United States Patent 10,696,975 (GENES AND USES FOR PLANT ENHANCEMENT) - sequence listing, part 4

SEQ ID NO: 12775 - protein, 471 aa, Frankia sp. EAN1pec
MTSSGKLVVVGQGYVGLPVAMRAVEVDWRVVGVDVDAGRVKRLAAGESYVEDVSRDRLAAALDSGRYEPTADFAAAAGFDVAVVTVPTPLREGAPDLGYVVEAARSLAPLVTPGATVVLESTTYPGTTEELFGPLLEEGSGLTAGDDFRLGYSPERIDPGNPTWRLENTPKVVSGVNGASLEAVRAFYDSLVDRTVSVASTRTAELTKLLENTFRHVNIALVNELAMFAHELGVDVWEAIDAASTKPFGFMPFRPGPGAGGHCLPIDPSYLSWRVRRRLGRSFRFVELANDINDHMPDHVVRRVIDMLNRRGRSVSGSRILLLGLAYKRNTGDSRESPAARVAALLADLGAGVLAADPHIDPAQAPGRVALVDADAAQIAAADLVVVLVDHDAFCRDLVMRHATAVLDTRRWLPAVSTGAAGAPVDHTQTGMPSGPARASVVDVPAAADLPVGAVVPAPRSEPRRVLIESL

SEQ ID NO: 12776 - protein, 125 aa, Triticum aestivum
GELGPTSHAPGRHGRGISVVAAEVFMLTGSTSAIRFGFVLGFALLALGISSLRSQRAGGRQPRLLLKGQAAIASVIFFKDLSVFFRHGWFPNVFAVLLSGMVVTFYIHRIVTGGHKGSTESSSDN

SEQ ID NO: 12777 - protein, 1046 aa, Streptomyces avermitilis MA-4680
MAKVRVYELAKEFGVESKVVMAKLQELGEFVRSASSTIEAPVVRKLTDALQQGNGGKAAPRKAAPAKPGAPSPAQAARPAAPRPPAPKPAAAERPAAAERPAAAPAAPGPRPGPKPAPRPAPAAPAPAAPEFTAPPSAPAAPAAAASGPRPGARPGAPKPGGARPATPGQGQGGQVRGERTDRGDRGDRGDRQGAARPGGQAPRPGARPAGPRPGNNPFTSGGSTGMARPQAPRPGGAPRPGGAGAPGGPRPQGAGGQDRAPRPQGGPGGAPRPQGGPGGARPTPGGMPRPQAPRPGGAPGGNRPNPGMMPQRPAAGPRPGGGGPGGRGPGGGGRPGGPGGGGGRPGGGGFAGRPGGGGGGFAGRPGGPGGGGGGFAGRPGGPGGGGGGRPGFGGRPGGPGGRGGTQGAFGRPGGPARRGRKSKRQRRQEYEAMQAPSVGGVMLPRGNGQSVRLSRGASLTDFAEKIGANPASLVGVMMNLGEMVTATQSVSDETLKLLADEMNFVLEIVSPEEEDRELLESFDIEFGEDEGGEEFLVARPPVVTVMGHVDHGKTRLLDTIRKTNVVAGEAGGITQHIGAYQVTTEVNDEERKITFIDTPGHEAFTAMRARGAKSTDIAILVVAANDGVMPQTIEALNHAKAADVPIVVAVNKIDVEGADPTKVRGQLTEFGLVAEEYGGDTMFVDISAKQGLNIESLLEAVVLTADASLDLRANPEQDAQGIAIESHLDRGRGAVATVLVQRGTLRVGDTMVVGDAYGRVRAMLDDKGENVEEAGPSTPVLVLGLTNVPGAGDNFLVVDEDRTARQIAEKRAARERNANFARRGVRFSLENLDEALKAGLVQELNLIIKGDASGSVEALESSLLQLDVGEEVDIRILHRGVGAVTESDINLATGSDAIVIGFNVRAAGRAAQMAEREGVDVRYYSVIYQAIEEIEAALKGMLKPEYEEVELGTAEIREVFKSSKLGNIAGVLVRSGEVKRNTKARLIRDGKVIAESLNISGLRRFKDDVTEIREGFEGGINLGNFNDIKVDDVIATYEMREKPRS

SEQ ID NO: 12778 - protein, 363 aa, Linum usitatissimum
IQMGLAENQVSFDLLEDYLAKHPEASSTTHNFKENALYQDYHGLKSFRQAMASFMSQIRGGRATFDPDRIVLTAGATAANELLTFILANPGDALLVPTPYYPGFDRDLRWRTGVKIVPIHCNSSTNFQVTKEALEAAYDDAVSMGLKVRAVLITNPSNPLGATVQRVVLEEILDFSVEKNIHLVSDEIYSGSTFSPDEFVSIAEVVNDRGSIRSESERVHIVYSLSKDLGLPGFRVGTIYSYNDAVVTTARRMSSFTLISSQTQHLLACMLSNAEFTENYISKNRERLRKRYEMIISGLRRAGIECLEGNAGLFCWMNMGPVLVEPTREAELSLWKLILKDVRLNISPGSSCHCSEPGWFRVC

SEQ ID NO: 12779 - protein, 418 aa, Arabidopsis thaliana
MNISSRGAAAIDESLVFGSSGVVYAPYGDYLKFVKKIIATKLLRPQVLERSRGLRAEELQRLYNRILDKAKMNENVEIGKEATMLMNNIFCRMSMGRSFSEENGEAERVRGLVAESYALAKKIFFASVLRRLLKKLRIPLFKKDIMDVSNRFNELLEKILVEHNEKLDEEHKDTDMMDVLLAAYADENAEYKITRNHIKSFFVELFVGGTDTSVQTTQWTMAEIINNSDVLERLREEIDSVVGTSRMIQETDIPNLPYLQAVVKEGLRLHPPFPLLTRKFEERCEIKGFYIPEKTFLIINAYAWMRDPDSWEDPNEFKPERFLGSSRLGQVDEREEAQKYIPFGGGRRGCPGANLASIFVGTAIGVMVQCFDWGIKGDKINMEETFEGLTLTMVHPIKCTPIPRTLPFVTSNLQSPSS

SEQ ID NO: 12780 - protein, 411 aa, Nicotiana plumbaginifolia
MNALAATNRNFKLASRLLGLDSKLEQCLLIPFREIKVECTIPKDDGSLATFIGFRVQHDNARGPMKGGIRYHPEVDPDEVNALAQLMTWKTRVANIPYGGAKGGIGCSPSDLSISELERLTRVFTQKIHDLIGVHTDVPAPDMGTNPQTMAWILDEYSKFHGYSPAVVTGKPIDLGGSLGRDAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNAKDIKAKFIVEAANHPTDPEADEILAKKGVVILPDIYANSGGVTVSYFEWVQNIQGFMWDEERVNTELKDYMNRGFKDVKDMCKTHNCDLRMGAFTLGVNRVARATTLRGWEA

SEQ ID NO: 12781 - protein, 313 aa, Paucimonas lemoignei
MTSCCGAVAKTRWRNVPDPCENTAYLPGHPLPAALKATADFSLALDHVAQGDGLLIAATSVAGLRPLAQQLQGKAIPNLVWLCKGLEEGSGLLPHQVVREVLGTQLPAGVLSGPSFAQEVAQGLPCALVIAAEDAALRELVVAAVHGPAIRVYSSDDVVGVEVGGAVKNILAIATGILDGMSLGLNARAALITRGLAEITRLGIALGARAETFMGLAGVGDLILTCTGDLSRNRKVGLGLAQGKPLETIVTELGHVAEGVRCAAAVRNLAQQLQIEMPITNAVAGILFDGHSPRATVEQLLARHPRDESISAS

SEQ ID NO: 12782 - protein, 409 aa, Schizosaccharomyces pombe 972h-
MKSATIIGGGSHPELLHLISNRLGITPCDVSLKRFANGETSVEIRESVRDKDVFILQSGSSTVNDSLMELLIIISACKGGSAKRITAVMPYFPYSKQSKMRKYRDAITARMVANLLTVAGVDHIITLDLHASQMQGFFTRPVDNLYAEPNIAEWIRRNVDDWEEAVVVSKNPGGAKRVTSLADTLNLDFALINTDRQRSSHFSQNFEDSIMDETEATETHVTNCSVYLDRPRIHTAKYLLGHIIDDEEIITTPASVCSEDYAQEVNLYSQGGCPSDDDEEENIMSASIYAERMITLVGDVNGKTALLIDDTIENPTAFIVASEHLVKRCGAKRVIVIGTHGIFQNKCLKDLQSCEYIEQIVVTNTYPIKPQAVLECDKLTVIDISGVLAEAIRRTHNGESISFLFKKAF

SEQ ID NO: 12783 - protein, 376 aa, Linum usitatissimum
IQMGLAENQLCFDLVENWVKNNPASSICTPEGSSGFKDIAIFQDYHGLPQFRNAVANFMAKVRGDRVKFDPDRIVMAGGATGAHETLAFCVANPGEALLVPTPYYPGFDRDLRWRTGIQLVPIECKSSNKFKLTIEDLEAAYETAKLNNIKVKGLLLTNPSNPLGTILDGETLRSVVAFTNSKSIHLICDEIYSATVFDGDAAEYVSIAEIVDEDRNSNVAPNRLNLDLIHLVYSLSKDMGFPGFRVGIIYSYNDVVVGCARKMSSFGLVSAQTQHLLGSMLADDDFVGEFIAANRRRLSERHRRFTAGLERVGIRCLRSGNAAGLFVWMDLRRMMKEQSVEAETALWKVIIDEVKLNVSPGTSFHCSEPGWFRVC

SEQ ID NO: 12784 - protein, 144 aa, Triticum aestivum
MAHMRVVHRDEEGHKVAEKVPVPETRRPDTARHVERKLEEQGLHRLERHPANAPRGVGIGAPPPKSGRGGKYTWEGPEGLVDSELDPAPAAIDRNDPNYEQEGEQDEVAEEVVVGQVEVAKVAQARAGVARVEVAPPLLHDHQQ

SEQ ID NO: 12785 - protein, 385 aa, Linum usitatissimum
IQMGLAENQLCFDMVEQWMNNNPSASICTSQGARGFKDIAIFQDYHGLPEFRNAVAKFMGKVRGERVKFNPDRIVMAGGATGAHETVAFCLADPGDAFLIPTPYYPGFDRDLRWRTGVQLVPIECQSSNNFKLRIEDLESAYDMAKLNNVRVKGLLLTNPSNPLGTILDGNTLRSIVSFTNDNNIHLICDEIYSATVFDKPDYVSVAEVVDEYLNNANDDGEGDDGNSNGPRPTLNLDLIHIVYSLSKDMGFPGFRVGIIYSYNDVVVSCARKMSSFGLVSTQTQHLIGSMLSDDDFVDEFIAANRRRLAERHRAFTGGLAEVGIRCLKTSNAGLFVWMDLRRLLKEQSVEAETALWRVIINEVKLNVSPGSSFHCSEPGWFRVC

SEQ ID NO: 12786 - protein, 313 aa, Desulfotalea psychrophila LSv54
MPNIIKIFSGNAHPQLADEIAAHLGMQVSEADVRKFSDGEIFVEIKKNVRGTDAFIVQPTCTPVNDNLMELVLMVDALRRASARRITAVVPYYGYARQDRKSAPRVPISAKVVAEMFMAVGVRRVLCMDLHAGQIQGFFNIPVDHLYAAPVLLKHIKKEFGEDVVMVSPDAGGVERTRAFAKRLNTGLAIIDKRRDRPNECEAMHVIGDVRGKVAILMDDMADTAGTICNGAKTLLENGAKEVHACCTHPVLSGPAVERITNSDLKSFVVTNTIPLGEEAKNCPKIKQLSVSALLADAIERIHNEDSVSSLFV

SEQ ID NO: 12787 - protein, 281 aa, Linum usitatissimum
CENWGFFEVLNHPIQVELLDTVEKMTKEHYRKCMEQRFKELVKSKGLEEVDSEIKDMDWESTFFLRHLPDSNINDIPDLEEDYRKVMKEFAVKLEKLAEELLDLLCENLGLEKGYLKKAFYGSKGAPTFGTKVSNYPPCPKPDLIKGLRAHTDAGGIILLFQDDKVSGLQLLKDGKWVDVPPMHHSIVVNLGDQIEVITNGKYKSVEHRVVAQTDGTRMSIASFYNPGSDAVIYPAPELIEKEEEEEKKVATTYPKFVFEDYMKLYAGLKFEAKEPRFEAM

SEQ ID NO: 12788 - protein, 332 aa, Rhodobacter sphaeroides 2.4.1
MKVLVIGGCGFIGSHVVDLLLQEGCRVRVFGRRPEAFRPPLAGVDYVMGDYSDPALVFRALHDVEAVLHLASATVPATANLNPGLDIEANLLATVRLLDVMRATGKRRLVFLSSGGTVYGVPQADPVPEEHPLRPIGSYGIVKVAIESYIRMEQALYGLAPVVLRASNPYGPRQGHTGVQGIIGTHLWRAARGEPVEIWGDGQVTRDFIHVRDLAALCVATLRSDTCGFFNAGSGTGTSVAEIVAGIDRTVQASGGPPVRALRQPGRGYDVPRVVLDISRARAAFDWAPRIGLEEGLAETWRWVCTTLAHETAAEAPPPRAKLARSRRSARF

SEQ ID NO: 12789 - protein, 643 aa, Synechococcus sp. CC9605
MHLGDLKHPNELHGLSPAQLEDVARQIRERHLQVVSTSGGHLGPGLGVVELTLALYQTLDLDQDRVIWDVGHQAYPHKLITGRFNDFDSLRQQHGVAGYLKRTESDFDHFGAGHASTSISAALGMAMARDNHGESFKCVAVIGDGALTGGMALEAINHAGHLPNTRLLVVLNDNDMSISPPVGALSNVLNRARLSPPMQFLSGSVEESVRHLPFMGGEIPAELNRLKGSMRRLAVPKVGAVFEELGFTYMGPIDGHDIGEMVRTFQAAHREGGPVLVHVVTKKGKGYPYAEADQVGYHAQSAFDLGTGKAIPSSKPKPPSYSKVFGQTLVKLCEQNSRVIGITAAMATGTGLDLLQKAVPDQYVDVGIAEQHAVTLAAGMACEGLRPVVAIYSTFLQRAYDQLIHDVGIQKLPVTFVLDRAGIVGADGPTHQGQYDISYMRAIPNFTVMAPKDEAELQRMLVTCLQHDGPTALRIPRGSGEGVPLMEEGWETLPIGRGELLREGDDLMIVAYGSMVAPALATATLLEEAGLSTTVINARFLRPLDQALIHPLARRIPRVVTMEEGALPGGFGAAVLESLTDQDINVSMLRIGIPDKLVDHATPQQSKEALGLTPAQMAERILERFSNTSGDLPASASIKALQA

SEQ ID NO: 12790 - protein, 509 aa, Synechococcus sp. CC9605
MTDYLQRILRARVYDVARETPLDPAPNLSRRLNNTVWLKREDLQPVFSFKLRGAYNRMAQLSDDELERGVIASSAGNHAQGVALSAQRLGCRAVIVMPSTTPEVKVRAVRALGGDVVLHGETYDECSAEAQRRCKADGLTFIHPFDDPEVIAGQGTIGMEIMRQAEQPPNAIYVAVGGGGLIAGIAAYVKRLWPETEVIGVEPVDADALSRSLEQGQRVELEQVGLFADGVAVRKVGEHNFELAQQFVDHMVRVDTDAICAAIKDVFEDTRSILEPAGALAVAGLKQDVAERQLEGRHLVAVACGANMNFDRLRFIAERAELGEEREAMLAVEIPESPGSLRRLCELLRERSLTEFSYRMTDGTSAQIFIGVQVYDDNDRASLLSQLERGGFPCLDLSENEFAKVHLRHMVGGRLPASARTACAGECKELLYRFEFPERPGALMSFVDALHPGWSISIFHYRNHGADVGRIVVGVLVPEKEMQGWTEFLNDLGYRHWDETNNPAYGLFL

SEQ ID NO: 12791 - protein, 355 aa, Botryotinia fuckeliana
MMCFGSREDVEAKRSKEIDALIHRDEKVMQRQVKLLLLAGAGESGKSTILKQMRLIYTDKGFSKTEKEEWRIIIFHNILDGLRMTVEAMNDFNTPFEHENTKQYLPMITEEKDLRPCEPIPLEYLKAFKDMWADSGIQKTVERGNEFALHDNLGYFFEDLDRLFSKEFVPTDQDVLRARLRTTGITETHFDLGSLQYRMFDVGGQRSERKKWIHCFENVNALLFLVAISGYDQCLAEDKDENQMQEALMLWESIANSHWFKHSALILFLNKIDLFKAKIGHSPITKFGFSDFQGDTTSWQQTSKYFMDKFIALNRSPGREVYGHFTNATDTDLLKVTMSSVQDMIIQRNLQKLIL

SEQ ID NO: 12792 - protein, 494 aa, Synechococcus sp. CC9605
MVVSAGIFSRDMGQFDLNRRTKIVATIGPATESPERIKELVKAGATTFRLNFSHGDHSEHAARIATIRQVSEELGQTIGILQDLQGPKIRLGRFAEGPITLANGDPFTLTSRPVSCDKTIATVTYDKLADEVTAGSRILLDDGRVEMKVDTVDKAEQTLHCTVTVGGVLSNNKGVNFPDVQLSVRALTDKDKTDLAFGLSQGVDWVALSFVRNPSDMEEIRGLICEQGHETPVVAKIEKFEAIDQIDSILPLCDGVMVARGDLGVEMPAEEVPLLQKELIRKANSLGIPIITATQMLDSMASSPRPTRAEVSDVANAILDGTDAVMLSNETAVGDFPVEAVQTMATIARRIEKDYPQRSIDSHLPSTIPNALSGAVSTIASQLNASAILPLTRSGATARNVSKFRPAAPILAITPDRTVACRLQLVWGVTPLVIPEGERTTQTFQAAMLKAKELNLLKESDLVVQSAGTHAGVSGSTDLVKVSIVGNEAEATLI

SEQ ID NO: 12793 - protein, 660 aa, Triticum aestivum
MDRHHHQQPPSPQGEHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNNRNDDASMGLNARDGSDNGSGTQSSWTKRAVEIDSPQDMSPDQSVDPPDSTCAHVSHLKSEICSNRLRGTNNKKCQKPKETNAEFKGKELEIGAPGNLNTEDQSSPNESSVKPADNGRCEYLPQNNSNDTVMENSDEPIVRAADLIGSMAKNMDAQQAARAIDAPNCSSQAPQGKDTDRENAMPYLELSLKRSRSTADGADAAIQEEQRNVVRRSDLSAFTRYNTCAVSNQGGAGFVGSCSPNGNSSEAAKTDAAQMKQGSNGSSNNNDMGSTTKSVVTKPAGGNNKVSPINGNTHTSAFHRVQPWTPATAAGKDKADEMSKKNAATAAAAKDNGGEAQSKRPCAAAHDANGGSSAGGTAQSNVVNPSGPVEGHAANYGSNSGSNNNTNNGSTAATAAAAVHAETGGIDKRSNMMHMKRERRVAAVNKFREKRKERNFGKKVRYQSRKRLAEQRPRVRGQFVRLPLRDNLPPHT

SEQ ID NO: 12794 - protein, 313 aa, Streptococcus pyogenes MGAS8232
MTKIYKTITELVGQTPIIKLNRLIPNEAADVYVKLEAFNPGSSVKDRIALSMIEAAEAKGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 12795 - protein, 660 aa, Triticum aestivum
MDRHHHQQPPSPQGEHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNNRNDDASMGLNARDGSDNGSGTQSSWTKRAVEIDSPQDMSPDQSVDPPDSTCAHVSHLKSEICSNRLRGTNNKKCQKPKETNAEFKGKELEIGAPGNLNTEDQSSPNESSVKPADNGRCEYLPQNNSNDTVMENSDEPIVRAADLIGSMAKNMDAQQAARAIDAPNCSSQAPQGKDTDRENAMPYLELSLKRSRSTADGADAAIQEEQRNVVRRSDLSAFTRYNTCAVSNQGGAGFVGSCSPNGNSSEAAKTDAAQMKQGSNGSSNNNDMGSTTKSVVTKPAGGNNKVSPINGNTHTSAFHRVQPWTPATAAGKDKADEMSKKNAATAAAAKDNGGEAQSKRPCAAAHDTNGGSSAGGTAQSNVVNPSGPVEGHAANYGSNSGSNNNTNNGSTAATAAAAVHAETGGIDKRSNMMHMKRERRVAAVNKFREKRKERNFGKKVRYQSRKRLAEQRPRVRGQFVRLPLRDNLPPHT

SEQ ID NO: 12796 - protein, 180 aa, Glycine max
TPRPRKSSFLKIEVPDSCSLLQLKDTVPRTISSSSSSLHLSLNRKDKIHAPSQEEPLNSLGVAIGNLIFYSLNPTVFTLETLLHKPETAPRDGPTIQDSSETLTSDSPFVLDAEKPPTLDAAELESMEMIDGSDETVVVGTNSEPFFMRRVLKEAPGNNVNDFKLLVFMVHGVVLESGFV

SEQ ID NO: 12797 - protein, 529 aa, Yarrowia lipolytica CLIB122
MLSRSTRLARVVQTSTRLYSTAYPTTHAKIENPVDTKAFINGQAVASKATTWFDLHDPATNNLVTRVPQSTDEEMRQAVEAAQKAFLTWKDTSIMHRQQVAFNFVRLIRDNWDRLAASITLEQGKTFADAKGDVLRGLQVAEQACSIPNTLMGESLEVAKNMRTEMYREPLGVVAAIAPFNFPAMVPLWSIPLALVTGNTLILKPSERDPGAALILAELITEAGAPPGTVNIIHGGAPTVNFICDAPEIKAISFVGGDAAGKHIHQRGGANGKRVQANLGAKNHCVLMPDADKNFALNSIVGAAFGAAGQRCMALSTLVTTQGTGSWMPELVERAKKLTINGGFEADADLGPVISPAAKARCEALIQSAIDEGATVLLDGRGQHPAKYPNGNFIGPTIITGVKPGMKCYDQEIFGPVLVVVDTTDLDDAIGLINRNKYGNGAAIFTRSGAAGNKFQKQIQAGQIGINVPIPVPLPMFSFTGNKGSFLGDLNFYGKAGVMFLTQYKTVTTQWRDEDVTSQKADVIMPTQS

SEQ ID NO: 12798 - protein, 384 aa, Synechocystis sp. PCC 6803
MPIAAAKPALLVLADGTPYPGWSFGADGTTVGEVVFNTGMTGYQEVMTDPSYCGQIVTFTYPELGNTGVNAEDEESIHPHVKGVVARNITRRPSNWRSTQSLPDYLVEHKIIGIYGIDTRALTRKLRSIGAMNGGISTEILEPEALLHHIQAAPSMAGLNLVKEVTTHEVYEWTDSTNDHWQFGPVAEQQGQPPLTVVALDFGVKRNILRRLASYGCRVIVVPASTSAAEILQYNPDGIFLSNGPGDPSAVEEGIVTTKELLAAKKPMFGICMGHQVLGLSLGAETFKLKFGHRGLNQPCGLEQQVEITSQNHGFAVTEGSLAEEVEITHFNLNDKTVAGLRHKELPFFSVQYHPEASPGPHDADYLFEKFVKLMRQQKAEVAG

SEQ ID NO: 12799 - protein, 470 aa, Streptococcus pyogenes MGAS8232
MEESMDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPRLQEKADFITKKVEEDGILYALEELGLIDKELQFPQLDLENHTGPKVTIKTNHGDMTLVLFPDHAPKTVASFLGLAKEGYYDGIIFHRIIPEFMIQGGDPTGTGMGGQSIYGESFEDEFSDELYNLRGALSMANAGPNTNGSQFFIVQNSKIPYAKKELERGGWPTPIAAAYAENGGTPHLDRRHTVFGQLVDETSFQVLDLIAGVETGAQDKPKEDVIIETIEVFD

SEQ ID NO: 12800 - protein, 528 aa, Synechococcus sp. WH 7805
MSQAPNEGQRQPAIVILDFGSQYSELIARRVRETEVFSVVLGYSTTAEELRRMAPKGIILSGGPSSVYAEHAPLCDPEIWNLGIPVLGVCYGMQLMVQQLGGRVVAATGKAEYGKAPLEVDDPTDLLTNVANGSTMWMSHGDSVEALPEGFVRLAHTANTPEAAVANHQRRLYGVQFHPEVVHSTCGMAMIRNFVYHICGCEPDWTTAAFIEEAVKQVRSQVGDKRVLLALSGGVDSSTLAFLLKKAIGDQLTCMFIDQGFMRKGEPEFLMDFFDRKFNIHVEYINARQRFLEKLKDITDPEQKRKIIGTEFIRVFEEESRRLGPFDYLAQGTLYPDVIESAGTNVDPKTGERVAVKIKSHHNVGGLPKDLQFKLVEPLRKLFKDEVRKVGRSLGLPEEIVRRHPFPGPGLAIRILGEVTAEKLNCLRDADLIVREEVKEAGLYHEIWQAFAVLLPVRSVGVMGDKRTYAWPIVLRCVSSEDGMTADWSRLPYDLMETISNRIVNEVKGVNRVVLDITSKPPGTIEWE

SEQ ID NO: 12801 - protein, 416 aa, Kluyveromyces lactis
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNNVIIGGGDTATVAKKYGVVDKISHVSTGGGASLELLEGKELPGVTFLSNKQ

SEQ ID NO: 12802 - protein, 556 aa, Oryza sativa Japonica Group
MAATAAYLPLRAQAQVGLAPLRPSGSAAAGARLPGRTARRRLAARGGPEAAGIRAEAVPGGGGVARRAAMVPPYNVLITGSTKGIGYALAKEFLKAGDNVVICSRSAERVESAVTDLKKEFGEQHVWGIVCDVREGKDVKALVDFARDKMKYIDIWNHKKAGFSPYLCVPLAQINNAGSNAYSYKPLVETSDEALMEVITTNTLGLMICCREAINMMRNQPRGGHIFNIDGAGSDGRPTPRFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKIMSNSQPAQEDDCMSSILVSRLIRAMQPTRSYLRWSDDLHKMFVEAVAYHGGPYEAKPTAVKETMQAMGVTSLTTHNIKSHLQKYRESFSSGVGSLHDHDLLRTTSPSKEALDLASEMVRDNDAAMAEIEMLNDLLLDHDIEMVETSFSVDDLQMMERELMSEIKLIEHNFEISESALDEYMDDLANYAFDLTGPANSSSP

SEQ ID NO: 12803 - protein, 418 aa, Tropheryma whipplei str. Twist
MSLIVQKYGGSSLASANNLKRVAERVSCAYYGNNRLVVVVSAMGSTTDRLLTLAHEVSVEPERRELDVLLSTGECVTASLLAMAINSIGLSARSFTAAQAGIVTDEHHCNARIITITPTPIEDALNAGEIAVVAGFQGVNRKGQVTTLGRGGSDTTAVALAAALKADRCEIYSDVEGVFTADPRIVPKARLLESIPIDHMLELSTAGARILSLRSVVFAKRHNVSVKVGSTFSDTSGTILCNEGEAMEEPVITGIATDTSQARITIVGLPDIPGSAAEVFSALSVAEVAVDNIVQNFSSSNTGFIDLSFTSPKAQGPAVTSALRENQTRIGYKDLQYDDEVGKITVVGSGIQHSADISAQLFRLLSDAKVNVEMISTSEMRISFVVRANVVAEVARLIHTSFGLDADLRAVVHSEGRV

SEQ ID NO: 12804 - protein, 325 aa, Vibrio parahaemolyticus RIMD 2210633
MKHIAIIGECMIELNGKPFGSMHQTFGGDTLNAAVYLSRGCEANSKPDKVKVSYVTALGNDPISTGMLTRWEDEGISTDLVLRDEIRTPGLYLIQLDDQGERTFLYWRNQSAARYLLQHPNFGIVKQALTQVDAVFLSGISLAILPEEDRISLLNLLVELKAQGVEIAFDSNFRPALWPQDNNQTVKNVYQAMYQLTDVALVTFDDEQLIWGDETPEQTIERLTSLGVGKCIVKLGADGCLVQDPTNQGSSAALAPQAVPTQPVAQVLDTTSAGDSFNGGFLSAYLAGADLATSCQRGNALAGAVIQHRGAIIPKAFTQPALGVV

SEQ ID NO: 12805 - protein, 383 aa, Synechococcus sp. WH 7805
MQDKLTLMIPGPTPVPETVLKAMGRHPIGHRSGEFQAVVERTNAQLRWLHQTSSDVLVITGSGTAAMEAGIINTLSRGDRVLCGDNGKFGERWVKVARAYGLDVDVIKAEWGQPLDPEAFRTALEADTDKTIKAVILTHSETSTGVINDLQTISSYVKAHGVALTIADCVTSLGATNVPMDAWGLDVVASGSQKGYMMPPGLSFVAMSDRAWTAYERSDLPKFYLDLGPYRKTAAKNSNPFTPAVNLYFALDAALEMMQSEGLEAIFARHARHRAAATAAMKAIGLPLFAAEGYGSPAITAVAPDGIDAEQLRKAVKERFDILLAGGQDHLKGHVFRIGHLGFVCDRDVLTAVAAIESVLQSLGLHKGEMGAGLSAASLALGN

SEQ ID NO: 12806 - protein, 603 aa, Arabidopsis thaliana
MDTKIGAIDTCKPTTGDIGSPPSNAVATIQDSAPITTTSESTLGRHLSRRLVQAGVTDVFSVPGDFNLTLLDHLIAEPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNNLEDAHEQIDKAIATALKESKPVYISISCNLAATPHPTFARDPVPFDLTPRMSNTMGLEAAVEATLEFLNKAVKPVMVGGPKLRVAKASEAFLELADASGYPLAVMPSTKGLVPENHPHFIGTYWGAVSTPFCSEIVESADAYIFAGPIFNDYSSVGYSLLLKKEKAIIVHPDRVVVANGPTFGCVLMSDFFRELAKRVKRNETAYENYERIFVPEGKPLKCKPGEPLRVNAMFQHIQKMLSSETAVIAETGDSWFNCQKLKLPKGCGYEFQMQYGSIGWSVGATLGYAQATPEKRVLSFIGDGSFQVTAQDISTMIRNGQKAIIFLINNGGYTIEVEIHDGPYNVIKNWNYTGLVDAIHNGEGKCWTTKVRYEEELVEAIKTATTEKKDSLCFIEVIVHKDDTSKELLEWGSRVSAANGRPPNPQ

SEQ ID NO: 12807 - protein, 522 aa, Tropheryma whipplei str. Twist
MMRSEQALYRRYRPEVFSEMVGQDGVTGLLSSALDNNRLGHAYLFSGPRGCGKTTSARVFARCLNCVNGPTSSPCGKCQSCIDLGRSGNGSLDVIEIDAASHNGVDDARALRERAIFAPAQSRFRIFILDEAHMVTTQGFNALLKIVEEPPAHVKFIFATTEPEKVLGTIRSRTFSYPFALVSASVMQPYIADICNKEKIRVEDGVLPLVVRAGGGSVRDTLSILDQLMVGKCITYESTVGLLRLAPDILLYDLFLAIAEDDGATAFASIEKVVEAGYEPVQFIEDLMSWVKDMTLAVCNAEGVFDSYAPEKVERIFALSKRFSLKDLDAMAEILFSRSNRLSGPISPRLLLEIMLASLLLAVGKSKLQVSDRVSDTQRQKGYPGNLLHNWSRVLDALKSETANMLQHSKPLRLTGSSLTIGMPQEILSRFVANKAAIDDLKSVLYKITGVQLRLSGKPIDDPDNTVKTPSSCLDNGTVTDNSGHKNTEVDDAETKEKPDNPITGEAVLVQAGAKLISEEEQ

SEQ ID NO: 12808 - protein, 394 aa, Silicibacter pomeroyi DSS-3
MFENLKAQPADKILALMQMYKDDPRSDKIDLGVGVYKNAEGVTPVMRAVKAAEKIVWEQQESKSYTGLIGDPAYSDAMIKLILGDAVQRANVGAAATPGGTGACRQAFELIKMASPEARVFVSDPTWPNHISILNYLGMTMVPYRYFDADSRGVDFEGMLVDLGQARAGDVVLLHGCCHNPTGANLNLSQWREVVKLINAKGLVAMIDIAYQGFGDGLEEDAQGTRLVASSVKECLIAASCSKNFGVYRERTGLLMAVSQDSGQTALNQATLAFLNRQNYSFPPDHGARVVTTILNDDALRADWMAELEEIRLSMLGLRQQLADELQRLSGSDRFSFIAQHRGMFSRIGAAPELVEKLRTEFGIYMVGDSRMNIAGLNAQTVPILAKAIIDAGI

SEQ ID NO: 12809 - protein, 488 aa, Neisseria meningitidis Z2491
MMKLGFKPIPLAIAAVLCALVLALPVPDGVKPQAWTLLAMFIGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 12810 - protein, 267 aa, Schizosaccharomyces pombe
DRTVSVWDVNSRFILYKLYGHSGSVLCLDFCRRRNLLVSGSSDSTIIIWDWQNRRPLKVYFGHTDNVLGVVVSENYIISSSRDHTARVWRLDATSPAEACMHVLRGHLASVNSVQYSSKTGLIVTASSDRTLRTWDITTGHCIRIIHAHQRGIACAQYNGKFIVSGSSDLTIRIFEASSGKLLRMLQGHEDLIRTVRFNDEKIVSGGYDGTVRIWNFNTGEQHCVLHNSRNSRVFGLQFDHRRIIACTHSSEILVWNFDDGLDCTFF

SEQ ID NO: 12811 - protein, 182 aa, Buchnera aphidicola str. APS (Acyrthosiphon pisum)
MNLNKIVAGDDIPNDIYVIIEISSNSSPIKYEVDKKSGMLFVDRFIPTPMFYPCNYGYINHTLSLDGDPLDVLVPSHYPIKSSCVIHCKPIGILNMQDESGDDAKIIAVPKSKICQEYKNINDISDISELLKKQITHFFQNYKTLEKEKWVEIIGWGNCQDAKLEINDAYNRAKKNSIFLNK

SEQ ID NO: 12812 - protein, 266 aa, Brassica napus
MASLVESGWQYLVTHFSDFQLACIGSFLLHESVFFLSGLPFIYLERQGFLTKYKIQAKNNTPAAQEKCITRLLLYHFCVNLPLMMASYPVFRAMGMRSSFPLPSWKEVSAQILFYFIIEDFVFYWGHRILHTKWLYKNVHSVHHEYATPFGLTSEYAHPAEILFLGFATIVGPALTGPHLITLWLWMVLRVLETVEAHCGYHFPWSLSNFLPLYGGADFHDYHHRLLYTKSGNYSSTFVYMDWIFGTDKGYRRLKSLKENSNLKQT

SEQ ID NO: 12813 - protein, 514 aa, Zea mays
MNGGAAPPSAAAAATPPHRRLPDFLQSVNLKYVKLGYHYLITHLLTLMLLPLMAVILLEAGRTDPEDLRQLWLHLQYNLVSVLVLSAVLVFGATVYVLTRPRPVYLVDFACYKPPAHLQVRFEEFMRHSKLCGFSDDALEFQRKILERSGLSEETYVPEAMHALPPQPTMANARAEAETVMFGALDSLFRSTGVRPKDVGVLVVNCSLFNPTPSLSAMIVNKYKLRGNVRSFNLGGMGCSAGVIAADLARDMLQVHRGTYAVVVSTENITQNWYFGNRKSMLIPNCLFRVGGAAVLLSNRGGDRRRAKYVLRHVVRTHKGADDRAFNCVYQEQDGEGKTGVSLSKDLMAIAGGALKTNITTLGPLVLPVSEQLLFFATLVAKKLLVSAKTKPYIPDFKLAFEHFCIHAGGRAVIDELEKNLQLSPAHVEASRMTLHRFGNTSSSSIWYELAYMEAKGRVRRGHRVWQIAFGSGFKCNSAVWHALRNVKPSPDSPWEDCIDRYPVELVDGFPAHQ

SEQ ID NO: 12814 - protein, 331 aa, Schizosaccharomyces pombe 972h-
MRVLRNFTIFFLFTALSLFRQISASAGDLHPVYVSCVNRCIENKCHGNPSDTSKLPLDLKLFRWDCGSNCGYECEITAENYFAAHNLPSQQYHGKWYFIRVFGIQELFSVFFSMLNFMIHYNGYHIMRRCIPDEHPAKRLCLSWAIVGMNAWVWSSVFHIRDTPITEKLDYFSAGAFVLFGSYCTLILMLRLDQLPGGKLLCWIIGVIFIAAFIAHVSYLSFYSFDYGYNMKANVAVGLVQNILWYYYSWSNRNSGLYWTRWPAYIVTSLMLATSLELFDFSPIANLIDAHALWHLSTVPITHYLYGFVVRKCSYDLTKGTFKIKAYDSSR

SEQ ID NO: 12815 - protein, 335 aa, Rubrobacter xylanophilus DSM 9941
MKAILVREFGGPEVLEHVEVERPEPGEGQVLVEVRSAGVNYADAMRRRNRYLAPQSLPFVPGSEVAGVVAEAGPGVEGVSVGERVAALVGEGGYAEYALVPASGLIPVPEGLGFDEAAAIPLQGLTAYLVLRDSARLAEGETVLVHAAAGGVGYLAVQMARLLGARRVVATASSPEKLEVARSLGADVLIDYTEEGWPESTEEGWPERVREATGGRGADVILEMVGGDFPRKNLGCLAPSGRMVVYGSASGERSEVPLLELMRKQQTVSGFWLARYLSDPRLRGRTGEALREILSWLSSGRLRLNIGGRYPLAEAARAHADLEGRRTTGKLVLNP

SEQ ID NO: 12816 - protein, 114 aa, Triticum aestivum
  misc_feature (4)..(5): Xaa can be any naturally occurring amino acid
  misc_feature (9)..(9): Xaa can be any naturally occurring amino acid
EVWXXETNXHDAPVPPCITQLQGGLVQVAIEVEDRAQRSAITRVNADDVRVAVAAPAARGEANNELLEFMGKVLGLRLSQMTLQRGWNNKSKLLIVEDLSARQVYEKLLEAVQP

SEQ ID NO: 12817 - protein, 193 aa, Leuconostoc mesenteroides subsp. mesenteroides ATCC 8293
MNLPNKLTVFRIILIPVFILLLTVPYAWSNISFLGATMPVNWLIAAVVFAIASATDFLDGQIARSQHLVTNFGKFADPLADKLLVMTALIFLTSFNVVPAWMTAVIVIRELAVTGLRTLIVENNGKVLAAQMPGKIKTFSQMFAIFFLYIHNAPFSIINFPIGDVLLWVAVIFTIYSGIDYFWQNRNVFSDGM

SEQ ID NO: 12818 - protein, 494 aa, Paxillus involutus
  misc_feature (141)..(141): Xaa can be any naturally occurring amino acid
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTXVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 12819 - protein, 234 aa, Glycine max
MSKSEDLKLLGGWFSPFALRVQIALNLKGLEYEVVEETLNPKSDLLLKSNPVHKKIPVFFHGDKVICESAIIVEYIDEAWTNVPSILPQNAYDRANARFWFAYIDEKWFTSLRSVLVAEDDEAKKPHFEQAEEGLERLEEVFNKYSEGKAYFGGDSIGFIDIGFGSFLSWMRVIEEMSGRKLLDEKKHPGLTQWAETFAADPAVKGILPETDKLVEFAKILQLKWTAAAAAAAK

SEQ ID NO: 12820 - protein, 494 aa, Paxillus involutus
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 12821 - protein, 494 aa, Paxillus involutus
  misc_feature (314)..(314): Xaa can be any naturally occurring amino acid
KLQQIYDAEHPRLILKELFSQDPHRFAKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGXWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 12822 - protein, 280 aa, Synechocystis sp. PCC 6803
MNLLSQLFAPPSPVPSPTPKAKKRSRRGVQIKTPAEIAIMRQAGAIAAQVLKEIAATVQPGMTTGDLDQLAEERIRSLGATPSFKGYHGFPASICACVNNEVVHGIPRRRKKIRSGDLLKVDTGAYFQGYHGDSCITIAVGKVSPQAQRLMEVAEGALYAGIEQVKPGNYLMDIAGAIEDYVKPTGYTIVEEFTGHGVGQALHEDPHVFNVRCRDLPNVKLKPGMTLAIEPIVNAGSRFTRTLGDRWTVVTVDNALSAQFEHTVLVTATGYELLTDRRLV

SEQ ID NO: 12823 - protein, 556 aa, Arabidopsis thaliana
MASRRVLSSLLRSSSGRSAAKLGNRNPRLPSPSPARHAAPCSYLLGRVAEYATSSPASSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 12824 - protein, 661 aa, Aegilops tauschii
MDRHHHQQPPSPQGEHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSGSAIQTQKCTKSKSGDDSNNNSNNRNDDASMGLNARDGSDNGSGTQSSWTKRAVEIDSPQDMSPDQSVDPPDSTCAHVSHLKSEICSNRLRGTNNKKCQKPKETNAEFKGKELEIGAPGNLNTEDQSSPNESSVKPTDNGRCEYLPQNNSNDTVMENSDEPIVRAADLIGSMAKNMDAQQAARAIDAPNCSSQAPQGKDTDRENAMPYLELSLKRSRSTADGADAAIQEEQRNVVRRSDLSAFTRYNTCAVSNQGGAGFVGSCSPNGNSSEAAKTDAAQMKQGSNGSSNNNDMGSTTKSVVTKPAGGNNKVSPINGNTHTSAFHRVQPWTPATAAGKDKADEMSKKNAATAAAAKDNGGEAQSKRPCAAAHDTNGGSSAGGTAQSNVVNPSGPVEGHAANYGSNSGSNNNTNNGSTAATAAAAVHAETGGIDKRSNMMHMKRERRVAAVNKFREKRKERNFGKKVRYQSRKRLAEQRPRVRGQFVRQPPPPAAVER

SEQ ID NO: 12825 - protein, 728 aa, Oryza sativa Japonica Group
MDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 12826 - protein, 178 aa, Heterocapsa triquetra
MALYATSTMLEMAQCDPASSFWGMLGVSSAIVFANLGAAYGTAKSGVGISSMGVMRPDMVMRSIIPVVMAGVLGIYGLITAVIINGKIHAPSYSAFSGYAHLAAGLTVGMSSLAAGLAIGIVGDAGVRANAQQPKLFVGMILILIFAEALGLYGLIVGLVVASTAEGKGRDLCKPWDR

SEQ ID NO: 12827 - protein, 240 aa, Saccharomyces cerevisiae
MADEERLKEFKEANKIVFDPNTRQVWENQNRDGTKPATTFQSEEDIKRATPESEKDTSATSGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 12828 - protein, 213 aa, Synechocystis sp. PCC 6803
MACERAKGNSPQLRLGTRGAQRVKCDRVLSPFGCDSFVFRWRKIVDLSRIPAQPKAGLINVLIEIPAGSKNKYEFDKDMNCFALDRVLYSSVQYPYDYGFIPNTLADDGDPLDGMVIMDQPTFPGCVITARPIGMLEMIDGGDRDEKILCVPAKDPRYTYVKSINDLAGHRLDEIAEFFRSYKNLEKKVTEILGWKDVDAVLPLVEECVKNYK

SEQ ID NO: 12829 - protein, 404 aa, Tropheryma whipplei str. Twist
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRITGRMIHSSFELAELVLSETLVATVPGEAFGTKGHLRLSYALDETSLLEGTGRLVEFFDTANSDMTKVF

SEQ ID NO: 12830 - protein, 282 aa, Zea mays
MAGGGQAAISFMTRMAKVAAGLGVAASAASTSFYTVDGGERAVIFDRVRGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDEVAITHLAYGQEFAQAVEKKQVAQQEAERSRFLVARAEQERRAAIVRAEGESEAARLISEATTTAGNGLIELRRIEAAKEIASVLSRTPNVSYIPAGDNGQMLLGLNAAR

SEQ ID NO: 12831 - protein, 308 aa, Synechococcus sp. WH 7805
MHDSFVNRCQPLPAGSKLCILGAGFSGSRLASLASALQIPVISTRREPSPDSEHLAFDTATGQAPDRRQLEGITHLLNTIPPDRDGNDPVLKTLGDQIQQWPLRWVGYLSTTGVYGNTDGAWVCEDDPPEPTQDRSRRRLACEQEWQASGLPLQILRLPGIYGPGRSALAAVKAGTLQPVDKPGQMFCRIHVDDVAAACLHLMHRSAQGQHPEIVNVCDDEPAASVSVHRYAASLLNCELPQPKPFTEAEASMSAMARSFWADNRRVSNQRLRQDLGYELIYPTYRSGLAQCLEIETLTESRTPSSPA

SEQ ID NO: 12832 - protein, 620 aa, Kluyveromyces lactis NRRL Y-1140
MTGATGSSNSDFISPVGSDVKHNDKSDTIIQSEGFPSIEGEAEYYEKTFSQSDEEYAAKSSVWHRFKDSFKRADHINTNIHGNAELELNPSQSLLPEKGASLKRDIKPRHVVMMSLATGIGTGLLVGNGKALATGGPAGLTIGYAIMGSCLYSIIQAAGELAVAYPTLTGNFNNYPSFLVDPAMCFATAALYCIQWLCVFPLEVISAAITIKYWNTSINPNVWCVIFYVMIIGINMCGSAGYAEADFFFNTCKILMFAGFFILGIIINCGGAGDSVYIGGKYWNDPGAFNGDTGISRFKAIVSTLVTAAFAFGASEAVALTASEQANPRKAIPSAAKQVLYRIIAIYLASIILVGFLVPYNSPELMGSGSSSVHSSPYVIAVASHGVKVVPSFINAVILISVLSVGNFSFYSSSRILLCLSEIGYAPKFFQYVDRQGRPLYAMIVGALVGCICFVSASSAEESVFTWLMAVSGLSQLFTWTNICISHVRFRKAMQVQNRSIGELGFRSQVGVWGSYYGIFMMILVFIGQFWVALFPVGGTDGADAENFFANYLAMPVFLALYFGFKIWKKDWRLYIPASEIDLISHRKIFDEEILKQEDEEYKIKMKHASIWVKLSNFWC

SEQ ID NO: 12833 - protein, 1112 aa, Kluyveromyces lactis NRRL Y-1140
MNGNGITTLKGDTIGPWKLGSTLGVGSTGKVVMAYNETKGQQAAVKIISKSIFNAQGSTMIGGNDPDVLPYGIEREIIIMKLLNHPNVLRLYDVWETSKDLYMVLEYVEKGELFNLLVERGPLPENEAVRFFRQIIIGISYCHALGIVHRDLKPENLLLDHKFNVKLADFGMAALESKDKLLETSCGSPHYAAPEIVSGLPYHGFESDVWSCGVILYALLTGRLPFDEEDGNIRNLLLKVQSGKFEMPGDDEISSEAQDLIARILTVDPEQRIKTREILKHPLLRKYPSIKDSKSIRNLPREDTYLNPLSLEGGNQCVDETILQNLVVLWHGRNKEDIITKLMEPGANLEKTFYALLHRFKHDNYQDQLKQQELQKKQSVSSNSLMYVGSLPSPNKSDSPVTTPKKKRTSIIVASSSHKRPVSMQKLSSQHSSPVKNGSIGKRLSKTFPSNKRISQLVSNSSSPTPAAHKRVSRINDSAAPPVPKEMLRDYKRQSKRQSKRFSLLPNMKRGSITTKLIATYAKLSEDSEWEYIEKETKRTSQDFATLMDQIFEHEKYEQIRKEKEELERKVNEAREKEEAERKERERIEREEQERLEREERKRAERQKELQDQMEDEIAKLKAEYEAVQGSSDERNTANGRSVSAPIETDRTANKRDSTFGIKNDINELINTRNFSLQTRPVSRLDPGIIAAESRLSANLEDDQASKEKTILETIRRSKFLGSQFNLNVELEKAQKDLVSKERQEQLRKYSEQTAKYEVQKLPKNAKAVATLRDDEVEPRKLSEVKVPQFTRRSKHFSSSNKRFSVLSLYSTKTSFTNLVDHLKNDNYLEPLPGQPEYSSSKVAQEPEFMFETVEELDENSKLFEVPETEEGKLASAARKESTDARKQSTNDKDINLPSLPPLQVSHDVADENGALGLGIYQPNDQTQKPHKTMLIDESIDENISSTSDVSRTEVVKKPPLNDVVRKNNNERKPLEEITPKVENKRKISFFRKFSQGSEKKLGPESFDSQLKAGVSAPKMYKALDRLLNEWTNYGLKHVESSPNDFVISGKLTSDNILSLRSTGFKITVLPGEGNGSIIQFTKKSGSTKTFNRLVKEIEKILEKEKVLVFSF

SEQ ID NO: 12834 - protein, 237 aa, Glycine max
  misc_feature (29)..(29): Xaa can be any naturally occurring amino acid
ATHPDTLKAALAEFISTFIFVFAGSGSGXAYNKLTDNGAATPAGLISASIAHAFALFVAVSVGANISGGHVNPAVTFGAFVGGNITFLRGIVYVIAQLLGSIVASLLLAFVTASTVPAFGLSAGVGVGNALVLEIVMTFGLVYTVYATAIDPKKGNLGIIAPIAIGFIVGANILLGGAFSGAAMNPAVTFGPAVVSWTWTNHWIYWAGPLIGGGIAGLVYEVVFISHTHEQLPTTDY

SEQ ID NO: 12835 - protein, 199 aa, Crocosphaera watsonii WH 8501
MTMEGCLRVGQLAPDFTATVVIDQEFQTKKLSSYRGKYVILFFYPLDFTFVCPTEVIAFSERYEEFSKINTEILAVSVDSEFSHLAWIQTPRTEGGVGDVAYPLVSDLKKDISNAYNVLDPESGVALRGLFIIDKEGIIQHSTINNLSFGRSVSETLRTLKAIQHVQNNPEEVCPADWQEGDKTMIPDPIKSKIYFSAV

SEQ ID NO: 12836 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFAEYFQQGDMESNGKFVTKGGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 12837 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCDESGKA

SEQ ID NO: 12838 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFADYFQQGDMESNGKFVTKGGERVDYQTGPIIWGAAGTNGQHSLYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 12839 - protein, 468 aa, Buchnera aphidicola str. APS (Acyrthosiphon pisum)
MSRQQIGVVGMAVMGRNLALNIESKNYSVSIFNRTRSVTEEVFNQNKKKNIVPYFSIKDFIDSLLKPRCILLMVQSGKATDETIKMILPYLEKEDILIDAGNTFYKDTIRRNEKLSKYEINFIGMGVSGGELGALNGPSIMPGGQKEAYKLVLPMLEKISAKFKGEPCVSYIGPNGAGHYVKMVHNGIEYGDMQLISESYFLLKYLLNMSNEELSSTFSKWNKGELNSYLIEITKNIFIEKDEKGKYLIDRILDVAEDKGTGKWISKSALDLREPLSLITESVFARYLSSLKRQRIIASKILQGPKIKTFIKDKNSFIEEVRRALYLGKIISYAQGFSQLKRASEKYHWNLKYGEIAKIFRAGCIIRANFLQKITDEYTQNKNVVNLLLTPYFSKIANEYENSLRNIVMYAIKYGISTPTFSAAISYYDSYRALYLPANLIQAQRDYFGSHTYQRTDQTGYFHTNWSQ

SEQ ID NO: 12840 - protein, 274 aa, Magnaporthe grisea 70-15
MNIPRIFRHTLTRGAPSVSRVAACQRASLNLSNARSFSHSRPPQAGVPMPLVTEVTAGGWRTSDIFSKLLQERIVCLNGPIDDWTQASVTAQLLWLEQDSPHKPITLYINSPGGQVSSGLAIYDTMNYISSPVHTVCVGMAASMGAILLLGGAAGQRYALPHSQIMVHQPLGSTQGQASDIIIYAKQITRIRSQINDIMRRHLNTAAGRERFAAQEVDEMMERDKYLTADEAVELGIVDKILTSRSDAVASALNDATGGRSAAAPAEAQDEKKN

SEQ ID NO: 12841 - protein, 161 aa, Antirrhinum hispanicum
ASEVAEKKTLTLTSSDGQDFTVSESGGCLSEMIKNMVEDDCVTTAIPIPVVDSKTLAKVIVFLDKHGDSTISSDDMKKFDEEYVTGVEMGILFDLAAAANYLNIKDMMEVVTQKIADIMENKSVAWVRKTFGIENDLDPEEEKALQDEYPWAFEGLDPDSD

SEQ ID NO: 12842 - protein, 465 aa, Xanthomonas axonopodis pv. citri str. 306
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 12843 - protein, 556 aa, Arabidopsis thaliana
MASRRVLSSLLRSSSGRSAAKLVNRNPRLPSPSPARHAAPCSYLLGRVAEYATSSPASSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 12844 - protein, 461 aa, Mesorhizobium sp. ZJ15B7
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 12845 - protein, 263 aa, Rhodobacter sphaeroides 2.4.1
MDLTGKTALITAGAGGIGLAIARRFADLGAQLCLCDISETAIAEAQALLPEALILRADVARSADVQEVVDRLVERFGGLDILVNNAGVSGPTRPVDEITDAEWNDTLAVNITAMFYMVRAAVPLFRAAGGGAVINMGSVAGRVGMPLRLPYSVSKYAVRGLTETLAIELGEIGVRVNAILPGLVDGPRGRRIIAEQARERGLSPEDYTRLFLHNISMHSMVQMEEVADMAAFLASDLAPHVSGQMIGVCGNFESYRAPLTVPA

SEQ ID NO: 12846 - protein, 136 aa, Vitis vinifera
MNQNQGGNDARHDDDSALSDFLASLVDYTPTIPDELVEHYLAKSGFQCPDVRLIRLVAVATQKFVTEVASDALQQCKARQSAVVKDKRDKQQKDKRLILTMEDLSKALREYGVNVKHQEYFADSPSSGMDPASRDE

SEQ ID NO: 12847 - protein, 115 aa, Triticum aestivum
MSSIGSSNIGFQLLKKSGWKEGTGLGAQEQGRLEPVETRVKNNKRGLGSKEPKPKPKVEDDVETAPSKRPKQDAPATKKAKLAAKRIRKMQEEEKRAQEREFEIAFFREFWPDNV

SEQ ID NO: 12848 - protein, 136 aa, Vitis vinifera
MNQNQGGNDARHDDDSALSDFLASLMDYTPTIPDELVEHYLAKSGFQCPDVRLIRLVAVATQKFVAEVASDALQQCKARQSAVVKDKRDKQQKDKRLILTMEDLSKALRECGVNVKHQEYFADSPSTGMDPASRDE

SEQ ID NO: 12849 - protein, 517 aa, Streptococcus mutans UA159
MTDIKDIQKIIVLDYGSQYNQLIARRIREFGIFSELRSHKVTADEVRAINPIGIVLSGGPSSVYAEDAFDIDKEILDLGIPVLGICYGMQLLTEKLGGKVVPAGQTGNSEYGQSTLHLTENSELFKETPAEQTVLMSHGDAVTEIPEGFQLVGKSSDCPYAAIENVEKKIFGIQFHPEVRHTEYGNAILRNFAFNVCKAKGDWSMDSFIDMEIEKIREQVGNRKVLLGLSGGVDSSVVGVLLQKAIGDQLTCIFVDHGLLRKGEGDQVMEMLGGRFGLNIIRVDASKRFLDLLAGIDDPEKKRKIIGNEFVYVFDDEASKQKGVDFLAQGTLYTDVIESGTETAQTIKSHHNVGGLPEDMQFELIEPLNTLFKDEVRTLGTALGMPDEIVWRQPFPGPGLAIRVMGEITAEKLETVRESDAILREEIAAAGLNRDIWQYFTVNTGVRSVGVMGDGRTYDYTIAIRAITSIDGMTADFARIPWEVLQKISVRIVNEVEHVNRIVYDITSKPPATVEWE

SEQ ID NO: 12850 - protein, 427 aa, Synechocystis sp. PCC 6803
MNIAVVGLSHKTAPVEIREKLSIQEAKLEEALTHLRSYPHIEEVTVISTCNRLEIYAVVTDTEKGVVEITQFLSETGNIPLATLRRYLFTLLHEDAVRHLMRVAAGLESLVLGEGQILAQVRTTHKLGQKYKGVGRLLDRLFKQAITAGRRVRTETDIGTGAVSISSAAVELVHRQVDLSSQKTVIIGAGKMACLLVKHLLAKGATDITIVNRSQRRSQDLANQFPQAQLTLCPLTDMFTAIAAGDIVFTSTGATEPILNCENLTGCVINRKSLMLVDISVPRNVAADVHAMEQVRAFNVDDLKEVVAQNQASRRQMARQAEALLEEEIAAFDLWWRSLETVPTISSLRSKVEDIREQELEKALSRLGSEFAEKHQEVIEALTRGIVNKILHEPMVQLRAQQDIEARKQCLRSLKMLFDLEVEEQFG

SEQ ID NO: 12851 - protein, 288 aa, Staphylococcus epidermidis RP62A
MKKIKKAIIPAAGLGTRFLPATKAMPKEMLPILDKPTIQYIVEEASKAGIEDIIIVTGKHKRAIEDHFDNQKELEMVLENKGKADLLEKVQYSTDLANIFYVRQKEQKGLGHAIHTAKQFIGNEPFAVLLGDDIVESDTPAIKQLMDVYEETGHSVIGVQEVPESDTHRYGVIDPSAKEGSRYEVRQFVEKPKQGTAPSNLAIMGRYVLTPEIFDYLETQQEGAGNEIQLTDAIERMNSKQQVYAYDFEGNRYDVGEKLGFVKTTIEYALKDPEMSQDLKAFIKQLDI

SEQ ID NO: 12852 - protein, 230 aa, Dehalococcoides ethenogenes 195
MIKDIRNVFSKDPAARSVAEVLFCYPGLHALWFHRVANWLWRHKLHFWARWLSHGGRFCTGIEIHPGAKIGQRFFIDHGMGVVIGETSEIGDDVLMYQGVVLGGTSLSKGKRHPTIGSNVVIGTGAVVLGGITVGEGAKIGAGSVVTKDVPAGATVVGIPGRVVEESRQMVIDLEHGKLPDPVADALKVVLAEQQKLMDRLAQLEKNSELKVPQDELRGQIREIMKEFNL

SEQ ID NO: 12853 - protein, 605 aa, Candida glabrata CBS 138
MPKNPLKKQYWTEVIDGFHSPDRTDSANDRSSSPDNFELSSVNSPVRVNVSSSGNDDILKGDTKEYPRDVKATPEAASYVEDINNTNLNKDLSVRHLLTLAVGGAIGTGLFVNSGASLTTGGPASLVIGWVIVSTCLFTVINSLGELAAAFPVVGGFNVYITRFIEPSFAFAINLNYLAQWLVLLPLELVAASITIRYWNDKINSDAWVAIFYTAIALANMLDVKSFGETEFILSMVKILAIIGFGILGIVLTCGGGPHGGYIGGKYWHNPGAFVGHSAGSQFKGLCSVFVTAAFSYSGIEMTAVSAAESRNPKETIPKAAKRTFWLITVSYVGILTLIGCLVPYNDPRLLNGSSSVDAAASPLVIAIENGGIKGLPSLMNAIILIAIVSVANSAVYACSRCMVSMAHIGNLPKFLSKVDKRGRPLNAILLTLFFGLLSFIAASDKQEEVFTWLSALSGLSTIFCWMAINLSLIRFRDAMKAQGRSLDEMPFLSQSGTWGAWYGVIVLFLVLVASFWTSLFPVGSSTASAKSFFEGYLSLPILIACYVGHKLWKRDWRLLVPLMEMDLDSGRRVLDAETREEELRVEREYLANASFFTRFLHIWC

SEQ ID NO: 12854 - protein, 161 aa, Silicibacter pomeroyi DSS-3
MISVGDTLPDATFMVFSDKGPETVDLEPKLKGRKVVMFGLPGAFTRGCSMTHLPSFIRTRQALADKGVDEVICVSVNDPFVMTAWGQQSGAAEAGITMLADPTAEFTKAIGLAFSAPVVGLYDRCQRFALMAEDGVVKVLNLETEAGACKLTVGEELLEQI

SEQ ID NO: 12855 - protein, 341 aa, Synechococcus sp. WH 7805
MTLRVAINGFGRIGRNVMRGWLSRGADTGLEIVGMNSTSDPKTSAHLLTYDSILGHIDRSVQIETTDETMIVNGKEIKFFADRNPLNCPWKDWGVDLVIESTGVFNTDEKASMHLEAGASKVILTAPGKGDGVGTFVVGVNDDQYRHEDWNILSNASCTTNCLAPIVKVLDQSFGLDWGLMTTIHSYTGDQRILDNSHRDLRRARAAALNMVPTTTGAAKAVALVYPEVKGKLTGFAMRVPTPNVSAVDLTFGPSRATNVEEVKAVIKAASENGMKGIIKYSDLPLVSTDYAGTNESTIFDADLTYAMGDKAVKILAWYDNEWGYSQRVVDLAEVVARNWK

SEQ ID NO: 12856 - protein, 369 aa, Salmonella typhimurium LT2
MATLSRLFIHPVKSMRGIGLTHALADISGLAFDRIFMVTEPDGTFITARQFPQMVRFTPSPLHDGLHLTAPDGSSALVRFTDFTPQDAPTEVWGNHFTARVAPTAINQWLSGFFSRDVQLRWVGPQLTRRVKRHNAVPLGFADGYPYLLTNEASLRDLQQRCPAGVQMEQFRPNLVVSGVAAWEEDSWKVLRIGDVIFDVVKPCSRCIFTTVSPEKGQKHPSGEPLATLQAFRTALDNGDVDFGQNLIARNSGVIRVGDEVEILATAPAKAYGATTVDNSVTPEKHPDASVTIDWQGQTFCGNNQQVLLEQLENQGIRIPYSCRAGICGCCRIRLLEGEVSPLKKSAMGDDGTILSCSCVPKTALRLEN

SEQ ID NO: 12857 - protein, 133 aa, Brassica napus
  misc_feature (62)..(62): Xaa can be any naturally occurring amino acid
FGRGKTPSQSNRGNSCNFTLVQHGAKQHPPKVIDNFETHPHKLILLKKGTKSDCSAKCGKAXGGLPYKCDECDVSFHVDCVWHPATKINYSPEVNHPYHSLHPLKLLKGPPPDYSDGKCRLCGTEIGEYFYHC

SEQ ID NO: 12858 - protein, 287 aa, Oryza sativa Japonica Group
MAGGPAAVSFLTNIAKAAAGLGAAASLLSASLYTVDGGERAVIFDRFRGVLPETVGEGTHFLVPWLQKPFVFDIRTRPHNFSSNSGTKGPCRWVYPHPSGLLSPPPTSVPFPTIFTSLGLEYDDKVLPSIGNEVLKAVVAQFNADQLLTERPHVSALVRDALIRRAREFNIILDDVAITHLSYGIEFSQAVEKKQVAQQEAERSKFLVAKAEQERRAAIVRAEGESESARLISEATAAAGTGLIELRRIEAAREIAAELARSPNVAYVPAGDNGRMLLGLNAAGFGR

SEQ ID NO: 12859 - protein, 149 aa, Silicibacter pomeroyi DSS-3
MTRYTKSPEAIAALSPEEFHVTQRSGTERPGTGKLLHNKEPGIYVDIVSGEPLFASSDKYESGCGWPSFTKPIETTHVLELEDRTHGMIRTEVRSKHGDSHLGHVFPDGPRDRGGLRYCINSASLRFVHRDDMTAEGYADYLDQVEDIA

SEQ ID NO: 12860 - protein, 125 aa, Cucumis sativus
AVASVNSASPAQASMVAPFTGLKSSAGFPITRKNNVDITTLASNGGKVQCMKVWPPLGLRKFETLSYLPDMSNEQLSKECDYLLRNGWVPCVEFDIGSGFVYRENHRSPGYYDGRYWTMWKLPMF

SEQ ID NO: 12861 - protein, 103 aa, Schizosaccharomyces pombe 972h-
MVKQVSDSSEFKSIVCQDKLVVVDFFATWCGPCKAIAPKFEQFSNTYSDATFIKVDVDQLSEIAAEAGVHAMPSFFLYKNGEKIEEIVGANPAKLEASIKANL

SEQ ID NO: 12862 - protein, 73 aa, Zea mays
  misc_feature (36)..(36): Xaa can be any naturally occurring amino acid
  misc_feature (49)..(49): Xaa can be any naturally occurring amino acid
MSFFHDRNIVSTVNLDCKLDLKAIALQARNAEYNPXRFAAVIMKIREPXTTALIFASGKMVCTGAKSDSIQAC

SEQ ID NO: 12863 - protein, 225 aa, Schizosaccharomyces pombe 972h-
MIPSKNIQKIKLVTFDAFGTILHLSKPVPIVYSEVAQKYGVHATIDEIEHNTFKDFSEKHKNHGKKSGLNPHDWWIKVIEHSFPTPVPAEMAEELWSYFSKKTGYTIHPLLIDFLKRNKEERKYIIGIISNTDERIRTVLEDYGIDHLIDIYAFSYDVGFEKPSREIFDYAMEKAVKLLGQEIQPEECMHLGDDLIKDVSAARNIQWNAEYCDIKTNFLKYFEQK

SEQ ID NO: 12864 - protein, 465 aa, Candidatus Protochlamydia amoebophila UWE25
MEEIKTDIVIIGSGPAGQKAAIQAAKLGKNVIVIEKEPELGGACLYSGTIPSKTFREAVVDLTRFHDRHFAGKDYILPNVTIDELNVRLHTVINEERNIITRQFKKNSIRVIQGSARFENQHTLIVVDNDFRLKYQIKATSFIIATGSNPRNPPDVPFDQQVILDSTTLLGIGRVPKSMIVLGGGIIGSEYASFFAALGTEVTVIDRKDHMLPLLDAEIGIHLQTALTDIGLKFLGKKEPVEISRVEDHAYVKFKDGSSLEADVLLYALGRLANIEALHVENTGIIVDAKGYIPVNALFQTVIPHIYAVGDVIGGPCLASTSMEQGRLAARHACGVQTHHFPTFYPVGIYTIPEISSCGYTEEELKAWGFHYEVGRAHYYEIARSHIAGSNTGLFKILFHAETLEILGVHVIGRNATEVIHIGQMGISFRAHIDYFIDHVFNYPTYAEGYRVAALNGVNKIKFKK

SEQ ID NO: 12865 - protein, 461 aa, Mesorhizobium sp. JS5A15
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDRAQEMGSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 12866 - protein, 461 aa, Mesorhizobium sp. HN14A16
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 12867 - protein, 93 aa, Glycine max
  misc_feature (27)..(27): Xaa can be any naturally occurring amino acid
  misc_feature (30)..(30): Xaa can be any naturally occurring amino acid
  misc_feature (65)..(65): Xaa can be any naturally occurring amino acid
NYKDLTMIELTRTVLLPYHITNQSQFXSFXTNHLTQMTFLYNTYQPYKFLPIYLSTVILHHDPFXVLYQKCIRQLINIITYNFHTSTPNLNVI

SEQ ID NO: 12868 - protein, 285 aa, Oryza sativa Indica Group
MTPQRSPAAAAAGGGGTPALHYLSGPYGDTTYTKVFVGGLAWETRSEGLRAHFEAYGEILEAVVITDRATGRSKGYGFVTFRDPDSARMACMDPYPVIDGRRANCNLAILGRPGPAMPFAPLRPVIPYNGGVAVPGGIPSTYGPEYMYPQNAYGSYVGQQYVPVYGGPRTVGPAVYPYGQFGQPVPGDQPYSPGYVPGHILPLSNQNAANVVRMSTVQQQYPPGKKSIFDEWIENTFARTPYIINISNICHFCGNRSSTPSATALDPCSCTIHTKQHFGTNVGLT

SEQ ID NO: 12869 - protein, 461 aa, Mesorhizobium sp. HB5A4
VMFDGSSIAGWKAINESDMVLMPDPETVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLLYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 12870 - protein, 346 aa, Oryza sativa Indica Group
MRTTARPTAAATALALILVLVFSPSPAAAAARMFKTIDARRSQHLDLGGSLVGPESVAFDGKGRGPYSGVSDGRVMRWNGEAAGWSTYTYSPSYTENKCAASTLPTVQTESKCGRSLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAISADRTHLIVALTGPCKLMRYWIRGPKVGKSEPFVDLPGYPDNVRPDEKGGYWVALHREKYELPFGPDNHLVAMRVSAGGKLVQQMRGPKSLRPTEVMERKDGKIYMGNVELPYVGVVKSI

SEQ ID NO: 12871 - protein, 347 aa, Oryza sativa Indica Group
MRTTARPTAAATALALILVLVFSPSPATAATARMFKTIDARRSQHLDLTGSLVGPESVAFDGKGHGPYSGVSDGRVMRWNGEAAGWSTYTYSPSYTKNKCAASTLPTVQTESKCGRPLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAIGVDRTHLIVALTGPCKLMRYWIQGSKAGKSEPFAELPGYPDNVRPDGKGGYWVALHREKYELPFGPDNHLVAMRVSAGGKLVQQMRGPKSLRPTEVMERKDGKIYMGNVELPYVGVVKST

SEQ ID NO: 12872 - protein, 350 aa, Oryza sativa Indica Group
MRSTARQAATAAAFALIVFLVLLSPSPTAAATATTRMFKTIDARRSQHLDLGGSLVGPESVAFDGKGRGPYSGVSDGRIMRWNGEAAGWSTYTYSPSYTKNKCAASTLPTVQTESKCGRPLGLRFHYKTGNLYIADAYMGLMRVGPKGGEATVLATKADGVPLRFTNGVDIDQVTGDVYFTDSSMNYQRSQHEQVTATKDSTGRLMKYDPRTNQVTVLQSNITYPNGVAISADRTHLIVALTGPCKLMRHWIRGPKTGKSEPFADLPGYPDNVRPDGKGGYWIALHREKYELPFGPDSHLVAMRVSAGGKLVQQMRGPKSLRPTEVMDRKDGKIYMGNVELPYVGVVKSS

SEQ ID NO: 12873 - protein, 155 aa, Triticum aestivum
  misc_feature (15)..(15): Xaa can be any naturally occurring amino acid
  misc_feature (47)..(47): Xaa can be any naturally occurring amino acid
  misc_feature (66)..(66): Xaa can be any naturally occurring amino acid
QRICDGICSNRVASXVSVLEIYGYDRNVDIAFPKVMGSIDNRAVSEXVGSTIVFMYHTEIGVRVKXIPHDEILSPFHAIVIIKIDIQGCGEACCMMEQRQLLLRNLVESPYILSEEDERLLKSSNSTCKEIGDFMKSVVYSKCVDHGTDAHFTKE

SEQ ID NO: 12874 - protein, 376 aa, Methylobacillus flagellatus KT
MPQTPAVLVLADGTVFRGISIGALGETVGEVVFNTSITGYQEILTDPSYTKQIVTLTYPHIGNVGVNAEDVESGRVYASGLVIRDLPLLSSSWRSEKSLSEYLVENNVVAIADIDTRKLTRILREKGAQAGCIIAGEVDEARALELARSFPGLAGMDLAKVVSRKDAGTFALGEWKLGSGYAAQDQARFHVVAFDYGVKHNILRMLVERGCKVTILPAQATAEEALALRPDGVFLSNGPGDPEPCDYAIKAISNVVDSGIPVFGICLGHQLLALASGAKTVKMKFGHHGANHPVQDLDDKRVFITSQNHGFAVDPESLPANLKPTHVSLFDGSLQGIARTDKPAFSFQGHPEASPGPNEMSYLFDRFINLMGQQKQ

SEQ ID NO: 12875 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDADLPVDTWRVMMYSEILDFHQTVGVANETEGSEQPDSQVEQNNLDSANGA

SEQ ID NO: 12876 - protein, 459 aa, Streptococcus pyogenes MGAS8232
MSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 12877 - protein, 557 aa, Kluyveromyces lactis
MASKNTYSDFKLATELPAWNQLQSLYEQKGKKLNVKDEFAKDNSRYEKFAKTFVNYDGSKILFDFSKNLVDDEILKSLIQLAKEAKVTSLRDAMFNGEPINFTEGRAVYHVALRNRSLKPMYVDGTNVTPEVDAVLQHMKEFTEEVRSGAWKGYTGKSITDVVNIGIGGSDLGPVMVTEALKHYATNLKVHFVSNIDGTHIAETLKDLDHETTLFLIASKTFTTAETITNATQLELKNWFLSKNGGDQSHISKHFAALSTNATEVEKFGIDTKNMFGFENWVGGRYSVWSAIGLSVALYIGFDNFEAFLKGAEAVDKHFVETPLEDNIPLLGGLLSVWYNNFFDAQTHLVAPFDQYLHRFPAYLQQLSMESNGKSVTRGNVFANYSTGSILFGEPATNAQHSFFQLIHQGTKLIPSDFILAAQSHNPIENNLHQKMLASNFFAQAEALMVGKDEEQVKSEGATGGLVPHKVFSGNRPTTSILAQKITPATLGALIAYYEHVTFTEGRIWNINSFDQWGVELGKVLAKVIGSELATDNKISSHDSSTNGLINQFKEWI

SEQ ID NO: 12878 - protein, 150 aa, Francisella tularensis subsp. holarctica
SDEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICT

SEQ ID NO: 12879 - protein, 485 aa, Agrobacterium tumefaciens str. C58
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAERAGSGVSH

SEQ ID NO: 12880 - protein, 83 aa, Glycine max
PLLQQQQQQQQEVVPLQDSYMQSRAEALQNVESTIHELSNIFNQLATLVSQQGEIAIRFLYSSLVLCIDTSLLSYIALFECDI

SEQ ID NO: 12881 - protein, 317 aa, Agrobacterium tumefaciens str. C58
MSGQGTAPLVAVIATGGTIASRRGADGASTPSLSGEDLLALVPQVNARLKPVDLMAKDSSSLTLANMQRISDAVGIELSDPAVAGIVVLHGTDAMEESSLLVHLQHALPKPVVFTGAQFTADHRQADGPANLARAIETALDQRNAEKGVLLSFGGRCLPAWGLYKLSADAADAFRSARPQVQAAAPKLAAPVTDIRVDIVAIHPGCDATHIDASLAAGAKGIVLAALGSGNANPLIAEAVKRCAERRVPVVVSSRVPEGLLVASYGGGGGGHDLVAVGAVHSSTLRPGQARILLAALLASNSSAETIVSAFGEPLSH

SEQ ID NO: 12882 - protein, 150 aa, Francisella tularensis subsp. holarctica
SDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICT

SEQ ID NO: 12883 - protein, 276 aa, Oryza sativa Indica Group
MALPTTSPLAAAAARPCAFPTPWRCRSPPLRRLPHVSCQANRGGSRDGNSLSTSAAAAAASPPPRWRAAVSAALAAAIVSAAPAYADLNKFEAEQRGEFGIGSAAQFGSADLKKAVHVNENFRRANFTAADMRESNFSGSTFNGAYLEKAVAYRANFTGADLSDTLMDRMVLNEANLTNAVLVRSVLTRSDLGGAIIEGADFSDAVIDLTQKQALCKYANGTNPLTGVSTRKSLGCGNSRRNAYGSPSSPLLSAPPPKLLDRDGFCDEATGMCDAK

SEQ ID NO: 12884 - protein, 307 aa, Pseudomonas syringae pv. syringae B728a
MSLPRVALIGECMIELQQHADGSLRQSFGGDTLNTAVYLSRLLGERAKVDYVTALGDDSFSDAMCRIWADEGIGLGKVQRLPGRLPGLYCIQTDANGERRFLYWRNEAAVRDCFMTPAAEPILAALASYDVLYFSGITLAVLGEQGRAKLLEALARARQRGVRVAFDNNYRPRLWASVEQAREAYLACLQHVDLALLTEDDEQALYGYADSEQLLAAYRGRGIGEIVVKRGAQSCLVEAGGERFDIAAQKVERVVDTTAAGDSFSAGYLAARLTGQHPLQAAEAGHRLASIVIQHPGALVPKSVMPV

SEQ ID NO: 12885 - protein, 334 aa, Synechococcus sp. WH 7805
MDSLTDADREPPWRFSVAPMLDCTDRHFRQLMRLISRHSLLYSEMVVAQALHHSNRRERLLGFDPEEHPIVLQVGGDEPRLLAEATRMAADWGYDEINLNVGCPSPRVQAGNFGACLMAEPERVAQCVEAMVSASDRPITVKHRVGIDDLDSDDLLTAFVDRVADAGASRFSVHARKAWLEGLDPKQNRTIPPLQHDRVIALKKRRPQLTIELNGGLDTPEQCLDALQHCDGAMVGRAAYAHPLRWASVDELIYGDVCRTVRASDVLIGLIPHAERHLQRGGRLWDIGRHLVQLVEGVPGARHWRRDLGQNAQRAGADLTVLESSARQLIDAGL

SEQ ID NO: 12886 - protein, 526 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADCTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVSCTYVVHPKQTTIRFVTDNPGPWFLHCHIDLHLEFGLAVVMAEAPSLVKATDVTTPAWDELCPIYDSLTPAQLP

SEQ ID NO: 12887 - protein, 150 aa, Francisella tularensis subsp. novicida
SGEDVFKKLNKIIDTTITPVVCIGESLDDRQSGKLKQVLATQLSLILENLSVEQLAKVVIAYEPVWAIGTGVVASLDQIQETHQFIRSLLAKVDERLAKNIKIVYGGSLKAENAKDILSLPDVDGGLIGGASLKAAEFNEIINQANKICT

SEQ ID NO: 12888 - protein, 317 aa, Arabidopsis thaliana
MENGDIPEDANEHCPGPQSESAGKSDSCAGCPNQEACATAPKGPDPDLVAIAERMSTVKHKILVLSGKGGVGKSTFSAQLSFALAGMDHQVGLMDIDICGPSIPKMLGLEGQEIHQSNLGWSPVYVEDNLGVMSIGFMLPNSDEAVIWRGPRKNGLIKQFLKDVYWGEIDYLVVDAPPGTSDEHISIVQYLLPTGIDGAIIVTTPQEVSLIDVRKEVSFCKKVGVPVLGVVENMSGLSQPLLDIVACSEVFDSSGGGAERMCREMGVPFLGKVPMDPQLCKAAEQGKSCFEDNKCLISAPALKSIIQKVVPSTVMTE

SEQ ID NO: 12889 - protein, 526 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADCTELIAAAVAPPADATLINGKGRYLGGPAVPLAVINVQQGKRYRFRMISIACDAYHNFSIDGHRLTVIEVDGENHEPATVDNIQIFPGQRYSFVLTATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYKNPVSCTYVVHPKQTTIRFVTDNPGPWFLHCHIDLHLEFGLAVVMAEAPSLVKATDVTTPAWDELCPIYDSLTPAQLP

SEQ ID NO: 12890 - protein, 699 aa, Crocosphaera watsonii WH 8501
MENFLSILRGNPLVSFTILLLVILTLPPIFERLRLPGLVGLLFAGVILGKDGLYLLDADSESIELFADIGKIYLMFVAGLEIDLAEFRKTKGRSLVFGSLTFFLPLLMGTFVGLNFGFGWNSSILIGSLLASHTLLGFPIVQRLGMVKNQAVMVTIGATIFTDIAALLVLAICVSIHSGDFSAASLVMQLVSLGFYAIIILFGFYWLGKEYFRRTGDEESNQFLFVLLAVFLASIGAQLINVDKIIGAFLAGLAVNDVVGDGPVKEKVEFVGGTLFIPFFFVGMGLLLDIPAFLKTIQFQLFLVISIVGGLIAAKFLAATVAKFIYRYTWAESFTMWSLSLPQVAATLAAALVAYQVKDADGQTLINEAVFNSVIVLMLITSILGPVLTAQFATKLPLPKTREDEENRNIESTLDEWLPQLKNEIKNDHFTVLIPIYNPYTQRDLIEMGALLAKKESGIIVPVSIAAAHVHMDDPQVDGNLKQSQILLDRAIEISQEFEVSAQPIIRIDDDAAQGISRSAKEKNANLIIMGWSENTGLKARLFGTILDTVFWSSHCPVAVMRLLDHPVNLRRILVPIKNLSQATLETIKFAQLFADSNQGIITLLHICDRQTPQEQITEFKTTLSKLITEYELSKECKIKMIIHDSPSQVIIRASHQFDLVVLRSFRRRTAGGLAVSDITTEVLKKLSCSLVLFGQPHS

SEQ ID NO: 12891 - protein, 356 aa, Neisseria meningitidis MC58
MTKHIAILRGDGIGPEIVAETVRVLDKLIAQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENAVQKVLQQGLRTSDIYEEGTKLVSCSEMGDAVLAAL

SEQ ID NO: 12892 - protein, 350 aa, Oryza sativa Indica Group
MRSTARQAVTAAAFALIVFLVLLSPSPTGAATATTRMFKTIDARRSQHLDLGGSLVGPESVAFDGKGRGPYSGVSDGRIMRWNGEAAGWSTYTYSPSYTKNKCAASTLPTVQTESKCGRPLGLRFHYKTGNLYIADAYMGLMRVGPKGGEATVLAMKADGVPLRFTNGVDIDQVTGDVYFTDSSMNYQRSQHEQVTATKDSTGRLMKYDPRTNQVTVLQSNITYPNGVAMSADRTHLIVALTGPCKLMRHWIRGPKTGKSEPFVDLPGYPDNVRPDGKGGYWIALHREKYELPFGPDSHLVAMRVSAGGKLVQQMRGPKSLRPTEVMERKDGKIYMGNVELPYVGVVKSS

SEQ ID NO: 12893 - protein, 306 aa, Kineococcus radiotolerans SRS30216
MTVRHFLADDDLSPAEQAEVLALAARLKTDRFAEKPLTGPQTVALIFDKPSTRTRVSFSVGVADLGGVPLVIDAAGSQLGRGEPVADTARVLERQVAAIVWRTFSQAGLEEMAANSRVPVVNSLTDTFHPCQVLADLQTVAERRGALAGLTLAYVGDGANNMAHSYALGGATAGMHVRIGTPATDLPDPAVLARARAVAERTGGSVTVTSSAPEAVVGADVVATDTWVSMGQEGEEFERFRPFSLTTDLLAGAGDDAVVLHCLPAYRGKEIDAAVIDGPQSAVWDEAENRLHAQKALLVWLLATSR

SEQ ID NO: 12894 - protein, 411 aa, Vibrio parahaemolyticus RIMD 2210633
MNFNLNQIREQFPALAQYHNDKPVTFFDGPGGSQVPQSVLDSMVGYLGRFNSNLGGHYFSSQATVDVMQSARESAQALLNAPSSGNIVFGANMTSLTFQLSRAISRDWQEGDEIIVSALDHYSNVSSWQQAAEDKGAKVHQVRINKADCTLDLEHLQSLLSEKTRLVAVTYASNTTGSIVDIQRVVEMAHGVGAQVYVDAVHYAPHHLVDVQALGCDFLACSAYKFFGPHVGIAYVADQWLHSLRPYKVEPATNIGPGRFETGTQSFEGLAGVAAAVGYLAQFGDNDLPLRQRLEQSYALYNQHEQRLSERFLQRLDALEGVKLYGIESEDCQQRTPTFALTFDKYSPEFIAKTLGEHNICVWNGHFYALGLVRQLGIEESGGVVRIGCMHYNTIEEVDMLFDVLESILDA

SEQ ID NO: 12895 - protein, 300 aa, Kineococcus radiotolerans SRS30216
MSDLTELTAEDKANVLVEALPWLQKWHGALVVLKYGGNAMVDEDLKRAFAEDVVFLRTAGLRPVVVHGGGPQISTMLDRLQIPSEFRGGLRVTTPEAMDVVRMVLTGQVGRELVGLLNAHGPLAVGLSGEDAGLLRATRRHAVVDGEPVDVGLVGDVVGVDPRAVVDLLAAGRIPVISTIAPEVDADGNPLHGQVLNVNADTAASAIAVALEAQKFVVMTDVAGLYRDWPNRDSLVREITAGDLAALLPSLESGMVPKMEACLRAVRGGVPRATVIDGRQAHSVLLEVFTTSGNGTMVVP

SEQ ID NO: 12896 - protein, 205 aa, Haemophilus influenzae 86-028NP
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPVLLLLTKADKLSQSARSKQVKMVREAILPFQGDIQVEAFSAQNKIGIDKLAAKLDFWFSPLFAK

SEQ ID NO: 12897 - protein, 203 aa, Magnetospirillum magnetotacticum MS-1
MTFVIGALLLLRDGKPARLVERKPEEERLFQQLGLMTAKPVLYVCNVDEGDADKGNAHSQAVFGRAKAEGAVAVVVSAKIESEIAVMPVADQTEFLEAVGLTEPGLNRVIRAGYDLLGLVTYFTVGPKEARAWTITKGTRAPAAAGVIHTDFEKGFIRAETIAFKDYTSLNGEAGARDAGKLRLEGKDYVVQDGDVLHFRFAN

SEQ ID NO: 12898 - protein, 332 aa, Rhodobacter sphaeroides 2.4.1
MSRQEAPRPKVAVIAGGGTLTALASDPFEICDYGQAGSLTAADLIDRCAAMADRVALVPLAFEPRPSFDMGPDQWGAICGLCAAALAEDPGLAGFVLTHGTGSLEEAAFFLSLVWDLPVPLVVTGAQRPASALSSDGYMNLFQAALVAAHPQARAEGVLVVAHGEIHLPFEVTKTATFGLDTFRSPDLGPVGLVIGGQVRFLRPAAPRAPRADWRVLGALPRVDILYCHSGGDACAIEAFIAAGARGLVVAGFAPGYATGAQARRLETWVREEGGVVVMASRGHGPVVANSRNDGHGFLPAGRAAPVKARLLLQLALAAGRAPAQIARDFEF

SEQ ID NO: 12899 - protein, 117 aa, Zea mays
DRHNDPMDVLVLMQEPVVPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 12900 - protein, 581 aa, Novosphingobium aromaticivorans DSM 12444
MAEHSSLLRDGFLLLGFALIFVLVFRRLGLGATLGYLLAGAVVGPQVLGLVGDAESKLGIAELGITLLLFLVGLELNPSRLWRMKRDILGLGLLQVTACGLAVAAMIGLTTEFSWEAALALGLPLALSSTAQVLPMLQSSGRLRTPFGERAFAILLFQDLSIIPLITIISAMSRNPADAGGPPGWLLTLYTLAAVVALIAAGRFVIRPLFRLIGNLGEREMFVVAALFTVMASAAVMEALGLSTALGAFVAGVMLADSPYRHELEADVEPFRSILLGLFFLAVGMMLNLHAIAERPLFVLAMAVGLIAIKAGAIFLIGLAFRMTWRGALALGLLLSQGGEFGFVLFAQAQNALLIAPDAASLFGAIVTLSMATTPFLMMATRGIREEAESPKGERAGPQPDGANAIIVGFGRFGQGVSQILLASNIPVTMVDTDIEMIDVAAEFGAKVYFGDGTRIDLLRQAGADEAEMIFFCMDGDQMSPDLVEAVHEAFPRAAIYVRAYDRRALIRLKETPASAVVREVLESAVKMARIALHDAGLSEEAINRAEDMFRARDKERLRLQVEAGDVRVARDRIITEPSGS

SEQ ID NO: 12901 - protein, 438 aa, Methanococcus maripaludis S2
MNGELSFKYDNVMEENLGNLGISNGKLESFNNESSKIIEILKEKELNGEFGFLDVLNDNLDKYYELNEYSKNFENILIIGIGGSNLGLRAAETGILGSFTSRYEIPRIYYMDNSDPEKTHDILSNIDLEKTLVFVISKSGNTVETLANFFIVRNLMKKKNIDLEKHVVSITSGGELEKITKKENYIHFEVPENVGGRFSVLSSVGIAPLSCTSVDIKKLIDGAKSIEKSCKCEDIFKNPALMNAVIHKLMYNRGKTVSVMMPYIERLRSFGMWYGQLWAESLGKNGFGQTPVIAVGATSQHSQLQLYMDGPNDKIATFLKVNKYRNDLKIEYEYDHHLSGHNLSEVITSELVGTENSMKHNNIPNVKITLSKLNEITMGKLFLMYEMQTAISGELYGINAFDQPAVEYGKKIAHECLTGSKVDSENKYINGKYIITSK

SEQ ID NO: 12902 - protein, 462 aa, Frankia sp. CcI3
MTDMQAFDHVIDLVGNTPLVRITPTIETTPTPVLAKLEYLNPGGSVKDRVALTMVSAAEEAGLLPPGGTIIEPTSGNTGVGLALVAARRGYRCVFTMPDKISEEKRAVLRAYGAEVVICPTAVAPDDPRSYYSVARRLVRETPGGWSPDQYSNPNNPAAHYATTGPEIWQATNGRVTHFVAGIGTGGTISGVGRYLKEASGGTVQIVGADPEGSVYSGGSGRPYLVEGVGEDIWPTTYDKTVVDRVEAVSDRDSFLMTRELARKCGLLVGGSGGLAVVVALRVARELGPDDAVVVLLPDSGRGYLSKIFNDEWMYEYGFLEPPSNEPTVSDVLRNKAEQTSGPPDLVHVHPAETVGAAISYLREYNVSQMPVVRHEPPLRAAEVAGSVIERHLLAAVFADRSAIDAPVADHLSPSLPMVGTGEPLARIVAVLGDEPAVLVHDEGNPVGILTRADLLSFLAVR

SEQ ID NO: 12903 - protein, 188 aa, Glycine max
  misc_feature (140)..(140): Xaa can be any naturally occurring amino acid
MRSLAAPHSFRVFVNSPIFRPIKLPFLTLNPLSSPSRRSPASVQCAVQFRPCIDIHKGKVKQIVGSTLQDLKGGDGSDPVTNFESDKSAAEYAALYKQDGLTGGHVIMLGADPLSKASALEALHAYPDFSSAELTVEDWXNLGGLQVGGGINSDNCLSYIEEGASHVIVTSYVFNNGQMDLGRLKDLV

SEQ ID NO: 12904 - protein, 100 aa, Zea mays
AAGEIAAAVGAEKLLLLTDVSGILADRNDPGSLVKVVDIAGVRKMVADGKVAGGMIPKVECCVHALAQGVHTASIIDGRVPPSLLLEIFTEGGTGPMITG

SEQ ID NO: 12905 - protein, 361 aa, Chlamydomonas reinhardtii
MGAYLSSPITDKEVFEGDGHGLRFGGGAMQGWRRTMEDAHVAEVNVANDPNVAMFGVFDGHGGAEVAKFCQKYMAAELQRFEEFGKGSVEDSLVKVFHRMDEMLRDQRYAEELEKLKSKESNEDEGEGEGGGVSTTDALDLLRRVFQLKRFVGGNSNSMGEGGSSEEPAESPEEELVQAGCTAVVAVKFGNELFVANAGDSRGVLCRAGKAVALSEDHKPAQEGERSRIIAAGGFLSEIGGVCRVNGNLNLSRAIGDLKYKTNNELPPSDQIITAQPDIRKIALSPEDRFFLLACDGVWDVMSNQDAVDFVSARLDQGMTPSQASCALLDACLASDPKEARGVGCDNMTVVVVQLNSPSSS

SEQ ID NO: 12906 - protein, 123 aa, Escherichia coli
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTSSKTPSVVTVNCLPKVLTLS

SEQ ID NO: 12907 - protein, 70 aa, Glycine max
MSNSSAGTSSKPRAASSQPSETSSKRKRGVFQKELQHMMYGFGDDPNPLPESVALMEDIVVEYVTELVHK

SEQ ID NO: 12908 - protein, 484 aa, Agrobacterium tumefaciens str. C58
MGKVTGFLEIDRQVGKYQPASDRIRHFREFTIPMSDAEVQKQAARCMDCGIPYCHGPTGCPVHNQIPDWNDLVYNNNWEEAIRNLHSTNNFPEFTGRVCPAPCEEACTLNLEDAPVAIKTVEQAIADKAYELGFIVPKPATIHTGKKVAIIGSGPSGMAAAQQLGRAGHEVHVYERESKAGGLLRYGIPDFKMEKNFIDRRVEQIKGEGVTFHCGVNVGVDVTVEALLADHDAVLYCGGSETPRPAGIGGADFNGVYDAMPYLVQQNRRVGRENIDSVGWPADPILAGGKHVVVVGGGDTASDCVGTAFRQGAVKVTQLDIRPMPPEKEDKLAVWPFWATKMRTSSSQAEGAIREFQVATLEFVGEDGVLTGVKCCQVDDRRKPIAGTEFIIKADLAFIAIGFSGPFTDSVLKEMEGKLTLNTDRRGSTNVVANETDYRTSVDKLWTAGDVRRGQSLVVWAIREGRQAARAIDEALMGATVLPR

SEQ ID NO: 12909 - protein, 272 aa, Aspergillus oryzae
MGTLLILGKVAIVTGIFLSYNSWRGMHIANDEPGGGSGFGAAIARRFGEEGAKVIITDINVEGGQKVAAQNPESLVFQQMDVTKADDWTAVMDLAFSKFGRLDILVNNAGITYRNKPTAEVTEEEWERVFNVNVKGIFLGSQALVTRLMEQGQGGSMINISSTGASRPRPGLVWYNASKGAVSNATKGLAAEYGPHNIRVNTVSPLLSGTGLFSMFTGMPDTPENREKFIGNVPLGRLTDPDDVANMCLYLASDEGSFINGAEMIVDGGKCI

SEQ ID NO: 12910 - protein, 310 aa, Triticum aestivum
  misc_feature (156)..(156): Xaa can be any naturally occurring amino acid
  misc_feature (169)..(169): Xaa can be any naturally occurring amino acid
  misc_feature (181)..(181): Xaa can be any naturally occurring amino acid
  misc_feature (220)..(220): Xaa can be any naturally occurring amino acid
  misc_feature (241)..(241): Xaa can be any naturally occurring amino acid
  misc_feature (263)..(263): Xaa can be any naturally occurring amino acid
  misc_feature (269)..(269): Xaa can be any naturally occurring amino acid
MAAPSSLASSHLSRLAAAAPAPQHHHQNHQLRLGCSRRRAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDEFIXGKKAAYCLESKSXVMACIGELLEEXREAGKTFRCLFLAEMEAFADNITDWKNVVIAYEPVWAIXGTGKGCFSKSKLQEVHAAVPXLGLKTNVIQLDVASTVRIIYGXGSVNAXANCAELAKKEDIDGFLVGGASLKGPDFATICNSVTSKKVTA

SEQ ID NO: 12911 - protein, 283 aa, Silicibacter pomeroyi DSS-3
MTGTLLSFGHGYTARVLSRALAPQGWRIIGTSRNPDQMEAIRASGAEPLLWPGEEPSLDGVTHLLISTAPDSGGDPVLAALGDQIAARAAQFRWVGYLSTTAVYGDHDGAWVDETTPLTPTAARGRWRVMAEQQWQAVPNLPLHVFRLAGIYGPGRGPFSKLGKGGIRRIIKPGQVFSRIHVEDIAQVLAASMARPDPGAVYNVCDDEPVPPQDVIAYAAELQGLPLPPAVDFDKADLTPMARSFYSENKRVRNDRIKEELGVRLKYPNYRVGLEALQADAET

SEQ ID NO: 12912 - protein, 317 aa, Pyrococcus horikoshii OT3
MVVSLKGRDLLCLQDYTPEEIWTILETAKMFKIWQKIGKPHRLLEGKTLAMIFQKPSTRTRVSFEVAMAHLGGHALYLNAQDLQLRRGETIADTARVLSRYVDAIMARVYAHKDVEDLAKYASVPVINGLSDFSHPCQALADYMTIWEKKGTIKGVKVVYVGDGNNVCHSLMIAGTKLGADVVVATPEGYEPDKKVIKWAEQNAAESGGSFELLHDPVKAVKDADVIYTDVWASMGQEAEAEERRKIFRPFQVNKDLVKHAKSDYMFMHCLPAHRGEEVTDDVIDSPNSVVWDEAENRLHAQKAVLALLLGGVKTGF

SEQ ID NO: 12913 - protein, 631 aa, Yarrowia lipolytica CLIB122
MKWLTSLRNSVVGGPHLYNNDKDSCSECDSDTESVSWTRKMFDPPVKQQREDYTDSEDEAGAPSGSREMEQLTTIWTKTDLYMAWASMLLLSVAIGMMIQTVSVYSTYATSDFNQMSLLSALNVVKSVMYIATRPILAKFADVLGRFETVLICIVIFTVGFIMLSASPNIGTYFAAHIFYIFGQVGIQFMEQVFAADTSDLKNRMFFVVLPNLCYLFTPWCAAPITNAILKHSTWHWGYGMWCITVPVVSIPALTIMFRHRMKARKMGLECARSGLSNVKTAMRQFDIIGLILFTGGISLLFLAVTLVKTSKSWSQPHVLSMIIIGPILLILFPIWEKLYPKYPFLPFSALKDRTLITGCIIVALYSLAYYIYAPYYTAWLLVCKNLSVTAATNTRVTWTVASTFGSLLVAPLIRYTYRLKPTIILGGCLYMLGLGLTYRYRQPDNSLAQFIIAQVIEGLGTGMIQYPVLVLIQAVVSHKQVVAATAIFYSSISVGGVIGDAISGSMYRQQYPKRLADYAPFLSEKDIDTMVNNVNAPLKYAWGSEERTAIIAAFNNVYRHLLYGPVIVGGALILFAVTLPNVDLSQMEERVKGVVFGNTNKKETERNDDENQDLGSEKSCQKDNVVETKV

SEQ ID NO: 12914 - protein, 527 aa, Chlamydomonas reinhardtii
MATVEKKYPYALDSEGKAKYVPVWRFTQPHMMAFHLSWICFFMSFVATFAPASLAPVIRDDLFLTKSEVGNAGVSAVCGAIAARLFMGIFVDVVGPRYGAAAAMLMTAPAVFCMALVTDFSTFACVRFFIGLSLCMFVCCQFWCGTMFNVQIVGTANAIAAGWGNMGGGACHFIMPLIYQGIKDGGVPGYQAWRWAFFVPGGIYIVTATLTLLLGIDHPSGKDYRDLKKEGTLKAKGNMWPVIKCGLGNYRSWILALTYGYSFGVELTVDNVIVEYLFDQFGLNLAVAGALGAIFGLMNIFSRATGGMISDLIAKPFGMRGRLWVLWITQTLGGIFCIIMGKVSNSLTATIVIMIIFSIFCQQACGMHFGITPFVSRRAYGVVSGLVGAGGNVGAAITQAIWFSGTATWQINLSRPDSFVWMGVQAVALTVAVMFIWFPMWGSMFTGPREGVEEEDYYLREWSAEEVAQGLHQGSMRFAMESKSQRGYKDKRMLDAVGNRGSPPLTFAPVAPRFHYWTGRQQGRQGT

SEQ ID NO: 12915 - protein, 229 aa, Bacillus pumilus SAFR-032
MNVRENLRQINEQINEACKRAGRNPDDVSVVAVTKYVSIERAQEAKEAGILHFGENRDQGLLEKQASITDESINWHFIGSLQTRKVKSVIQTIDYLHSLDRISLANEIEKRVDHTVRCFVQVNTSLEESKHGLQSEDVIPFVKQLADFKKIEIAGLMTMAPFTDDHTVIRNCFKTLKNLQKEVKHLNQVNAPCQHLSMGMSNDFEIAIEEGATFVRIGSSLVGNETGGA

SEQ ID NO: 12916 - protein, 516 aa, Lotus japonicus
MDGPVGRGGGAGLDIYLPNYKLGKTLGIGSFGKVKIAEHVLTGHKVAIKILNRRKIKNMEMEEKVRREIKILRLFMHPHIIRLYEVIETPTDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRMTIPEIRQHPWFQARLPRYLAVPPPDTMQQAKKIDEEVVQEVVNMGFDRNQLIESLRNRIQNEGTVAYYLLLDNRFRVSSGYLGAEFQETMDSGFNQMHPGEVASSVVGHRIPGYIDYPGVGMRPQFPVERKWALGLQSRAHPREIMTEVLKALQELNVCWKKIGHYNMKCRWVAGIPGHHEGMVNNNTAHSNHYFGDDSSIIENDAVPSSNVVKFEVQLYKTREEKYLLDLQRVQGAQFLFLDLCAAFLAQLRVL

SEQ ID NO: 12917 - protein, 269 aa, Silicibacter pomeroyi DSS-3
MKEHRGRLTRDGIRIYEPTDFAGMHAAGAVAARILDDIAEHVFPGQSTGEIDRIITGMVEAAGAKSATIGYKGYEHASCISVNHVVCHGIPGDKRLGEGDILNIDVTVIVDGWFGDTSRMYVAGKLPRKAERLIQVTHDALFKGIEMVKPGNTFGDIGHAIQTYVEAHRMSVVRDFCGHGLGQVFHAPPNVLHYGRPGTGAVLEEGMFFTIEPMVNLGRPETKTLADDWTAVTRDKSLSAQFEHSVGVTANGVEIFTLSPGGKFHPTYA

SEQ ID NO: 12918 - protein, 441 aa, Lotus japonicus
MNQPKIKRRVGKYEVGRTIGEGTFAKVKFARNSETGEAVALKILDKEKVLKHKMAEQIKREVATMKLIKHPNVVQLYEVLGSKTKIYMVLEFVTGGELFDKIVNHGRMCEDEARRYFQQLINTVDYCHSRGVYHRDLKPENLLLDACGNLKVSDFGLSALSQQIKDDGLLHTTCGTPNYVAPEVLNDKGYDGATADLWSCGVILFVLVAGYLPFDDPNLMELYKKISAAEFTCPPWLSFSARKLITRILDPNPMTRITIAEILEDEWFKKDYKPPIFQENGETNLDDVEAVFKDSEEHHVTEKKEEQPTAMNAFELISMSKGLNLENLFDVEQGFKRETRFTSKSPANEIISKIEEAAKPLGFDVQKKNYKMRLANVKAGRKGNLNVATEVFQVAPSLHMVEVRKAKGDTLEFHKFYKKLSTCLEDVVWKTEDDMQKQEAK

SEQ ID NO: 12919 - protein, 562 aa, Vibrio parahaemolyticus RIMD 2210633
MNNDKRPLYIPYAGPALMATPLLNKGSAFSAEERSSFNLEGLLPETTETIQEQVERAYQQYKSFESDMDKHIYLRNIQDTNETLFYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGPDYDAFVEEFIQAVQRRWPDALIQFEDFAQKNAMPLLERYKDRICCFNDDIQGTAAVTVGSLLAACKAAGTQLSKQRITFLGAGSAGCGIAEAIIAQMVSEGISDEKARSQVYMVDRWGLLQEGMPNLLDFQQRLVQKHSNTKEWENEGNGFSLLDVMRNAKPTVLIGVSGAPGLFSQEVIEEMHKHCKRPIVFPLSNPTSRVEATPNDIIRWTNGEALVATGSPFDPVVHEGRTYPIAQCNNSYIFPGIGLGVLAVNAKRVTDEMLMESSRALATCSPLAINGRGALLPPLEEIHLVSKKIAFAVAKKAIEQGVALEITDEALNDAIDQAFWQPVYRRYKRTAF

SEQ ID NO: 12920 - protein, 593 aa, Schizosaccharomyces pombe 972h-
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEVFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKASISTTSLVKSNVSTNSRKSSNFEDELARRVSSPLSALNQMSQSPIPIRVSSDKDYDSYACHEVVSNPSTLDDDYNYMFVCPPEEYTYSTDNVRTDSLDLQSLPTPTLEQLESVPFNRYGYVRIFPSTTLSSTASGYYTPDSLSTPEPSIDGLTNLDDVQVGGFVQGSGNQNRRPISFPVISNMQPNITNVRSASAPLCSSPVPSRRYSQYATNARYTPRKVSSGSVLRKISSFFRKD

SEQ ID NO: 12921 - protein, 449 aa, Schizosaccharomyces pombe 972h-
MDNIGAADAATSSGISGLLSGNSFLGAGIGLMGFGAGLAILRRGLISGASLVKRRMLVSVEIPSKEKSYNAFLHWMSTVPKRYSNQLAVESNRQLKMPQNAREKPDKQVANRIFSLVPGPGKHYIKYKKCWIQVERERSNRLQDLTTGTPWETITLTTLSRDRGIFSELLLEAQKFMQSAQKNKTTIYTAWATEWKPFGHPRSKRMLSSVVLESNVKKMITDDVHDFLRNSQWYDTRGIPYRRGYLLYGPPGSGKTSFLYALAGELDYDICVLNLAEKGLTDDRLNHLLSNVPPKAVVLLEDVDSAFQGRERSGEVGFHANVTFSGLLNALDGVTSSDERIIFMTTNHPEKLDPALVRPGRVDVKAYLGNATPEQVREMFTRFYGHSPEMADDLSDIVCPKNTSMASLQGLFVMNKSSPADAVDMAKELPDNPPSTPFSFNVHRKSLSV

SEQ ID NO: 12922 - protein, 211 aa, Gossypium raimondii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 12923 - protein, 237 aa, Schizosaccharomyces pombe 972h-
MSTIHSCLDLIRSQIQQSANGRNVLLVAVSKFHPVETLMEAYNAGQRHFGENYMQEFLKKVELMPDDVQWHFIGSLQSSKCKKIASVKNLYSIETIDTEKKARLVNSAREALQLPLNVYIQVNTSGEENKGGVTPSKVLELCKQVQDMKYLRLKGLMTIGSISNSQLSDHNPDFQVLSDLRESLQNELGIPLQLSMGMSSDYLLAIKYGSDSVRVGSSIFGSRPTEKPSDVHISASK

SEQ ID NO: 12924 - protein, 482 aa, Salmonella enterica subsp. enterica serovar Urbana
MSDVSLIAVVMAGGTGSRLWPLSRELYPKQFLQLSGEHSLLQTTLLRLSALACKDPLVITNEQHRFIVAEQLRQIDQLHDNIILEPCGRNTAPAIALAAFSALKRNEQEDPLLLVLAADHVIAKENVFCNAIKKAVPIAENGNIVTFGIIPEYAETGYGYIERGAPFSVNGNSTGIDFYHVKNFVEKPERLTAEKYISAGNYFWNSGMFMFKASVYLNELKKFRPDIYSICEQVVSSSYRDLDFIRIPEALFKDCPAESVDFAVMEKTEHCIVCPINIGWSDVGSWQSLWDISEKTNEGDVCKGDILTYNTKNNYIYSESALVAAVGVEDIVIVQTKDAILVSKKSDVQDVKKIVEMLKTQDRTEYISHREVFRPWGKFDSIDQGERYRVKKIVVKPGEGLSLRMHHHRSEHWIVLSGTAKVTLDDKTMLVTANESIYIPLGATYSLENPGVIPLNLIEVSSGDYLGEDDIVRQKERYRKDD

SEQ ID NO: 12925 - protein, 482 aa, Salmonella enterica subsp. salamae serovar Greenside
MSDVPLIAVVMAGGTGSRLWPLSRELYPKQFLQFSGENSLLQTTLLRLSALACKDPLVITNEQHRFIVAEQLRQIDQLHDNIILEPCGRNTAPAIALAAFSALKRNEQEDPLLLVLAADHVIAKENVFCNAIKKAVPIAENGNIVTFGIIPEYAETGYGYIERGALFSVNGNSTETSFYHVRNFVEKPDRLTAEKYISTGNYFWNSGMFMFKASVYLNELKKFRPDIYSVCEQVVSASYRDLDFIRIPEALFKDCPAESIDFAVMEKTEHCILCPIDIGWSDVGSWQSLWDISEKTDEGDVCKGDILTYNTKNNYIYSESALVAAVGVEDIVIVQTKDAILVSKKSDVQDVKKIVEMLKARDRTEYISHHEVFRPWGKFDSIDQGERYKVKKIIVKPGEGLSLRMHHHRSEHWIVLSGTAKVTLDDKTMLITANESIYIPLGATYSLENPGVIPLNLIEVSSGDYLGEDDIVRQKERYRKDN

SEQ ID NO: 12926 - protein, 304 aa, Agrobacterium tumefaciens str. C58
MDAQMTNFETRLRENAAKTEALLGHLLSGEARADEITRPQNLLEAMRHGVLNGGKRLRPFLVIESVALLGGDAEAGLHVGAALECLHCYSLVHDDLPAMDDDDLRRGQPTVHRKFDEATAILAGDSLLTLAFDIIASDDNPLAAERKAALVISLARAAGIGGMAGGQALDLAAEKKAPDEDGIITLQAMKTGALLRFACEAGAIIAGSNQAERQRLRLFGEKIGLSFQLADDLLDLTADAATMGKATGKDAARGKGTLVALRGEAWAREKLQEQVAEASELLAPYGEKAAILIAAARFIAERKS

SEQ ID NO: 12927 - protein, 290 aa, Rhodobacter sphaeroides 2.4.1
MSKKHPIISVTGSSGAGTSTVKHTFDQIFRREGVKAVSIEGDAFHRFNRADMKAELDRRYAAGDATFSHFSYEANELKELERVFREYGETGQGRTRTYVHDDAEAARTGVAPGNFTDWRDFDSDSHLLFYEGLHGAVVNSEVNIAGLADLKIGVVPVINLEWIQKIHRDRATRGYTTEAVTDVILRRMHAYVHCIVPQFSQTDINFQRVPVVDTSNPFIARWIPTADESVVVIRFRNPRGIDFPYLTSMIHGSWMSRANSIVVPGNKLDLAMQLILTPLIDRLVRESKVA

SEQ ID NO: 12928 - protein, 333 aa, Rhodobacter sphaeroides 2.4.1
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 12929 - protein, 321 aa, Crocosphaera watsonii WH 8501
MVENRQSTVVITGASSGVGLYAAKALADRGWYVVMACRNQPKAHQAAQSLGIALDAYTVMHIDLGNLDSVRQFAQDFRATGKTLDALVCNAAIYMPLLKEPLRSPEGYELSMTTNHLGHFLLCNLMLEDLSHSSAPEKRMVILGTVTHNPDELGGKIPPRPDLGNLEGFADGFKEPISMVDGKNFEPVKAYKDSKVCNVLTMRELDRRYHESTGIVFTSLYPGCVADTPLFRNHYPLFQKIFPWFQKNVTGGYVSQELAGERVADVVTKPEYGESGSYWSWGNRQKKDRQAAFVQNVSPQAQDEAKAEKMWNLSEKLVGLA

SEQ ID NO: 12930 - protein, 567 aa, Rubrobacter xylanophilus DSM 9941
MKHATLYRRWRPRTFGEIAGQEPVVRTLRRAIETGRVAHAYLFSGPRGTGKTSTAKVLAMGLNCAQGPTPEPCGRCESCRSIVAGSSMDVIEMDAASNRGIDEIRELRDRVNLAPAAGRAKVYIIDEVHMLTTEAFNALLKMLEEPPEHVVFVLATTEKHKVLPTIISRCQSFDFRRPGVGTLVEKLSEIARAEGIEAEREALTAIARASGGSFRDAEGMLDQISSFSEGRVTVALVRELLGSAGPEMLAETADALHERRAADALRVVDRLSSEGRDLGQFAAELISHLRVLMLLPHAPEAALAEAGPEERPALEEQARRIPTGETVRMIEALGETSGRIRRGGDPKLELELCFLKLARDYTEPSLEGLVRRVEALEKRLEEGSAPPRENPAKESPEQPPDGRAGEAPPRQEEPPRTGAELDWDSVLQELRARRQVPVAALYESARVEGCEDGLVKISFPEELAPLMKSAGEPKRVEPLRDVLEERLGFRPRVELKLSGEAPPRPPAAYPPSPEPARREGEDAPRAQERPHPPREGPEGEEDVIRSQDEVFELARRHLGGRPDARGG

SEQ ID NO: 12931 - protein, 194 aa, Avena sativa
TRASTPNGNKKLDAGYREAQEKPSECPVFLFFSVNTSGQFVGIAEMIGPVDFDKTVDYWQQDKWNGCFSIKWHIVKDIPNNILKHITLENNDNKPVTNSRDTQEVKLEQGLQMLKIFKEHVSKTSILDDFAFYENRQKLMQEKRAKQQVLQGQGGDEKEKNAANGNSAAQQQAVSKESAAPVPGGRAERLKIRC

SEQ ID NO: 12932 - protein, 347 aa, Schizosaccharomyces pombe 972h-
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 12933 - protein, 289 aa, Phaseolus vulgaris
MEGKEQDVSLGANKFSERQPIGTAAQIQDDGKDYKEPPSAPLFGPSELTSRSFYRAGIAEFVATFLFLYITILTVMGVNRSDSKCATVGIQGIAWSFGGMIFALVYCTAGISGGHVNPAVTFGLFLARKLSLTRAVFYIVMQVLGAIVGAGVVKGFEGKTFFGKHNGGANFVAPGYTKGDGLGAEIVGTFVLVYTVFSATDAKRSARDSHVPILAPLPIGFAVFLVHLATIPITGTGINPARSLGAAIIFNKDLGWDDHWIFWVGPFVGAALAALYHQVVIRAIPFKSS

SEQ ID NO: 12934 - protein, 475 aa, Rhodobacter sphaeroides 2.4.1
MITQVLLCGGSGTRLWPLSRKGYPKQFASILGEHSLFAASARRLSGPGFGRPVIVTGSDFRFVVTEQLAEAGIDPGTILIEPEPRNTAPAILAAALHVAAGDPEALMVVAPSDHAIADPAAFRAAVMQGVPAARAGRIVTFGIVPTRAETGYGWLELDGAEDGAAVPLRRFVEKPDLDRAEEMLASGGFLWNSGIFLFSARTILATFEEHAPALLAPVRRAVEGAVPDLGFLRLDPQPWAEAEPISIDYAVMERTRNLSVVPFRGSWNDLGGWDAVALEMGTDGQGVSLSGGATAIDCRNALLRADSEGVELVGIGLDNIIAVAMKDAVLVAERSRAQEVKQAVEALKAKGARQAESFLRDRRPWGFFETLALGERFQVKRIVVHPGGALSLQSHLHRSEHWIVVRGTARVTIDADVHLMTENQSVYIPLGARHRLENPGKVPMELIEVQTGSYLGEDDITRYEDVYARGQGARG

SEQ ID NO: 12935 - protein, 568 aa, Vibrio angustum S14
MKEITVVQYLINALKAINIHHVFGVPGDFAFPINDAICEDDNIEWIGSSNELNASYAADGYARIHGVAALSTTYGPGELSALCGVAGAYSAHLPVIFITGMPSEKVMASHALIHHTLGDGQFGTFAKMADNVVEASTILTVDNAENEINRVIQLALSAKRPVYIALPEDVALSILPAPQEFNFTFEPQTGSDDVIQLAELIAYKINNATQPLIMIGEHLRVCHAQKQALRLLEKANLPFSTMFADKALLDETHPNFIGLCDGKVINKHINDYVESSDFILNLGALFTDFNTGAFTIQWPEDIVNIYQDKININKRQHPPVNFCRLLETLTPLIHPRTNTYNCYMGYSHLEPAANTENNHNDLITAHSLYPRLETFFKEDDQVIAETGTISMGLGLARLPKGARFENQTLWGSIGWATPAAFGAAIANPSCRTVLLTGEGSHQLTVQELGQFHRFGLKPIVIVLNNNGYLIERILCKDPMINYNDLCQWNYSQLPQAFGAKDWLSMKVTTNAELDHALELASTATTGVYIEVVTAMMETAALAANLASQLNPQRGLQVHVPPVQEKEFA

SEQ ID NO: 12936 - protein, 531 aa, Chlamydomonas reinhardtii
MAEKPATVNAELVKEMDAAPKKYPYSLDSEGKANYCPVWRFTQPHMMAFHLSWICFFMSFVATFAPASLAPIIRDDLFLTKSQLGNAGVAAVCGAIAARIFMGIVVDSIGPRYGAAATMLMTAPAVFCMALVTDFSTFACVRFFIGLSLCMFVCCQFWCGTMFNVKIVGTANAIAAGWGNMGGGACHFIMPLIYQGIKDGGVPGYQAWRWAFFVPGGIYILTATLTLLLGIDHPSGKDYRDLKKEGTLKAKGAMWPVVKCGLGNYRSWILALTYGYSFGVELTVDNVIVEYLFDQFGLNLAVAGALGAIFGLMNLFTRATGGMISDLVAKPFGMRGRIWALWIIQTLGGIFCIVLGKVSNSLSSTIVIMIVFSIFCQQACGLHFGITPFVSRRAYGVVSGLVGAGGNTGAAITQAIWFAGTAPWQLTLSKADGFVYMGIMTIGLTLPLFFIWFPMWGSMLTGPREGAEEEDYYMREWSAEEVASGLHQGSMRFAMESKSQRGTRDKRAAGAPLESHSNSDSEPAAAKPVVV

SEQ ID NO: 12937 - protein, 519 aa, Methylobacillus flagellatus KT
MTTQTNTVEVKAGSFSRDFFASIVVFLVAVPLCLGIAIASGLPPTAGIITGIIGGLVVGSISGSPLTVSGPAAGLVVIVADIVAEFGLAIYGVIVLAAGLVQILAGVFKLGVWFRAISPAVIHGMLGGIGILIIGSQFHIMLDRDPLSSGIANLIDIPNGLLETFESHGGNIYAAITGIITIVAIVLWTRFAPAKLKLIPGALIGVVLAVIVANLFNFDIKYLTDLFDGPTDLQNILGTIITPTMSTIEASMTTGVLLAVVSLAFIASAESLLSCAAVDQMHQGVRTKYDRELMAQGVGNAICGFLSALPMTGVIVRSSANVEAGATSRVSTILHGLWLLLFISVFLFTLEYIPVATLAGVLVYTGYKLAYPKVAKELLSYGKAELAIYIITIVTIVSFNLLAGVVTGLVLSIAKLLYVFSHVSIKAEHQPDSKQTTLHLKGSATQLGIPKLVSVLDHLEPGREIHVLFDDLEYIDHACIQLLDGWQKQYQMTGGKVIIEWDSLIGKYHARETAIAEGN

SEQ ID NO: 12938 - protein, 322 aa, Brassica napus
  misc_feature (137)..(137): Xaa can be any naturally occurring amino acid
  misc_feature (157)..(157): Xaa can be any naturally occurring amino acid
  misc_feature (161)..(161): Xaa can be any naturally occurring amino acid
  misc_feature (167)..(167): Xaa can be any naturally occurring amino acid
  misc_feature (177)..(177): Xaa can be any naturally occurring amino acid
  misc_feature (199)..(199): Xaa can be any naturally occurring amino acid
MMKMQIGVLAFLVALSAIESGIASPNTVPAFLWSPHLQAGNGGMDEAVNYQVMSAKDLVDSVFTQGGWSNILCSEKKVEHPVVDVALVFIGRELLSSDVSSKRNSEPSLVNTLNGLFTASNFSLAFPYISAPEEERXMESLLLSGLKQACPHNVGVXNIVXSDSCFXEDGTIQKLSXDLQSFKDHLLARRETRKEGETXDWVVLCSQGSESISESGQSHSERESISELVSSVEQSGSKYTALYVSDPYWYTSYKTLQRFLAESATGNSTAGVSTTCDELCKFKSSLLEGILVGIVFLLILISGLCCMAGIDTPTRFETPQDS

SEQ ID NO: 12939 - protein, 295 aa, Agrobacterium tumefaciens str. C58
MVEQKKIRKAVFPVAGLGTRFLPATKAVPKEMLTVVDKPVIQYVVDEAAEAGIEHFVFVTGRGKAVIEDYFDIQFELEQMLRERNKNAELTLLAGLLPKAGTASFTRQQVPLGLGHAVWCARDIVGDEPFAVLLPDMIMHSQKSCLKGMVELYDQTQGNVIAVQECAPDQTHKYGIVGVGNAVGEGFKITEMVEKPAKGTAPSNFYINGRYILQPEIFDILENQERGAGNEIQLTDGMLTLAKSQEFSGYHFRGQTFDCGAKDGFILANVAFALERGDIRPAIEEPIKALIEGLK

SEQ ID NO: 12940 - protein, 388 aa, Bordetella pertussis Tohama I
MIRSKLPDVGTTIFTVMSRLAIEHKAINLGQGFPDFDPDPELCVLVGKAMAAGHNQYPYMPGVAPLREAIAAKVKTLYGHAYDPETEITVTSGATEALMATVLAAVGPGDEVVVIEPCYDSYLPAIRLAGGTAVPVPLRAPTRDDPYYRIDWQRVRDAIGARTRLLMLNFPHNPTGAVLDESDLDALESIVRETGVLLLSDEVYEHIVFDGKPHASLSRRPLLAEHAFVISSFGKTYHTTGWKVGYCCAPRQLSAELRKVHQFMVFTVSSPMQFALAEYMANPKPYLDLPAFYQAKRDRLAAGLANTRFRPLPSPGTFFMLADYSEITKHAEADFARHLTIDHGVTVIPVSAFYQNPAAPESNHHLVRFCFAKQDATLDAAIERLAHV

SEQ ID NO: 12941 - protein, 612 aa, Streptococcus pyogenes MGAS8232
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNMPAANKVLTKEEVLKREPDLKQEGLLGGGVYLDFRNNDARLVIENIKRANRDGALIASHVKAEDFLLDDNSKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFDRDENGLFTLAGGKITDYRKMAEGALTGIIQILKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVIKEMAKHFEWSDQERVAQEDDLRRVIADNDLSALKGQQEG

SEQ ID NO: 12942 - protein, 368 aa, Synechococcus sp. WH 7805
MSVINAFRRRFSPAPVLQDWPGLIEAYRPWLPVTKSTPVVTLREGATPLIPVPSVAERIGRDVKVFVKYDGLNPTGSFKDRGMTMAISKAKEAHCEAVICASTGNTSAAAAAYARRAGMRAFVLIPDGYVAQGKLAQALVYGAEVLAIRGNFDRALDIVREVSDQFPVTLVNSVNPYRLQGQKTAAFEVIDALGDAPDWLCIPMGNAGNITAYWMGFQEYNQAGRSRKLPRMMGFQASGSAPLVNNTTVTDPDTIATAIRIGNPVNREKAIAARQASDGDFLDVTDAEIIEAYKLLGGQEGVFCEPASAASVAGLLKRKEEVPSGATVVCVLTGNGLKDPDCAINNNDAAFHTDLDPDLGTVARVMGF

SEQ ID NO: 12943 - protein, 448 aa, Lotus japonicus
MVLRKVGKYEIGRTIGEGTFAKVKFAQNTETGESVAMKVLDRNTIIKHNMVDQIKREISIMKLVRHPYVVRLYEVLASRTKIYIILEFITGGELFDKIIRHGRLSEAESRRYFQQLIDGVDYCHSKGVYHRDLKPENLLLDSLGNIKISDFGLSALPEQGVSILRTTCGTPNYVAPEVLSHKGYNGAVADVWSCGVILYVLLVGYLPFDELDLTSLYSKIEKAEYSCPPGFPVGAKTLIHKILDPNPETRITIEQIRNDEWFQRGYVPVSLLEYEDVNLDDVNAVFDDAEEQRANQQCDHEDMGPLMLNAFDLIILSQGLNLAAIFDRGQDSMKYQTRFITQKPAKVVLSSMEVVAQSMGFKTHIRNYKMRVEGLSAKKTSHFSVMLEIFEVAPTFYMVDIQKAAGDAGEYLKFYKNFCGNLEDIIWKPPHESTKSKVSKTRSKRRSR

SEQ ID NO: 12944 - protein, 564 aa, Prochlorococcus marinus str. NATL2A
MSSTEAMPKTRTFSEFAKQADYSLMDSLKADPQATDDGDDHLTREVFSGHYVPVTPTAISKPEYVTHSKTLFNELGLSQELALDELFRRLFSGDISVATAPMRPVGWATGYALSIYGTEYTQQCPFGTGNGYGDGRAISVFEGLFNGKRWEMQLKGGGPTPYCRGADGRAVLRSSVREFLAQDYMQSLGVPTSRSLTLYASRSETVRRPWYTKDSNSINPDILVETPAAISTRVAPSFLRVGQIELFARRVRNNEHQDAMKELEMIVKHLIVRNYKKEIDPTLSFSNQVVELANSFRERLTSLVANWMRIGYCQGNFNSDNCAAGGFTLDYGPFGFCELFDPRFQPWTGGGEHFAFFNQQVAAEANYQMFWGALRPLLNGNAESLERLDSIRDGFTTVMNQKMENMWAKKLGLVTYDAPLVNEMLRLMVHTKVDYTIFFRKLSSIPNKLTDLKDSFYLPISEETESKWISWLQRWREQVISKGDQNEISAKMKSINPKYTWREWLITPAYEKAEEGDYGLIKELQAVLDEPYEEQSLEIQKKYDRLKPKKFFGAGGVSHYSCSS

SEQ ID NO: 12945 - protein, 566 aa, Candida glabrata CBS 138
MFRREKEDGVEDITGNISQLGLNGTLSPATGNTPFKKYAPSTPTQYKENRSGASPYSTSPTKSIFKKEKPRERIINSPKKLPRDFHRKATSNKTQRLVSVCQMYFLDYYCDMFDYVISRRQRTKQMISNIQEYKQNHTIPDEQLNEEWNNYLQKEHEVLRKRRLKPKNKDFEMITQVGQGGYGQVYLARKRDTKEVCALKILNKKLLVKLNETNHILTERDILTTTRSEWLVKLLYAFQDPESLYLAMEFVPGGDFRTLLINTRTLRSPHARFYISEMFCAVNALHELGYTHRDLKPENFLIDAEGHIKLTDFGLAAGTVSNERIESMKIRLEEVKNLEFPAFTEKSIEDRRKIYQNLRQNDINYANSMVGSPDYMALEVLEGKKYDYTVDYWSLGCMLFEALIGYTPFSGSSTNETYENLRHWKRTLRRPFLNDGRSAISDRAWELITRLIADPINRLRSFEHVKRMNYFHEINFDTLRQLSPPFTPQLDNETDAGYFDDFTNEADMAKYADVFKRQDKLAAMVDDSEVDSKLIGFTFRHKNGNTGSSGVLYKGHENANPFSTFY

SEQ ID NO: 12946 - protein, 116 aa, Triticum aestivum
LHQITKELSRLHEMALQNRLSTNDITGGTITLSNIGAIGGKFGSPVLNLPEVAIIALGRIQKLPRFDDDENVYPSSTINVTVGADHRVVDGATVARFCNEWKSLVEKPELLLLHMR

SEQ ID NO: 12947 - protein, 412 aa, Lotus japonicus
MASVGVAPTSGVREASGCHGAAGVDRLPEEMNDMKIRDDREMEATVVDGNDVTETGHIIVTTIGGRNGQPKQTISYMAERIVGHGSFGVVFQAKCLETGETVAIKKVLQDKRYKNRELQTMRLLDHPNVVALKHCFFSTTEKDELYLNLVLEYVPETVHRVIKHYNKLNQRLPLIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCTALDALTHPFFDELREPSTRLPTGRFLPPLFNFKSHELKGVPAEILVKLVPEHARKQCPFLGL

SEQ ID NO: 12948 - protein, 310 aa, Pseudomonas aeruginosa PAO1
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPGRDPGEVARGWLNPRCRLVFVTHGGAGASVHCTHGSWSRPADTALPLRDTVGAGDTFQAATLAYLRRLDADSPAGLAALSREAIDAMLAFAIRAAAVTCSRVGPDLPFAHEL

SEQ ID NO: 12949 - protein, 333 aa, Bordetella parapertussis 12822
MPEARLPRIAVLATGGTIAGAQTDAASGAYRAGSYGVGQLLAAVPQLAGLARIGAEQIANVGSQNMSHAVWRQLALRAAALCDDPATDGIVITHGTDTLEETAYFLSLVLPVDKPVVLLGAMRPATALSADGPVNLYNAVALACHPAARGRGPLVVMNEDIHLARHVQKTAASGIAAFASPNAGRAGVMQGGRPVFHARAERQAADALLRPDELPQQAWPRVDIVHACVDLDGELIDFMAGRAQGIVLAGVGDGNATDAALQALQRACARGVAVVRASRTGSGRVGRNIEIDDDACGFIAAGDLSPQKARVLLTLGLCQTRDTARLQALVDSR

SEQ ID NO: 12950 - protein, 212 aa, Gossypium turneri
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEM

SEQ ID NO: 12951 - protein, 477 aa, Silicibacter pomeroyi DSS-3
MAKQPMLKFVQIERDMPEKRAADARKEDFHEIYAEYAAVKAAEQASRCSQCGVPYCQTHCPLHNNIPDWLRLTATGRLQEAYETSQATNTFPEICGRICPQDRLCEGNCVIEQSGHGTVTIGAVEKYITDTAWDMGWVKPASPVAERSESVGIIGAGPGGLAAADMLRQAGVQVTVYDRYDRAGGLLMYGIPGFKLEKEVVERRNRLLADGGVRFELNCDVDAAKFAELRAAHDAVIIATGVYKSRDLSMPGSGLGGIEKAIDYLAASNRKSFGDEVADFDNGRLNAEGKRVVVIGGGDTAMDCVRTAIRQGAVSVKCFYRRDRANMPGSQRETQNAEEEGVVFEWLSAPKGFTGDDKVAGVMVQKMRLGQPDASGRQSPEVIEGADYVEEADLVIKALGFEPEDLPTLFGQPDLPVTRWGTVKAAFRTGATEMEGIYAVGDIVRGASLVVWAIRDGRDCAEAILEGFGAKTAMAAE

SEQ ID NO: 12952 - protein, 219 aa, Gossypium turneri
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 12953 - protein, 547 aa, Lotus japonicus
MESTRRWFSKFKAMDKTKPSKNKEDTGMAKEGLQPPTNEETPSNVTQQKVEAAKQYIENHYKKQMQSLQERKERRNMLEKKLADAEVSEEEQNNLLKYLEKKETEYMRLQRHKMGADDFEPLTMIGKGAFGEVRVCREKATGHVYAMKKLKKSEMLRRGQVEHVKAERNLLAEVDSNCIVKLYCSFQDEENLYLIMEYLPGGDMMTLLMRKDILTEDEARFYVGETVLAIESIHKHNYIHRDIKPDNLLLDRHGHMKLSDFGLCKPLDCSNLQEKDFSAMSNRSGALQSDGRPAAPKRTQQEQLQHWQKNRRMLAYSTVGTPDYIAPEVLLKKGYGVECDWWSLGAIMYEMLVGYPPFYSDEPMQTCRKIVNWRTHLKFPEEAKLSPEAKDLICRLLCNVEQRLGTKGADEIKAHPWFDGIEWDKLYQMKAAFIPEVNDELDTQNFEKFEEADKQTEPSAKAGPWRKMLPSKDINFVGYTYKNFEIVNENEIPGIAELKKKSTKSKRPSIKALFDDESAMAANQPVKGSFLNLLPPQMEVPEKNESQ

SEQ ID NO: 12954 - protein, 426 aa, Lotus japonicus
GRVLGQGNFAKVYHGRNLATNENVAIKVIKKEKLKKDRLVKQIKREVSVMRLVRHPHIVELKEVMATKGKIFLVMEYVKGGELFTKVNKGKLNEDDARKYFQQLISAVDFCHSRGVTHRDLKPENLLLDENEDLKVSDFGLSALPEQRRDDGMLVTPCGTPAYVAPEVLKKKGYDGSKADIWSCGVILYALLSGYLPFQGENVMRIYRKAFKAEYEFPEWISPQAKNLISNLLVADPEKRYSIPEIISDPWFQYGFMRPLAFSMKESAVGEDSTIDHFGGEEEEVPELVAAMGKPARPFYNAFEIISSLSHGFDLRSLFETRKRSPSMFISKYSASAVVAKLEGMAKKLNFRVTGKKEFTVRMQGMKEGRKGKLAMTMEVFEVAPEVAVVEFSKSAGDTLEYVKFCEEQVRPSLKDIVWSWQGDSN

SEQ ID NO: 12955 - protein, 365 aa, Candidatus Protochlamydia amoebophila UWE25
MSTNLSVGIVGLPNVGKSTLFNALTSNQAAASNYPFCTIDPNIGIVDVVDDRLDRLSALSNSKKIVYANMQFVDIAGIVEGASKGEGLGNKFLSNIRETDAIVHVVRCFESSDIIHVAGKVDPIHDIEIINMELRLADLQMIENVLARLEKQAKTKKELVLSLETLKKVSEHLNENKPVRTLELTDEEKESIEAYRFLSSKKVLYVANVSEEELPEMDNEFVRRVKAYAEAEGNAVIPICAKLEEEIAQLPLAERKSFLESLGLQQSGLERLIKASFNMLGLLTYLTTGEIETRAWTITEGTHAAEAAGKIHSDIQKGFIRAEVVAFDDMMTYKGRAGAREQGKVRAEGRDYLVKDGDVILFMHH

SEQ ID NO: 12956 - protein, 280 aa, Arabidopsis thaliana
MSKEVSEEGKTHHGKDYVDPPPAPLLDMGELKSWSFYRALIAEFIATLLFLYVTVATVIGHKKQTGPCDGVGLLGIAWAFGGMIFVLVYCTAGISGGHINPAVTFRLFLAGKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 12957 - protein, 518 aa, Pycnoporus cinnabarinus
MSRFQSLFFFVLVSLTAVANAAIGPVADLTLTNAQVSPDGFAREAVVVNGITPAPLITGNKGDRFQLNVIDQLTNHTMLKTSSIHWHGFFQQGTNWADGPAFVNQCPIASGHSFLYDFQVPDQAGTFWYHSHLSTQYCDGLRGPFVVYDPNDPHASLYDIDNDDTVITLADWYHVAAKLGPRFPFGSDSTLINGLGRTTGIAPSDLAVIKVTQGKRYRFRLVSLSCDPNHTFSIDNHTMTIIEADSINTQPLEVDSIQIFAAQRYSFVLDASQPVDNYWIRANPAFGNTGFAGGINSAILRYDGAPEIEPTSVQTTPTKPLNEVDLHPLSPMPVPGSPEPGGVDKPLNLVFNFNGTNFFINDHTFVPPSVPVLLQILSGAQAAQDLVPEGSVFVLPSNSSIEISFPATANAPGFPHPFHLHGHAFAVVRSAGSSVYNYDNPIFRDVVSTGQPGDNVTIRFETNNPGPWFLHCHIDFHLDAGFAVVMAEDTPDTKAANPVPQAWSDLCPIYDALDPSDL

SEQ ID NO: 12958 - protein, 206 aa, Gossypium harknessii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQ

SEQ ID NO: 12959 - protein, 253 aa, Ustilago maydis 521
MSDWENDDEPQQPVAPPKLSAAGRKKFDDEDVEDEVKDDWEEEDSEPEAAKTPVVLPPRKKKSVKQKIAEKEEEERLRREQGLDTDEEEEEEEDWDADPIAKRRMEREAQLKSDVENAANLLGTAKLSDDELSSLKTANPSSKEDWEKLSTSIFTELIKKHASKPGFEKHFVPHFYKTLASTMRDVDIRKASTMLKTYAEEKVKAEKEAKKAGGQKTKLAAAKPKMVGTSSAKNVIDTNVYGDEALDDDLDFM

SEQ ID NO: 12960 - protein, 211 aa, Gossypium thurberi
DVYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 12961 - protein, 344 aa, Kluyveromyces lactis NRRL Y-1140
MLNATKRLACLSFFVYVSLASPGDRLPEFSDCVRACEVVRHCTDRFEEDSFNPFINEQFSEPALVYKALLWDCTSDCDYQCQQKITLDREERNEDIYQFHGKWPFKRVLGMQEFYSTIFSICNFVPHYRGFKLARKSLAKLQKTSQRRVLILNYIFISMAGMIAWICSSIFHTRDLIITEKLDYVFAGATVLSGFHGVFYRVARLDLHPRVGALFSLSVFTIFVGHLLRLYLNWSYAYNMRFNIFFGLLQYILLITLAILNYRTFSSIRPDLVHDLSVVPVLLVVFTGVAMSSELFDFFSYRWQIDSHAIWHALTIVPSFYLYEFFLKDYHVLGSRTSTNIKNV

SEQ ID NO: 12962 - protein, 216 aa, Medicago truncatula
MNSVALRLSKHLRRSSHASVPRSTVLCYSTFTSETDAGQPSRDNNGLNKEELDDEFDDFLGGRPELQLQGVDPSRGWGFRGVHKAIICGKVGQAPVQKILRNGKNVTIFTVGTGGMYDQRIVGSKDLPKPAQWHRIAVHNEVLGAYAVQQLFKNSSVYVEGEIETRVYNDSINGEVKSIPEICVRRDGKLRLIRSGESVDKTSLDEFNVYIDEEIV

SEQ ID NO: 12963 - protein, 219 aa, Gossypium thurberi
DVYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 12964 - protein, 387 aa, Buchnera aphidicola str. APS (Acyrthosiphon pisum)
MEGVLSQLAVLVLEDGTKFHGRAIGAKGITVGEVVFNTSITGYQEIITDPSYSHQIVTLTHPHIGNVGTNSNDEESSKIYIKGLIIRDLSLTASNYRNKKSFSSYLKENNIIAISDIDTRKLTRILRTKGSQNGCIIEDKKQNYSIAYNKAKNFISLQDLDLAKKVSTKSIYNWDQGSFTFKKNNFFSINKQKFLFHVVVYDFGVKRNILRMLVDRGCYLTVVPAITDPKTVLNLSPDGIFLSNGPGDPRPCDYAIHAIQYFLKTNIPIFGICLGHQLLALASGAKIVKMKFGHHGGNHPVKDIKNNRVIITSQNHSFTVDTENLPNNIEITHSSLFDGTLQGLSLTNKSAFSFQGHPEASPGPHDASYLFDYFIKLIVSQKTTLSN

SEQ ID NO: 12965 - protein, 258 aa, Xanthomonas axonopodis pv. citri str. 306
MSVNLKTKEEIELMRVAGRLAAEVLDVVAPHVKPGVTTAELDRICHDHIVNVQGTIPANVGYRGFPKSVCTSVNNVICHGIPSAAKVLKDGDIVNIDVTVIKDGWHGDTSRMYYVGTPSVMAKRLVETTHEAMWRGIRAVKPGATLGDVGHAIQKFAEAERFSVVRDYCGHGIGKVYHDEPQVMHYGRQGEGLVLKPGMTFTIEPMINEGTYHHKTLPDGWTVVTKDRKLSAQWEHMVAVTEDGVDVLTLSANSPAPV

SEQ ID NO: 12966 - protein, 210 aa, Gossypium trilobum
VYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 12967 - protein, 380 aa, Methanococcus maripaludis S2
MSFQIDKRAYQSLKNFSNIIYKNAIVNKDDFSKTEEIVDITYNGNFVAKALYDPKFPLIKILTRENEEIDKDFFFKRINNANNYRTDILNYKDTYRMIYAEADYLPSIILDKYNKIASIQISSKIMDNYSDLIFECISEITDVETMYVQSGKKGSDVKTKIFGDKSQIETVISEGNAKFNVNMKGHKTGFFLDQRDNRIDLENYVKPGDKVLDICSYTGGFAVHAGIKGGEVTAVDLSEKALAVAEENMELNRVKNYNCMVSNAFDAMKEMIKNNEKFDVVVLDPPAFTDSSKDIKNALNAYNSMNYLGLKLAKRILVTCSCSHHIDRESFKHTIVSSSLRAKKEIRQIGSYRTQAPDHIITMANKDLEYLKCLFFNVVN

SEQ ID NO: 12968 - protein, 215 aa, Gossypium trilobum
VYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 12969 - protein, 702 aa, Rubrobacter xylanophilus DSM 9941
MGYLDVRKEDGVAVVWLDEPGSRVNKLSTPVLGEFEAALDELERDGGVRAAVLISAKKDSFVVGADIEEFSRLKTPAEVEGIIRKGHELLGRMESSPKPVVAAVHGPAVGGGLELILACHYRIATDHPATKFAFPEVMLGLLPALGGTQRFTRLVGVQKALEIITTGKNVYPSQARRMGLVDALMHPEGLLEAAKRAARALADGSLSPRRRRPSLRERVLEETPLDRLVYGRARELADRQTRGNYPAVPKIIECVRTGRKEGMEAGFEAERRAFASLLFTPESGALRNLFFLKTGAEKNPYAGRERKVGTVGVLGAGLMGSGIAQVSAARASRKVLLKDARLDLAAKGRGEVYRSLSRRVGRGMSAFERDRAVERIVPIEDYAPLARADLVIEAVPEDLELKRETIRQVEAVGRDDLVIASNTSAIPITEISAGARRPERIVGMHYFSPVPRMPLLEVVRKEDTPEWVLATCIQEGLAQGKTVITVNDGPGFYTTRILAFYINEALLLLEEGAAVDAIDEAMMDFGFPVGPLKLLDEVGIDTGVKINEVLRPLFAARSLRTSDRGAEVVAAGYKGRKSGRGFYLYEGREKGRVNPEVYEFLGTERRPIPARAIQERLSMMMVSEAVRCLEEGVLSSPQDGDVGAVFGLGFAPFRGGPFWYLDQMGAERALVLLNNLRSACGERFSPPALLEERAASGKRFYA

SEQ ID NO: 12970 - protein, 81 aa, Guillardia theta
MNEQEIFEKVQTIISEQLGVDKSQVTKDANFANDLGADSLDTVELVMAIEEAFNIEIPDDAAEQISNLQQAVDFISQKVAA

SEQ ID NO: 12971 - protein, 485 aa, Cleome spinosa
MAVAPTRIGLAGLAVMGQNLALNIAEKGFPISVYNRTTSKVDETVERAKREGNLPVYGFHDPESFVNSIQKPRVIIMLVKAGAPVDQTIKTLSAYMEEGDCIIDGGNEWYENTERREKAVTEQGLLYLGMGVSGGEEGARNGPSLMPGGSYEAYKYIEDILLKVAAQVPDSGPCVTYIGKGGSGNFVKMVHNGIEYGDMQLIAEAYDVLKSVGKLSNDELHTVFSEWNKGELLSFLIEITADIFKIKDDKGDGYLVDKVLDKTGMKGTGKWTVQQAAELSVPAPTIESSLDARFLSGLKEERVQAAKVFKEGGFGDILTDQAVDKKQLIDDVRRALYASKICSYAQGMNLIRAKSLEKGWGLKLGELARIWKGGCIIRAIFLDRIKQAYDRNPELPNLLVDPEFAKEIIERQSAWRRVVSLAINSGISTPGMSASLAYFDSYRRERLPANLVQAQRDYFGAHTYERVDMDGAFHTEWFKIAKSMI

SEQ ID NO: 12972 - protein, 456 aa, Physcomitrella patens subsp. patens
MGLRMRRRWSNSGCVRNSKRGVTKESVDKKEPVREGNTHINAQTFTFRELVAATKNFRADCLLGEGGFGRVYKGRLESTGQARGRSWWVQVVAVKQLDRSGLQGNREFLVEVLMLSLLHHTNLVNLIGYCAEGDQRLLVYEFMPLGCLEDHLHDLPQDKECLDWNTRMKIAAGAARGLEYLHDKAQPSVIYRDFKSSNILLDEKFHPKLSDFGLAKLGPVGDKTHVSTRVMGTYGYCAPEYAMTGQLTLKSDVYSFGVVLLELITGRKAIDNARAVGEQNLVAWARPLFKDRRKFPFMADPLLQGRYPMRGLYQALAVAAMCLQEQAATRPLIGDVVTALSYLASQTYDPGVQPQGSSRFAPATPSGEKREKEKKVPLGPNGAEERMVKEQKVGKVAMQSPDLREGGRDSPRAVRRTGTARDGVKPHIPTRERERAVAEARVWGENWREKQRGPTT

SEQ ID NO: 12973 - protein, 505 aa, Xanthobacter autotrophicus
MNKPEIAITKQSPFKARYGNFIGGKFVEPVGGRYFDNTSPVTGGKICEIARSDADDIEKALDAAHAAKDAWGKTSAAVRALILNRIADRMEENLDLLALAETWDNGKPIRETTAADMPLAIDHFRYFAGAVRAQEGGISEIDHDTVAYHFHEPLGVVGQIIPWNFPILMAVWKLAPALAAGNCVVLKPAEQTPASILVLAELIADLLPPGVLNIVNGFGLEAGKPLASSSRIAKIAFTGETTTGRLIMQYASQNLIPVTLELGGKSPNIFFADVVAEDDDFFDKAVEGFVMFALNQGEVCTCPSRALIQESIYDRFMEKALKRVAAIVQGSPLDPATMIGAQASSEQLEKILSYIDIGKQEGAEVLIGGERNTFGGDLAGGYYVKPTVFKGHNKMRIFQEEIFGPVVSVTTFTDDAEALHIANDTLYGLGAGVWTRDGNRAYRFGRAIQAGRVWTNCYHAYPAHAAFGGYKQSGIGRENHKMMLDHYQQTKNMLVSYSPKKLGFF

SEQ ID NO: 12974 - protein, 133 aa, Methylobacillus flagellatus KT
MAYSDKVLDHYENPRNVGSLDKNDPSVGTGMVGAPACGDVMKLQIKVNDQGIIEDAKFKTYGCGSAIASSSLVTELIKGKSLDQAMEIKNSDIAQELALPPVKIHCSVLAEDAIRAAVADLKAKQGAKDQQVA

SEQ ID NO: 12975 - protein, 147 aa, Cleome spinosa
MGCRRCRRTWKKDNDEKDRIPLIFITKYAEELDRKAAALSRSIRDLRLKLLPPVFSLHLHHLLAHSLASGSALAVQLNSHSTTREQFTRLVTARNRFARTNSDKGYVSDHEVGVHSNLPYSSAPRNDTQTRLLYLRSAFVVFIKISF

SEQ ID NO: 12976 - protein, 506 aa, Xanthobacter autotrophicus
MNSPAFLSSAHTSPFKPRYGNFIGGTFVEPVSGRYFENTSPITGKVICEVPRSDEHDIERALDAAHAAKKAWGRTSAADRALVLLKIADRLEANLELLAGAETWDNGKPIRETTLADIPLAIDHFRYFAACVRAQEGTLGEIDHDTIAYHYHVPLGVVGQIIPWNFPILMAAWKLAPALGAGNCVVLKPAEQTPASILVLAELIADLLPPGVLNIVNGFGLEAGKPLASSPRISKIAFTGETGTGRLIMGYAAQNLIPVTLELGGKSPNIFFADVAAEDDDFLDKAVEGFVMFALNQGEVCTCPSRALVQESIFDKFMEKALARVAAIKQGSPLDPSTMIGAQASSEQMHKILSYIDIGRAEGAQVLAGGERNVLTGELADGFYVKPTVFLGKNNMRIFQEEIFGPVVSVTTFKDEEEALHIANDTLFGLGAGLWTRDGSRAYRVGREIEAGRVWTNCYHAYPAHAAFGGYKQSGIGRETHKMMLDHYQQTKNLLVSYSPKKLGFF

SEQ ID NO: 12977 - protein, 437 aa, Cleome spinosa
MEFLPVSAVLQKASKPAIVVASVLILLTVTPALYSLLGGYSIFPFVITSNPFLLSLPPPSDGSSSSSSPDASHDPSPSQGPSDNSSSSVDEEKCDYFSGEWVSNPEAPYYTNTTCWAIHEHQNCIKYGRPDTEFMKWRWKPDGCELPVFNPIEFLQIVSGKAMAFVGDSISRNQVQSLLCLLSRVEYPQDISPTADTDFRTWKYPSYNFTVHALWSPFLVSSTEADPSGPDKTGLFNLYIDEFDPIWMAEIGQLDYLIISSGHWFFRPVIFYENRQLVGCHYCGLANVTVLPLDYGYRKALRTVLKAILDNFAGVAFFRTFSPHHFEGGPWNKGGDCIRTRPYRRNETVFRDENLEFHNIQLEEFRAAEEEAVKKGLRLRLIDTTQAMLLRPDGHPGKYGHPPNAQVTLFKDCVHWCLPGPIDTWNDFLLRMMKTEK

SEQ ID NO: 12978 - protein, 462 aa, Triticum aestivum
  misc_feature (391)..(391): Xaa can be any naturally occurring amino acid
  misc_feature (403)..(403): Xaa can be any naturally occurring amino acid
MVLSHAASAGSSDESVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEXFEISEFLRRFGXGSVPAYTMPPDAPARQPGSASVIREGLLSRNFREGLRIQIEKVLKNLEPPRPKKGSPPV

SEQ ID NO: 12979 - protein, 250 aa, Methylobacillus flagellatus KT
MFSKIKEDIGVVFERDPAARTRWEILTTYPGVHALLIHRFSHRLWRMRLYWLARLSSYIARWFTGIEIHPGAVIGRRVFIDHGMGVVIGETAVIGDDCTLYHGVTLGGTSWNKGKRHPTLLNGVVIGAGAKVLGPITIGAKAKIGSNAVVVKDVPDNATAVGIPARIVDQEQPRPQDNMAEKIGFAAYAVSEKMNDPLNKAIQTLIDHIANQDNQLQEVRQQLAKLGADIETDVEIGHAFDVNSINKIVD

SEQ ID NO: 12980 - protein, 179 aa, Cleome spinosa
MELLHSGTIPSTQKLAIVVTMAIALFTIIPLLYPFRANPNFFPKQPPAPSTSHHQTRPTFLTEAAVEESNCDIFSGKWVPNPDTPYYTNTTCWAIHEHQNCMKFGRPDSGFIQWRWKPDACEMPVFNPFQFLEIMRGKSMAFVGDSVSRNHMQSLICLLSRLAYLGFKIHEICVIWCSH

SEQ ID NO: 12981 - protein, 468 aa, Rhizobium leguminosarum bv. viciae 3841
MLQYDLVVVGSGPAGRRGAIQAAKLGKKVLVIEQGKRVGGVSVHTGTIPSKTLRETALNLSGWRERGFYGRSYRVKEEISADDLRRRLLITLNHEVEVLEHQFARNRVQHIRGKASFINASTLQVIKDDGETTQVTAASVLLAVGTKPFRPNYMPFDGKSVLDSDELLDIQDLPRSMVVIGAGVIGIEYATIFSALDTAVTVIDPKATMLDFIDKEIIEDFTYQLRDRNMKLLLGQKADKVERLENGKVELTLDSGRRLTTDMVLFAAGRMGATDALNLQAIGLEADSRGRLKVNPETFQTSVANIYAAGDVVGFPSLASTSMEQGRIAARVAVGAVAKEPPKYFPYGIYAVPEISTCGLTEEEMKERGIPYECGIARFRETSRGHIMGLDTGLLKLIFSLKTRRLLGVHIVGEGATELVHIGQAVLNLKGTVEYFVENTFNYPTLAEAYKIAGLDAWNRMGDIKSEL

SEQ ID NO: 12982 - protein, 278 aa, Rhizobium leguminosarum bv. viciae 3841
MVNYIEASTAPPKNTGAIRLYDAQAFEGMRRACQLTARCLDALADIVKPGLLTDEIDRFVFDFGMDHGAYPATLNYRGYTKSTCTSINHVVCHGIPNDKPLRDGDIVNIDVTFVLDGWHGDSSRMYPVGVVKRAAERLLEVTYESLMRGIAAVRPGARTGAIGEAIQTYAEAERCSVVRDFCGHGVGRLFHDSPNILHYGRANEGPELREGMIFTIEPMINLGRPHVKVLADGWTAVTRDRSLSAQYEHTVGVTSDGCEIFTLSPGGLDRPGLPSHNG

SEQ ID NO: 12983 - protein, 364 aa, Bacillus pumilus SAFR-032
MKRRLVLENGTVFEGTGFGSLESSVGEVVFNTGMTGYQEILSDPSYCGQIVTLTYPLIGNYGINRDDFESITPFVKGLIVKELCEKPSNWRSAYSLDEYLKMKNIPGLSGIDTRKLTRMIRSAGTLRGAFAGPDEQVEDVVSRLQTMQLPTDQVSQVSVKNAYPSPGRGKRIVLVDYGMKHGILRELNKRDCDVIVVPYNITADEVLQLKPDGIMLSNGPGDPVDVPEAVEMIQQLIGKVPLFGICLGHQLFALACGASTEKMKFGHRGSNHPVKELATGKVTLTSQNHGYTVSAINEDVLEVTHIALNDNTIEGLKHKEAPAFTVQYHPEASPGPEDANYLFDQFMDMIHTTEKEGEEVCQNA

SEQ ID NO: 12984 - protein, 479 aa, Agrobacterium tumefaciens str. C58
MKRNRKVKILATLGPASSEEAMIEKLHLAGADLFRINMSHASHDVMRTLIQRIRSVESRNGRPIGILADLQGPKLRVGKFAETKVDLVPGQTFTLDNNDTPGDNTRVFLPHPEILEAVKPGHRLLIDDGKLHLRAEKSDGKSIVTTVVSGTRISDRKGISLPDTLLGVGVLTDKDRVDLDAVLETNEVDWVALSFVQRPEDLAEVRKISRGRVGLMSKIEKPQAVERIEEIIELSDALMVARGDLGVEMPLEAVPGIQKQLTRACRRAGKPVVVATQMLESMITAPVPTRAEVSDVATAVFEGADAIMLSAESASGDYPIEAVSTMASIASTVEQDPYYSNIIYAQRPQPEATGADAISLAARQIAETLKLAAIVTYTSSGTTGLRAARERPQVPIIALSPIIQTARRLSVVWGLHCVVTGDASDLDDMVNRACRIVVSEGFGKPGDRIIISAGVPLGTPGATNMVRIAYIGSDGQSGV

SEQ ID NO: 12985 - protein, 691 aa, Lotus japonicus
IQSYHFSVYSTSPVSRMKPLLHPSSILTFWFTLFIISINIQTPLCADNDSKYYTNCYEAFSCDGSSVGNLKYPFWGGNRTEYCGQSQLELVCEDRAAKITINSITYRVVKWEDSTQKLTVARDDFWGGVCAVSDYQNSSFDNSPFQYDFSGDNNVTLLYNCGSIDPPSGFYRSSCDGGSRVVYYIVGVGPLSFASACTSVVVPVLASQVSALASTAGNIDEVLNEGFGLRWSGNYQECTGCLDTRGACGFDGKFRCFCEDGPHQSSCISDRAPAPDKRRGSTTRNIVIGVAASCVGGLVAIISIAIYIRRKFKSLSGQTMISRKRSTFVEHDVEAFMQSYGSLAPRRYSYSEVKRITNSFVHKLGQGGYGVVYKATLPDGRLVAVKVISESGGSGEDFINEVSSISRTSHVNIVSLLGFCYDKNRRVLIYEFMPNGSLDNFINGMGSPNAICCFDWNTLYKVAIGIARGLEYLHQGCNTRILHLDIKPQNILLDEDLCPKIADFGLAKICKRKESIVSMLGTRGTPGYIAPEVFSRAFGGVSHKSDVYSFGMLILEMVGGRKNYDSGGGSQSSEMFFPDWIYKDLEQGDVHTNFLVITEEEHEMARKMILVSLWCIQTRSSERPSMNKVVEMLEGTLESVPYPPKPILHSPEKLLLQNSDLTSGNTLETDSMTTEKDGSIELNVLSKNVPG

SEQ ID NO: 12986 - protein, 1891 aa, Oryza sativa Japonica Group
MVQALVFAVGIVGNILSFLVILAPVPTFYRVYKKKSTESFQSVPYAVALLSAMLWLYYALLTSDLLLLSINSIGCLVESLYLTVYLLYAPRQAMAFTLKLVCAMNLALFAAVVAALQLLVKATDRRVTLAGGIGASFALAVFVAPLTIIRQVIRTKSVEFMPFWLSFFLTLSAVVWFFYGLLMKDFFVATPNVLGLLFGLAQMVLYVVYKNPKKNSAVSEAAAAQQVEVKDQQQLQMQLQASPAVAPLDVDADADADWRRRRRPPRSGQLTMTPSTTGASSSTSRRRRSRRRRCRPWRWPDRSIRLTIDSIEFDYLPYSRICCFDIFLNWSVLASPVGRRQNGIGMQMNRGSIVRPSQVSILGPVGYGPTTLPLRHSDVVVGAPVAPKTINSLHALSPIGLYCCRDEKIQHVLGHFQKDFEGGVSADNLVILSGKNFLTGSKYGGYGSFLPTYQRSPPPLPQSRSPPKVANVGTSRSPYQQSAESMGQYPSTVANESISRNNGSTAPSSGDLCKREICSSTNGEKDSVACSDSLDSSFNGSDQKTLKVRIKVGSTNTLARKNASIYSGLGLDISSSSSMEGSPDGHEGQSPVCSNVPYESPRTILQIMTYFSVPGGFLLSPLHGNILKLTNKVTPLVNKWETNLDLKNVPRAVDGHSELSLSSGHVKAHVAKKMKPDGKKKKSIDTKTRKDANNTSAILGKEANVEIPGSRVILSDTHDITCSSGAPTTELKGVSQFTEESTKDARPKQQMGCNDLGTVKSEAVKTEVTKHIEENSSFDSSGNGCLAPRGKVKLKASKVDRTSEDMNISSHKFSPYDRKKESKVKPMRTFEPAMDDFEGNVDKDWGAGSSDDLKTIHGKETFASERTVEDNSRTEVKRMQKEHKANFVAPSSFLEDGNFTHSSVLVNDGATDSHLKSNHFENKSKEKSHKDLSENLPKRSIGNKEGASLESVSVQGQRKEKMMNSDNEKELHITGPAKKEIPSSVKHGTFPGSEEQQLHMPSNGGIIPGPANAASLPAPVLIEDNWVCCDMCHKWRLLPYGTNTSMLPKKWICSMLDWLPGMNKCDISEDETTNALNALYVTQIPAAGVSSGGPHTAHASVAASSTYNISGQLGQSRKRKNALKDENCYEHDQQAPAKMTLTSNQQAPAKNREVVDSEHYTNDRDPVSTHDLVPQSKSASERHKSKHKSRSSHSDGGDLTEKSKKHSKSKNRRGIDRDEHKTSKKTKKEDRHYFNKDWKNEYDLAGNKVRDETKALSAKAKMSKDSCEQDEFSLRKEKASRFDILEKTKRINDDDVAFHEKMKEHRAGIETLDLSGKKKTVKEWEDNRLSSMDHTSKGGDNENLNERLSKIKKSEARPEEVQDANALFSSAGRRQDNELVADNKFVTCKEGPSELWDNQPPRQVLNLAEPTRRDVACLQSSTVATSSSSKVSSSRRNKNSREAKGSPVESVSSSPLKNSNTDKISKARKTGKDGELNADSSILHTPMKYPTHEVGLLHTGQQAVGEAILRGSTNNSGRNGSSNLISEGNKQIEMSSRKEKLRPSIDNQDMQKSIGQDNHSHMKEGKSEVHTTRVKPGASKNHTQLRSNVENGDSASPIRRDGNMIAFALKEARDLKHKANHLKEKGLELESMGLYFEAALKFLHVASLWETPNLDNSRSGDVAQSMKMYSETAKLCRRSVYHFIKQGIKVTKDAVVAAIARMENWRRLTVGRNLDHSLATFCAHAYERCNKMASAALAYKCVEVAYLKAAYYKHPSASKDRQELQSVVQIAPGESPSSSASDIDNLNSHGLSKALSTKGGNSPQVAGNHLPLAVRNQAHLLRLLAYTNDVNCAFDATRKSQVAIASAASSQERGKTVDDGLASVRTVLDFNFNNVNELLRLVRLSMELINT

SEQ ID NO: 12987 - protein, 330 aa, Leptospira interrogans serovar Lai str. 56601
MLEKQFNSYNDFGNPMVMFRNRITRMAKHWKKWARKRNIECFRIYDRDIPQVPVCVDLYGPLCHISVYKNNYEISDEDRVKESEEISKIICEILSIHPNQIFWKKREPKKGKEQYEKQSEQSELFEVGENGLRFYVNLSDYVDTGLFLDHRITRDLVRKESKGKKFLNLFSYTGSFTVYAASGGATKSLSVDLSNTYSDWAEENLKLNGFSLTKHRILRADVMEWLRHERKNPDREKYDLIVVDPPTFSNSKKTNEIFDIQKNHVEVLNILYRDFAFPGAVLFFSTNFRKFEFSKQSVLWDNLKDISKFTISEDFRNEKIHFCWRMEKPV

SEQ ID NO: 12988 - protein, 272 aa, Vibrio campbellii AND4
MEHKKIAFIGAGNMVRAIVSGLVANGYPAQNIIATAPSETRRQPLEQDFGIRTTSDNIRAATEADVVVLSVKPQMMEQVCKPLQSIDLCDKLVISIAAGINCSRLDDMLATKLNIVRVMPNTPAQLGLGMSGLYAPKHVQEQDKAFAAELMQACGKVCWVEQESGINNVIAAAGSAPAYFFLFMEAMQAEAIAQGFDRDTARTLIQQSALGAASMVVENPETELSTLRENVTSKGGTTAEALRTFNEQQLPDIVARAMQAAVARAEEMEKLF

SEQ ID NO: 12989 - protein, 308 aa, Cytophaga hutchinsonii ATCC 33406
MSSLKLFSGTNSHYLAEKIAAAYGEPLGHRTIKRFSDGEIYVSFDESVRGKDVYIIQSTFPNADNLMELMLMVDAARRASAAEVAAIIPYFGYARQDRKDKPRVPIAAKLVANLLSAAGVDRLMTCDLHAGQIQGFFDFPVDHLDGAAIFIPYLRSIQSDKLIIASPDVGGVKRAREFAKHLKAEFVVCDKHRERANEIASMQLIGNVEGADVILVDDLIDTGGTITRAAEVIMNKGAKSVRAICTHPILSGSAYENIENSVLTEMLVTDTIPLRKETSKIKVLTVADLFAKAIYQIQQNESVSSLFL

SEQ ID NO: 12990 - protein, 103 aa, Cucumis sativus
VYTFYKAQGLAVGKSLVEEDKLDLATSLIEKAKAKGVSLLLPTDVVVADKFAADADSKVVAASSIPDGWMGLDIGPDSIKSFGEALDSTQTIIWNGPMGVFEF

SEQ ID NO: 12991 - protein, 291 aa, Cytophaga hutchinsonii ATCC 33406
MELNLFKPMLQAEAFKNKVVVVTGGGTGLGKSMAQMLLQLGANVVITSRKLEVLEAAAKELETLTGGSVLAVACDVRDYRQVEELLQKSVARFGRVDALLNNAAGNFVSPTENLSPKAFDVVVDIVLKGTYNCVLTFGKYWIDNQIPATVLSIVTTYATTGSGYVVPSACAKAGVIALTRSLAVEWAKYSIRFNAIAPGPFPTEGAWSRLFPGQIAELFEPGNRIPLKRFGKHEELANLSSYLLSEYSAYMTGEVVTIDGGEWLKGAGEFNGLDVVSKEEWAEIERSIRGK

SEQ ID NO: 12992 - protein, 236 aa, Vibrio campbellii AND4
MTSIQQNIEHITSQIRHDEQKYGRSPKSVKLLAVSKTKPDEAIVEAYQAGQEAFGENYVQEGVSKVQHFAKHYPDNRIEWHFIGPIQSNKSRPVAEHFDWVHTIDRAKIAQRLNDQRPNELKPLQVLIQVNTSGEESKSGVADAEIFELAELISRLPNLTLRGLMSIPANVPDYQSQLRAFKQLEKLKQKLAQQYSDVDTLSMGMSGDMGAAIEAGSTMVRIGTAIFGARDYNKQQ

SEQ ID NO: 12993 - protein, 153 aa, Archaeoglobus fulgidus DSM 4304
MYSDKVFDHFQNPRNVGKIEDADGVGTVGNPVCGDLMTIYIKVKDNRIEDIKFQTFGCAAAIATSSMATEMAKGKTIEEALKITRDAVAEALGGLPKQKMHCSNLAADALRRAIVDYFRKNGKIDKIKELGLEKELEKMEKGEMDDHGEYCEA

SEQ ID NO: 12994 - protein, 816 aa, Arabidopsis lyrata
MRGAVPNKHHSYIFFFLFFVIVLFPDFSISANTLSATESLTISSNKTIVSPGGVFELGFFRILGDSWYLGIWYKKISQRTYVWVANRDNPLSNPIGILKISNANLVILDNSDISVWTTNLTGAVRSPVVAELLDNGNFVLRDSKINESDEFLWQSFDFPTDTLLPQMKLGQDHKRGLNRFLTSWKSSFDPSSGSFMFKLETLGLPEFFGFTTFLEVYRSGPWDGLRFSGIPEMQQWDDIIYNFTENRDEVAYTFRVTEHNSYSRLTINTVGRLEGFMWEPTQQEWNMFWFMPKDTCDLYGICGPYAYCDMSTSPACNCIKGFQPLSQQEWASGDVTGRCRRKTQLTCGEDRFFKLMNMKLPATTAAVVDKRIGLKECEEKCKTHCNCTAYANSDVRNGGSGCIIWIGELRDIRIYAADGQDLYVRLAPAEFGERSNISGKIIGLIIGISLMLVLSFIMYCFWKKKHKRARATAAPIGYRDRIQESIITNGVVMSSGRRLLGEKEDLELPLTEFETVVMATDNFSDSDILGQGGFGIVYKGRLLDGQEIAVKRLSEMSSQGTNEFKNEVRLIARLQHINLVRLLSCCIYADEKILIYEYLENGSLDSHLFETTQSSNKLNWQTRFNIINGIARGLLYLHQDSRFKIIHRDMKASNVLLDKNMTPKISDFGMARIFERDETEANTRKVVGTYGYMSPEYAMEGIFSVKSDVFSFGVLVLEIVSGKRNRGFHNSGQDNNLLGYTWENWKEGKGLEIVDSIIVDSSSSMSLFRPHEVLRCIQIGLLCVQERAEDRPKMSSVVLMLGSEKGEIPQPKRPGY

SEQ ID NO: 12995 - protein, 392 aa, Archaeoglobus fulgidus DSM 4304
MVCSISEVVEMPYFDYASTKPVDERVVEAMLPYMTEHFGNPSSVHSYGFKAREVIEEARGKISELINGGGGDIVFTSGATESNNLALIGYAMRNARKGKHVLVSSIEHMSVINPAKYLQKQGFEVEFIPVDKYGTVDLEFIEEKIREDTILVSVQHANNEIGTIQPIKEISEIINGRAALHVDATASLGQIEVDVEKIGADMLTISSNDIYGPKGVGALWVRQGVRLQPIILGGGQEKGLRSGSENVPAIVGFGKAAEITAKEWGEEAGRLRRLRDRIIDNVLKIEESYLNGHPEKRLPNNVNVRFSYIEGESIVLSLDMAGIQASTGSACSSKTLQPSHVLMACGLKHEEAHGTLLLTLGRYNTDEDVDRLLEVLPGVIERLRSMSPLYRR

SEQ ID NO: 12996 - protein, 226 aa, Allium cepa
MEAVTKLDVEGTAFDSVIIPPGSSKTHFLGGAGVRGLEIGGKFIAFTAIGIYLETDSIPFLADKWKGKTGEELAGSLDFFRDICTGPFEKFTNVTMILPLTGEQYSEKVTENCVAYWKAIGIYTDAEASAVDKFKQAFKPESFPPGSSILFTHTPSGTLKIAFSKDGLVPKDEGVLIENKALTQAVLESIIGEHGVSPAAKLSIASRLSEIMNKVGNVEEKLPVLS

SEQ ID NO: 12997 - protein, 203 aa, Arabidopsis thaliana
  misc_feature (183)..(183): Xaa can be any naturally occurring amino acid
MRARLVVFPIKGKKWCFSRSVDPFAAQSPSGVTPTTVRGLWKKISSESKPINANAELLVDFISDKMNKAWVGLEKAPDGSIKNKIHGFGLKLLARVKPSEIFLKSISKEVTSVQVTYPPSLDPRLVRRRLRHIAMSGTILHKKYLVGSVTLLPLTSAFMVLPLPNIPFFWVLFRTYSHWRALXDESKNSNTKPEQKSQSPTCL

SEQ ID NO: 12998 - protein, 226 aa, Allium cepa
MEAVTKLDVEGTAFDSVIIPPGSSKTHFLGGAGVRGLEIGGKFIAFTAIGIYLETDSIPFLADKWKGKTGEELAGSLDFFRDICTGPFEKFTNVTMILPLTGEQYSEKVTENCVAYWKAIGIYTDAEASAVDKFKQAFKPESFPPGSSILFTHTPSGTLKIAFSKDGLVPKDEGVLIENKALTQAVLESIIGEYGVSPAAKLSIASRLSEIMNKVGNVEEKLPVLS

SEQ ID NO: 12999 - protein, 606 aa, Neisseria meningitidis MC58
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQNAISAPNLLNRFGSYELETGTTAVQWQQALNDLGYKTDVRELNSGVQAIIIEPSRLVGGADPRREGRVMGD

SEQ ID NO: 13000 - protein, 324 aa, Neisseria meningitidis MC58
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 13001 - protein, 228 aa, Brassica napus
MRQTIVNIFLRGREEGDRLGFLIGSMNSAEALIKSIQGLSASPGDLSALHGILKKAEDSLRNNWDVQLATLEELDPSIHSLGYLYLLEGLTRGSVSKGKTSGVLLLMARFINRCDAGQIRLASEKFVTLCKRFKDRVLELEDPLRGVAPLVSAVRKVQVSAKCLTALHPDCLQLCLEAKCYKSGFSILSDDILEVDQPRDFYLYCYYGGMICIGLKRFQKASELLYML

SEQ ID NO: 13002 - protein, 395 aa, Arabidopsis thaliana
FFFSSSIFSLSHSRSPSLSSSRFSSLSAAMSPALEKSRQGNGGCNDDSKSKVTVVGSGNWGSVAAKLIASNALKLPSFHDEVRMWVFEEVLPNGEKLNDVINKTNENVKYLPGIKLGRNVVADPDLENAVKDANMLVFVTPHQFMDGICKKLDGKITGDVEAISLVKGMEVKKEGPCMISSLISKQLGINCCVLMGANIANEIAVEKFSEATVGYRGSREIADTWVQLFSTPYFMVTPVHDVEGVELCGTLKNVVAIAAGFVDGLEMGNNTKAAIMRIGLREMKALSKLLFPSVKDSTFFESCGVADVITTCLGGRNRRVAEAFAKSRGKRSFDELEAEMLQGQKLQGVSTAREVYEVLKHCGWLEMFPLFSTVHQICTGRLQPEAIVQYRENKL

SEQ ID NO: 13003 - protein, 266 aa, Candidatus Protochlamydia amoebophila UWE25
MFDSYHPKFMKTLVMKFGGASVASPEHFARIADLIIERQCVFPRLVIVVSAMGQTTNELIKLAHQVHPNPPQREYDMLISAGERISMTLLAMILCRKGKDAVSFTGSQSGILTCSQHTSAHIIDVRPQRLIQTLEQGKIVIVAGFQGVSQDKEVTTLGRGGSDTSAVAIGVALKAEKIEFYKDVLGIYNKDPKMYSDAICYPTLNYQEALTIVNQGAKVLHARAIKLAEKNGMPLHVRSFISRHDQGTWITSVDCKKSINPVYEIS

SEQ ID NO: 13004 - protein, 369 aa, Debaryomyces hansenii
MTSTPFNIEKPFRVAIIGSGNWGTAVAKIVSENTAEKPEVFEKQVNMWVFEEEVDGQKLTEIINTKHENVKYLPEVKLPENLVANPDVVDTVKDADLLIFNIPHQFLPRVCKQLVGHVKPSARAISCLKGLEVGPEGCKLLSQSINDTLGVHCGVLSGANIANEVARERWSETTIAYNIPEDFRGKGRDIDEYVLKQLFHRTYFHVRVINDIIGASFAGALKNVVACAVGFVIGAGWGDNAKAAIMRIGIREIIHFASYYQKFGVKGPAPESTTFTEESAGVADLITTCSGGRNVKVARYMIENNVDAWEAEKIVLKGQSSQGILTAKEVHELLTNYNLSNEFPLFEATYRIIYENADVNEFPVILERD

SEQ ID NO: 13005 - protein, 385 aa, Haemophilus influenzae 86-028NP
MALELSDIRQQITQIDRSLLKLLSERHRLAFDVVRSKEISQKSLRDVEREQQLLQELVQFAENENYQLEAQYITSIFQKIIEDSVLTQQVYLQNKLNEQRNQNLHIAFLGKRGSYSNLAARNYAARYQKQFVELGCQSFDQVFEKVQTGEADFGVLPLENTTSGAINEVYDLLQHTDLSLVGELAYPIKHCVLVNDKTDLSQIDTLYSHPQVIQQCSQFIHSLDRVHIEYCESSSHAMQLVASLNKPNIAALGNEDGGKLYGLSVLKTNIANQENNITRFIVVAKDPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 13006 - protein, 160 aa, Brassica napus
METAICGRLALAPTTLFNSISGDKHSVSKGPCVNNRGVLMTMSTYAALGKGGGVLDKPIIEKTTPGRESEFDLRKSKKMAPPYRVILHNDNFNKREYVVQVLMKVIPGMTVDNAVNIMQEAHINGLAVVIVCAQADAEQHCMQLRGNGLLSSVEPDGGGC

SEQ ID NO: 13007 - protein, 220 aa, Agrobacterium tumefaciens str. C58
MMEIEARLEDVRQRIADVAEKSGRKAADVALVAVSKTFDAEAIQPVIDAGQRVFGENRVQEAQGKWPALKEKTSDIELHLIGPLQSNKAADAVALFDVVESIDREKIARALSEECARQGRSLRFYVQVNTGLEPQKAGIDPRETVAFVAFCRDELKLPVEGLMCIPPAEENPGPHFALLAKLAGQCGLEKLSMGMSGDFETAVEFGATSVRVGSAIFGSR

SEQ ID NO: 13008 - protein, 550 aa, Rubrobacter xylanophilus DSM 9941
MFSPGPHSTTQHRAKTPGAAVLESSFMQGERLGEESTAGKLAGLGRLREAAAHPSSEEAVRRQRERGKLTARERIELLLDPGTFVELDRYRVHRSHNFGMDARKPLGDGVITGYGEIDGRRVCVFSQDFTVFGGSLGEVFAQKICKVMDLALSTGCPIVGINDSGGARIQEGVLSLAGYAEIFHRNVRASGVVPQISVILGPCAGGAVYSPAITDFIFMVEGTSHMFITGPDVIRAVTGEEVSFEELGGAATHNARSGVAHFSAPDEESCLSDVRYLLSFLPENNLESPPYFEPADDPERMEEGLATLIPDSPQRPYDMREAIRMVVDGGEFFEVQEAWAQNLVVGFARLGGHAVGVVGNQPAVLAGTLDIDASVKGARFVRFCDAFNIPLLTFVDVPGFMPGTDQEWGGIIRHGAKLLYAFSEATVPKMTVITRKAYGGAYDVMNSKHIGADVNVAWPTGEIAVMGAPAAVNIIFRREIAEAEDPEAKRRELISSYEKQFNNPMVAAEMGYLDDIIDPRETRPYLIRALSMVESKRPERPPRKHGNIPL

SEQ ID NO: 13009 - protein, 129 aa, Oryza sativa
MGIHEHVEGIKAHWAKNFAFLDYFKKVYGRDKPLPKWTDADVDEFIASDPVYGPQLKAMRETRKFGLGGALRRRRRTFGGIRPSSTPRAPPRWASWATGFSGANWRPPSVRDSEGGRKHWVPRSIQKLN

SEQ ID NO: 13010 - protein, 238 aa, Kineococcus radiotolerans SRS30216
MNDRREELAAGLDAVRARLAAAARAAGRDPGTLTLVAVTKFFPASDVRLLAGLGVRDAGENRDQEASAKAAELADLPDLHWHFIGQVQTNKVRSVVRYAGSVHSVDRVRLADALGRAAAGAGRELGCFVQVDLAEALGLPADSGRGGAAGEEVLRVADAVAGADALRLRGLMAVAPLGVEPAAAFDALARTAQRVREHHPGALELSAGMSGDLEQAVAAGATHLRVGSAILGSRPPAR

SEQ ID NO: 13011 - protein, 488 aa, Salmonella typhimurium LT2
MKKINHWINGKNVAGNDYFQTTNPATGDVLAEVASGGEAEVNQAVAAAKEAFPKWANLPMKERARLMRRLGDLIDQHVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQVGALISQQHWEKVSGYIRLGIEEGATLLAGGAEKPTDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 13012 - protein, 634 aa, Cleome spinosa
MKTTRLMVVVMIRRFSVCFFGFLWLLGSASALLSPQGVNFEVRALMDIKASLNDPHGVLESWDRDAVDPCSWTMVTCSSENFVISLGTPSQSLSGTLSPSIGNLTNLQIVLLQNNNISGRLPTELGRLTKLQTLDLSDNFFHGEIPSSLGRLRSLQYLRLNNNSLSGAFPLSLANMTQLAFLDLSYNNLSGPVPSFAAKTFSIVGNPLICPTGAEPDCNGTTLMPMSMNLNETGALLYNESHKRNKMAIVFGSSVSSVSFIILVFGLFLWWRQRRHQRTFFDVKDGHHEEVSLGNLRRFSFRELQISTHNFSSKNLLGKGGYGNVYKGILADGTVVAVKRLKDGNALGGEIQFQTEVEMISLAVHRNLLRLFGFCITPAEKLLVYPYMSNGSVASRLKGKPVLDWSTRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELITGQRALEFSKAANQKGAMLEWVKKIHQDKKLEVLVDKDLKGNYDGIELEEMVKVALLCTQYLPGHRPKMSEVVRMLEGDGLAERWEASQRTESTSKCSSRPNELSSSDRYSDLTDDSTLLVQAMELSGPR

SEQ ID NO: 13013 - protein, 103 aa, Anabaena sp.
MSVYVGNLSYDVTEDSLNAVFAEYGSVKRVQLPTDRETGRMRGFGFVEMGSDAEETAAIEALDGAEWMGRDLKVNKAKPKEDRGSFGGGNRGGYGGGGGPNRY

SEQ ID NO: 13014 - protein, 490 aa, Physcomitrella patens subsp. patens
MWLWLLSLRRRPPGPMIWPWLGSMLEIAPQFDTMNDWYLNYFSADVKTFSFGMPGFPSCTKFVATVDPVIVEHILTNVYKYGKGDQLRDRLGDFLGRGIFLADGEDWRRHRKIASTEFSTRKLRGHSASVFRGEGVKLANCLKVAMAADQPVEIQDLFLRMTLDSICKVAFGVEIGSLSPDLPDVQFAKDFDNAQAHISKRVVRPMFKILRALDIGEEHHFRIATNSVHSFAMDVIAKRRKEIAAAHDAGEEYVSYMDDLLSKFMANLTQDENSYDDKELRDVIISFMLAGRDTTAVTLSWFTYEMCCHPEIADKIYEEGVAVIGKHTVVESAVEHLTHEALGQMHYLHAALSESLRLHPAVPRDGKCVLEEDVLPNGIKVKKGDFVQYVPYSMGRMPFLWGPDALEFKPERWLKDGVYQSVSPYIHSAFQAGPRICLGKDSAYLQLKVTAALITHFFKFHLVPGQEIAYTTTLVMPIKKGLKVTLSPRQ

SEQ ID NO: 13015 - protein, 393 aa, Cleome spinosa
MAASTTVIAWGSGEDGQLGLGTNDEKEWVCVVEALEPYAVRSVVSGSRNSLAICDDGTLFTWGWNQRGTLGHPPETKTENIPSQVKALANVKIVQAAIGGWHCLAVDDQGRAYAWGGNEYGQCGEEPGKDEMERPLRRDIVIPKRCAPKLVVRQVAAGGTHSVVLTREGHVWSWGQPWPPGDIKQISIPVRVQGLENVRLIAVGAFHNLALEENGTLWAWGNNEYGQLGTGDTQPRSQPIPVQGLDSLTLVDIAAGGWHSTALTDKGEVYGWGRGEHGRLGFGDNDKSSKMLPQKVNLLAGEDIIQVSCGGTHSVALTRDGRIFSFGRGDHGRLGCGRKVTTGQPLDVPVKIPPPEGQFNDAAEDDDGKWVAKVVACGGRHTLAIVEWKSAAI

SEQ ID NO: 13016 - protein, 713 aa, Cytophaga hutchinsonii ATCC 33406
MSNNTQETAGFNFAPQVSAAAQADIVELSTKIKGFRDNTIDSEKFRSFRLTRGVYGQRQEGVQMIRIKLPYGKVTTDQIIRIADISDKYGSSNLHLTTRQDIQLHYVKLENAPLVWNELEEVGVTLREACGNAVRNITASYTAGVDPNEPFDVSPYAHSMFEYFLRNPICQDMGRKFKISFSTSEADTAFGFIHDLGFIPRVKTVNGKEVRGFKVLLAGGLGAQPFVAHNVHEFLEEDQLIPFSTAVIRVFDRFGERSKRHKARLKYLVNGIGVEAFMEHVAKERIAIKDKSVVIDRNRVDEIILPAVTSFTEATPVDAVKFERFVKANVFEQKQKGYFGVQLKQHLGDLKSDKARVFAAIVKKYASDDVRITVNQGWLLKFVKKEALPALFNELNEIGLAEPGFDSMADITACPGTDTCNLGISSSTGLSVEIEKMLLEEFPDTVFNKNIKIKISGCMNACGQHTIGNIGFHGMSIKNGTNVLPAMQVMLGGGLEPDGTGTIADKILKLPTRRCVEAVREILTDYDTNATEGEYFNDYYRRQVAAEKMYFYKLLKPLSDLETLTELDYIDLGHDEKYVTEVGVGECAGVMIDLVGTLILDTEEKLKWSKRLQQNATPADAIYAAYATYVCGAKAILTGEGVACNTQIAMINDFDKHLVSTNKFSIAGGSFASQVLCMSEHEPTKEFADKYIADTEQFVQQIKTYRAAALVTV

SEQ ID NO: 13017 - protein, 317 aa, Oryza sativa
  misc_feature (62)..(62): Xaa can be any naturally occurring amino acid
MAAASSPAAAITCRAAVAWAPGQALVMEEVEVAPPEAMEIRVKVVSTSICRSDVTQWQSTAXMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 13018 - protein, 299 aa, Brassica napus
TFFVKSFGVFDLDGLLKASAEVLGKGAFGSSYKASFEHGLVVAVKRLRDVVVPEKEFKEKLQVLGSISHPNIVTFGRVGGRVGEKLVVFEYMSRGSLSALLHGNKGSGRSPLSWETRAGIALGAARAISYLHSRDATTSHGNIKSCNILLSESYEAKVSDYCLAPMISPTSTPNRIDGYRAPEVTDARRISQKADVYSFGVLILELLTGKSPTHQQLNEEGVDLPRWVSSITEQQSPSDVFDPELTRYQAEGNENMIRLLKIGISCTAQYPDSRPSMAEVTRLIEEVSRSSGSHSPLSG

SEQ ID NO: 13019 - protein, 488 aa, Kluyveromyces lactis NRRL Y-1140
MYLNDTGIRRCGPPRPRPRSTHPLLAQLESSACATAIKDYEKELLAYFQELQECDLPNPKMIDNQPELDWYMRPYLLDFLIDLHGILRLSEPVLFLAIQIMDRYCSKRIVFQKHYQLVTTTSLWIAAKFEDKKSRTPTLNQLISACSHIYDSYMFIQMESHILETLRWNIRTCFTTFDAIQLCFKDTDIIWPTEDVSMLQIVSIFFAELSCYDKHYMAFSSSVKATSGIILASVLLGDNCFQKHISTLLLDFLDLKCESLGLTVCHHSVVSSCKEKDPFSIICAPLLRVDENTHVDIRRCCLLYLNDIFKPLTANKDLPTALMSKYDKICLQDYITAYTSQNIDKYLHLCKLTQALLNPIYDRTRLLEQINMVTDIMVGLELCQQGPIRDELPLKIYQSVLLPSSDELKEEILKNNELHGSSRSASSTEITSPWTPASVFSAKRSLSDASSIDNELDLVDVPRAKDARALRLPTPLRKCVSSDFAPNI

SEQ ID NO: 13020 - protein, 422 aa, Mesoplasma florum L1
MFKVKFADIGEGLTEGKVAEVLVKLGQEIKEGDALFFVETDKVNSEIPAPVGGKIANILISQGQEIKVGDVVIEIDDGSSAAEVTPVAEIKTKNEPIEENASVVGSTPVSNDVIASRATTNAAAEISNSGVKATPLARKIAADKKIDLSTIKGTGPHGRILVSDLDSAPVAVPNTNSATKTVVKSVDVDAPLSWDSIPMNGIRKATVKAMVKSQSENAAFTGMKNINITPTYDMRAMLKDGCESKGIKLTYLAFIVKAAAKVLEEMPNINVRIDAENNAILQVHNINIGIAVDTEKGLMVPVIKGANHLTIFEIANKIGELAKKARDGKLAMTEMKDATFTVSNFGSVGLDYATPIINSPESAILGVGTMTKTPIFVKDEIKAGWIMPFSMTCDHRIIDGGDAGRFLMKIENYLSNPALLLM

SEQ ID NO: 13021 - protein, 602 aa, Mesoplasma florum L1
MFKVKFADIGEGLTEGKVAEVLVKLGQEIKEGDALFFVETDKVNSEIPAPVGGKIAKVLISEGQEIKVGDVVIEIDDGSATVEAAPAAEEENASVVGSTPVSNDLIPSRGPAPTQNVAAQPTPAPVATKHTDIEESFDVIVVGAGIGGYVSAIKTAQLGLKTLIIEKQYYGGVCLNVGCIPTKSLLRTAKVFEDIVHKAANLGIDMKTKDEPSINWNKALERKDGVVNKLTGGVKVLLTKNGVKQIIGEASALDKNTISVNGKKYHCDNLIIASGSVPNELPLPGFAEGRESGFLIDSTKILSLPKIPKTLTVIGGGVIGIEFGCLFAALGTKVTVIEGAPKILPMLDQDVTALMTKTLKEKYKIEIFTNAKVKEVKGKSVVFEIDGKEQTVKSDYCLESIGRKTVTKGFDGIGLELSERKSIIANDYGETNLEGVYAIGDVTSKIMLAHVASHAGIVTANRIALKANKPDAHDIKMDYSKIPSCIYSHPEIAMIGKTEQQLKEEGVEYKTFKFPFAAIGKALADDDTTGFVKIICEPKYKTLLGAHIIGNRATDMISEFTTLIECEGTITELARAIHPHPTMSEAIGEAAEALESGKSLNL

SEQ ID NO: 13022 - protein, 322 aa, Mesoplasma florum L1
MYSVEQIKKILVDSDHKKTIVLPEGEEPKIQEVANTLVKENISKVIMLFQKSESIPSSLDSKIEVIAIDKLDKQPLIEKFMDLRKDKTNLEQATKLMGQANYIGAMLVKMEKADCMLCGITYTTADTIRPALQIIKTSPNVALAASVFIMNKGEENYFFTDCALNLKPTSQQLADISKMTAKFAQSFDVKNPEVALLSYSTAGSGAGEDVVRVKEAVELLDSQTVDFNYAGEIQFDAAWDKEIRDKKFKDCKLTKQTPDVFVFPDINAGNIGYKIAQRMGGYEAIGPFILGFNKPVNDLSRGATLTDIMNTAIITIYQALEA

SEQ ID NO: 13023 - protein, 152 aa, Arabidopsis thaliana
MSSKMIVLMSSDGQSFEVEEAVAIQSQTIAHMVEDDCVADGIPLANVESKILVKVIEYCKKHHVDEANPISEEDLNNWDEKFMDLEQSTIFELILAANYLNIKSLLDLTCQTVADMIKGKTPEEIRSTFNIENDFTPEEEEAVRKENQWAFE

SEQ ID NO: 13024 - protein, 312 aa, Oryza sativa
KGVDVVAINDPFIDVTYMVYMFKYDSTHGRFKGDAHEEGGMLVVNGKKIQVFQESDPSNIPWAKAGAEYVVESTGVFTTLEKAEAHRKAGAKKVIISAPSPDAPMFVMGVNHEKYEPGMNIVSNASCTTNCLAPLAKVIHDNFTIVEGLMTTVHAATATQKTVDGPSKKDWRGGRGAAQNIIPSSTGAAKAVGKVIPELNGKLTGMAFRVPTPDVSVVDLTVRLGKDATYDQIKAAVKAAANSDQWKGVLGYTEDEVVSTDFLGDTHSSIFDAKAGISLSPTFVKLVAWYDNEYGYSNRVVALIKYMKTKDN

SEQ ID NO: 13025 - protein, 325 aa, Arabidopsis thaliana
MARSGVDETSESGAFVRTASTFRNFVSQDPDSQFPAESGRYHLYISYACPWACRCLSYLKIKGLDEAITFSSVHAIWGRTKETDDHRGWVFPDSDTELPGAEPDYLNGAKSVRELYEIASPNYEGKYTVPVLWDKKLKTVVNNESSEIIRMFNTEFNGIAKTPSLDLYPSHLRDVINETNGWVFNGINNGVYKCGFARKQEPYNEAVNQLYEAVDRCEEVLGKQRYICGNTFTEADIRLFVTLIRFDEVYAVHFKCNKRLLREYPNIFNYIKDIYQIHGMSSTVNMEHIKQHYYGSHPTINPFGIIPHGPNIDYSSPHDRDRFSS

SEQ ID NO: 13026 - protein, 298 aa, Neisseria meningitidis MC58
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 13027 - protein, 470 aa, Erwinia carotovora subsp. atroseptica SCRI1043
MEQHASGSEGQFKRTMKARHLVMLSLGGVIGTGLFFNTGYIISTTGAAGTLLAYLIGALVVYLVMLSLGELSVAMPETGAFHVYASRYLSPATGYTVAWLYWLTWTVALGSSLTAAGFCMQYWFPQVPVWTWCLLFCALIYLLNVVSSRFFAEGEFWFSIVKVVTILAFIVLGAGAMFGFIPMQDGSPAPFFQNITASGWLPHGGLPILMTMVAVNFAFSGTELIGIAAGETENPQKVVPMAIRTTVARLVIFFLGTVLVLAAIIPMEEAGIAKSPFVLVFEKIGIPYAADIFNFVILTAILSAANSGLYASGRMLWSLSNEGTLPRRFSRLTRRGIPLFAISVSMLGGLLALFSSVVAPDTVYVALSAISGFAVVAVWLSICASHYMFRRHHIRSGKSLSELQYRAPWFPITPILGFLLCLLACVGLVFDPSQRIALWCGIPFVALCYGAYYFTQSVKKRGLTGVEDIA

SEQ ID NO: 13028 - protein, 315 aa, Staphylococcus aureus subsp. aureus COL
MLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 13029 - protein, 483 aa, Erwinia carotovora subsp. atroseptica SCRI1043
MSFDSLGLSADILRAIEEQGYRDPTPVQRQAIPVVLEGRDLMASAQTGTGKTAGFTLPLLQLLTSREAQNKGKGRRPVRALILTPTRELAAQIDENVKAYSKYLPLRSLVVFGGVSINPQMMKLRGGVDILVATPGRLLDLEHQRAVDLSQIEILVLDEADRMLDMGFIHDIRRVLAKLPAKRQNLLFSATFSDEIKALANKLLTNPASVEVVRRNSPSELVTQNVHFVDKRRKRELLSQLIGENNWQQVLVFTRTKHGANHLAELLEKDGITAAAIHGNKSQGARTRALANFKDGGIRVLVATDIAARGLDIDQLPHVVNYELPNVPEDYVHRIGRTGRAEATGEALSLVCVDEHKLLRDIERLLKREIPRIAIEGYEPDPSIKAEPIVNGRQGSRGGGSGGARSASPRAPSGAPRGQSERSERSQGQGERRSADANRQPRKPSGNSDSPWGTGGKGNSGKGSGEGQRRAPRPQNRSKPADK

SEQ ID NO: 13030 - protein, 308 aa, Vibrio angustum S14
MSKRDFYEVLGVAKTASEKEIKKAYKKLAMKFHPDKNPDDPTAADKFKEVKAAYEILTDKEKRAAYDQFGHAAFDNPSMGGGHHGGGHHGGFQGGFQGGGYGDFEDIFGGAFGDMFSNARGGRGGFGSRHSTRPQKGEDLQYTMEIDLEDAINGASRVIDLPVFEGASQVNKKLNIKIPAGIEDGGRIRLSGKGHLGINGGPQGDVFIQMNIRPHPRYTREGNNLHCKATTDFVTAALGGKIEVNTLNGAISLKIPEGTQNGRKFRLKGKGVTDRKGNTGDLIVQLTIETPQNLSERQKELLTEFAAA

SEQ ID NO: 13031 - protein, 233 aa, Triticum aestivum
TSQWNQVAEHSEMIEQVDRDVKRTHPDIHFFCGDSSFAKSNQDSLRNILIIFAKLNAGIRYVQGMNEIFAPLFFVFRNDPDYKNANFAEADSFFCFVELLSGLRDNFCQKLDNSAVGIRGTLSKLSQLLKKYDGELQHHLEITTEVNPQFYAFRWITLLLTQEFNFADIIHIWDTLLSDPDGPQETLLRICCAMLILVRKRLLAGDFSSNLKLLQSYPPTNIGHLLYVANKLQ

SEQ ID NO: 13032 - protein, 292 aa, Zea mays
MDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHA

SEQ ID NO: 13033 - protein, 94 aa, Arabidopsis thaliana
  misc_feature (25)..(25): Xaa can be any naturally occurring amino acid
  misc_feature (60)..(60): Xaa can be any naturally occurring amino acid
  misc_feature (65)..(65): Xaa can be any naturally occurring amino acid
PLWLRHLLKYLPPQATMVAPFTGLXSSTSFPVTRKANNYITSITNNTGRLSCIKVWPPIXRRSFXTLSYLPDLSDLELPKEVDYLLLNKYIPCV

SEQ ID NO: 13034 - protein, 349 aa, Zea mays
  misc_feature (77)..(77): Xaa can be any naturally occurring amino acid
  misc_feature (93)..(93): Xaa can be any naturally occurring amino acid
  misc_feature (140)..(140): Xaa can be any naturally occurring amino acid
  misc_feature (207)..(207): Xaa can be any naturally occurring amino acid
  misc_feature (227)..(227): Xaa can be any naturally occurring amino acid
GGQLDDSSLLSTLPGNAKPGARRLPPTLSGTAAGCSSKSPSSVHQCRHCRPHRRRHRHAPAAVSSTPRTVLLLFVLXKAPGLSFATSAASSSXRRLPGDLRSFGCYASPQASSMVANLVEGVSYPFFYSLADMGTLPDHXHKNIARLLKAKRFRKPDISETIQELLGGKVGRGQLSGGLVVDVGANVGMASFVAAVMGFRVLAFDDXEPVFENLQRIFDGVYLNRTXKVSIKSNAEIAVEVSTIPLDELVPDTERVLLIKVDVQGWEYHVLGGASNLLSRRKGEAPYPYLIYEEDEHLLQAGNSSAQDIRTFLTSVGYNHCKRHGNGAHGLYMNCEESAEFWQFWPFVT

SEQ ID NO: 13035 - protein, 283 aa, Physcomitrella patens subsp. patens
SLPIEDVRDVKDQQAVEEFRRDLITRNLLPELHDDYHVLLRFIKARKYDVKKAAEMWKNMLAWRMEFGTDTIDEDFKFTEIDKVRNYYPQGYHGVDKEGRPVYIERIGKIHAQNLMEVTTLDRYLKYHVQEFEKLLNLKFPACSVAANRHIDTTTTILDVAGVGLKNFCKPARDLIVAIQKVDSENYPETLAQLFIVNAGPGFKMLWGTIKGFLDPHTAAKIHVIGNNYQKKLLEIVDESNLPDFLGGTCTCPAEGGCMQSDMGPWKDPDILKVNWHYAYLLL

SEQ ID NO: 13036 - protein, 498 aa, Triticum aestivum
MMDDPPPSLHRLLLPPLLLVLLVLVSVSCPLAHGSPATGGGLGAEEWTARTDAASVQLRNSHPRRLLQVGGGNHLPPQFLQPRHRHHRRTHSPAPSPAPFTAPSPSPSAFRPSLAPPQLAWPLPSTPQPSHDPQVGAPVNPLHKHSWRAYGLVSAGGAAFLVMAAVFAVYCRAKKVGTVRPWVTGLSGQLQRAFVTGVPSLKRSELEAACEDFSNIIGSTANCMLYKGTLSSGVEIAVVSSLISSRNDWSKECESQYRKKISSLSKVGHKNFINLLGYCEEENPFTRAMVFEYAPNGTLFEHLHVREAENLDWMARLRISMGIAYCLEQMHKLNPPVVPRSFDSTTIHLTDDFAAKVSDLDFWNGTKGSDSVADDCIMLDTESIVHQYGIILLEILTGRAPFPEQDLPLDQWASIYFEGKMPLAELIDSSLGSFPEETARALCDVARSCVDPDPSKRPRMAQVAAQMKEITAVGPEGATPKVSPLWWAELEIMSAEAT

SEQ ID NO: 13037 - protein, 391 aa, Pyrococcus horikoshii OT3
MREKRKYFIAERVLLIKRSKIRELFERASKMEDVISLGIGEPDFDTPKNIKEAAKRALDEGWTHYTPNAGIPELREAVVEYYKKFYGIDIEVENVIITAGAYEGTYLAFESLLERGDEVIIPDPAFVSYAEDAKVAEAKPVRIPLREENNFLPDPNELLEKISKNTRMIVINYPNNPTGATLDKELAKTIADIAEDYNIYILSDEPYEHFIYEDAKHYPMIKFAPENTILANSFSKTFAMTGWRLGFVVAPSQVIKEMTKLHAYVIGNVASFVQIAGIEALRSEESWKAVEEMKKEYNERRKIVVKRLKNMPGIKVKEPKGAFYVFPNISGTGMSSEKFSEWLLEKARVVVIPGTAFGRMGEGYVRISYATSKEKLIEAMNRIEKALEGEK

SEQ ID NO: 13038 - protein, 266 aa, Mesoplasma florum L1
MKRVLFIGLGHMGSSLVKGVLKNSNNKIEVFGYDVIKEVQDKAIKNIQGLRPLKDISEIELKKIDYIVIGTRPIDVEPLCKNMDQLNIDGKTIICMANAVTIEDVQNNFVKNKKVSVIRMMPNMNASIQKSVTALATKNASNETMKFVSEMFELCGIVENIDEDKFGTLTAISGCSPSYIISFFKAMTDYAIDKGFEKEQAFRIIEEAIIGSVMNASKSEVELRTMVDQICVPNGSTIEGQKILDNKNFEKIIQEALTAATKKATK

SEQ ID NO: 13039 - protein, 173 aa, Oryza sativa Japonica Group
MKTTGGGGSPKEAVVPSAASGDTTLGRHLAHRLVQVGVSNVFAMPGDLKLTLLDHLIAEPGLHIVGCCNELNAGYASDGYAWARGVGACIVTFTVRGQLLHGRRRRSHRFWNQVTGDEAGAAFRNQERAGAAPSLPSAVARRSGSVVVDGGSASPSSPPSPSSETTASWDRHG

SEQ ID NO: 13040 - protein, 486 aa, Cycloclasticus oligotrophus
MQHINHFINGEFVSAVDGKSFEKRSPVDRRLIAQVSEGGKVDVDRAVHAARAALNGEWGAFTMEQRVEILYGVADEITRRFDDFVEAEMADTGQPKSIMTHAFIPRGAANFKIFADVIKNVPNESFQTTTPDGLGALNYAIRVPKGVVGVVSPWNAPFLLMTWKVGPALACGNTVVVKPSEETPLTTTLLGEVMNKVGVPKGVFNVVHGFGPDSAGEYLTHHPKVDAITFTGETTTGAAIMKAASEGMRDVSFELGGKNAGIVFADSDFDKAVDGIYKSSFLNSGQVCLGTERVYVERPIFDKFVEALKKKVEKVRHGRPDDENCNFGPMISHEHQAKVLSYYAKAVEEGATVVTGGGVPSIPEELKEGAWVEPTIWTGLAEDATVMKEEIFGPCCHIAPFDDEQQVINWANDTEYGLSTTVWTRDLSRAHRVAAKINVGITWINSWFLRDLRTAFGGSKQSGIGREGGVHSLEFYTETRNVCVKL

SEQ ID NO: 13041 - protein, 134 aa, Candida glabrata CBS 138
MAGPKKVSSSKSSKDAQSGEVFNDFKEAINSSMKAYTTQVEGNNKLKLIDIFCVFLVLVGGIQFLFALLVRDSFPFNAFLAGFIMCVGQFVLLISLRLQILNQIEFPGISSNRAFAEFIIASLTLHFICLHFIN

SEQ ID NO: 13042 - protein, 158 aa, Cucumis sativus
VSEEDEESTYVEPSRRGRYSVVFDPLDGSSNIDCGVSIGTIFGIYLLKDSHEPNLEDVLQPGKNMVAAGYCLYGSSCTLVLSTGTGVNGFTLDPSLGEFILTHPDLKIPSKGKIYSVNEGNAKNWDGPTAKYVEKCKFPTDGSPPKSLRYVGSMVADV

SEQ ID NO: 13043 - protein, 216 aa, Bacillus pumilus SAFR-032
MVYIAPSILSADFANLEKDIRDVEQGGADYIHIDVMDGHFVPNMTFGPNVVEAIRPHTRLPLDVHLMIEQPDRYIPAFAKAGADIISVHVEACPHLHRTIQHIKEQGVKAGVVLNPHTPVSHIEHVLEDVDLVLFMTVNPGFGGQAFIPSVLKKVKEVKALSEQKGLTDLLIEIDGGVNVETAKSCKEAGANLLVAGSAVYGEDNRAVAIQAIREA

SEQ ID NO: 13044 - protein, 302 aa, Leptospira interrogans serovar Lai str. 56601
MQELDSVRIHFNESNLAFLNLLLGLIMYGIALELRFEDFKLLVDKPRSSITGILSQFILFPFATYLLLWILNPSPGIALGMLLVAACPGGNISNFVTLLAKGNTALSISLTAFSSALAIVITPFNFFFWGNLYPPVQNTLRTISLNPWDVLKAILMILIIPILLGLLTKKFLPKTTAKIVKPIRILSAIIFAAFLLIALFANFQIFLNVIYKVFLYVFLMNAVGFLLGYYFSKLMRLDERDSRCISIETGIQNSGLGLVLIFAFFEGQGSMAIIAATWGIWHAIAGVTLAWFWSKKTSTLKT

SEQ ID NO: 13045 - protein, 289 aa, Nocardioides sp. JS614
MLYPEAQRAVAAAADETPVWAEGYDVEDARARAREAAATEPREEVAEVRDVDADGVPCRLYRPAGAAPGVVLHVHGGGFVFNDIDVHDPGARRLANRSGLSVLSVDYRRPPEHRFPAAPDDVSTASAWAERELDGPLFAHGDSAGGNLALVAALRHPDRFAALVLIYPFLDPTAAFESYRTAADGFDRREAEWYWQQYAATPADLADPSLAPLLSERLGTLPPTLVVTAEHDPLRDEGEELARRLAEAGVEVTATRYLGQVHGFWRHPSVFTASEPLIRQAAGFLRQHG

SEQ ID NO: 13046 - protein, 512 aa, Mesoplasma florum L1
MSLILLENISHQNGGKKLYEESSMRINKGEHVALLGPNGAGKTTLLNIISQKIVPDHGLVEWHPKAKIGYLDQHQEVDMNITGEEYLKDAFKYLFDMEAQIHKIYEDMATEYKEEELVKALALQDELNIKGFDSIEKQIGNLVAGLGIEPDNIKRPLGSLSGGQRGKILLAKLLLKNDDFILLDEPTNFLDVEQVEWLVNFLQNYENAFLVVSHDRDFINRIVNIIYAIENLEIVRYVGNYDKYVELSALRAEQYDRAREAQQGQISKLKEYIAKNGARASTARSAQSRQKQLEKIDVMDARKENAKPNMHFKYRRPSSTVIVKADKLEIGYDFALTKPLTFELREGEKCIVKGYNGIGKTTFLKTIAGEIEKIDGEVEIGQGVFTNFFHQIDDFEEHETPVSYLLTRYPQMTPGEVRAKIGMFGIKSELMMNKMKELSGGEQTKVRLAALSLEPSSLLILDEPTNHIDVLAKESLLDAIKAFEGTVLITTHDINFETQWADKVLDFEDILD

SEQ ID NO: 13047 - protein, 322 aa, Ustilago maydis 521
MSKVTASGIISGNISTQRIKLNNGQEIPQVALGVYKAPNDGSTENACKWAFDAGYRHIDSAARYMNEESVGRALAEWTKENNVPRSEIFITSKLWDADHDKAAAAIEDSLKKLNVDYMDMYLMHSPGTMGAEKRLEAWKALEEAVDAGKIKTIGVSNFDVEELDHLLANCRIKPAVNQIESHPFFAHEELREACISRGIHIQAYSPMAQGQALDRPEIKTIASKHGKTPAQILLKWGLTHGNIILPKSLTKHRIESNAQLFDFELDSDDMDVLDNLDEGMKVGKLGPAGTSQPASPGGTRPGSRRSSGSGGLSGNKLQMSSS

SEQ ID NO: 13048 - protein, 286 aa, Bradyrhizobium sp. ORS278
MSKILKIAFQGEPGANSHIAISEAYPTAEAMPCPTFEDALSAISSGEADLGMIPIENSVAGRVADIHHLLPGSGLYIIGEWFLPIRHQLMALKGTRLADIKTVESHVQALGQCRRYIRNLGIRPIVAGDTAGSARDVSERGDRSVAAIASRLAAKIYGLDILAEDIEDEAHNTTRFVVLAREEQWAEQNSGPLVTSFVFRVRNLPAALYKALGGFATNGVNMTKLESYMVDGNFFATQFYADVDGHPEDKGLAFALEELKFFSRELRIVGVYPAHPFRATFSETRE

SEQ ID NO: 13049 - protein, 441 aa, Rubrobacter xylanophilus DSM 9941
MARPITMPQLGESVTEGTIARWLKAEGDEVEKDEPIAEVDTDKVSAELPSPLAGRIERLLVPEGATVEVGTEIALVATGEEPGPDGPAREDARSEGPTEEFPAAGTRAQPVAAGPGESRAAGRGEGDGRGARVPSAEELRLRRSSPVVRRLAAEHGVEISSIRGTGVGGRVTKKDIEAYIREREARPREEAPPRPAPPPPRERVEVHEGDEVVEVTSVRRAIAERMSRSKREAPHAWTLVEADVSGLVGLREARKEEFRRREGVNLTYLPFVVRAVVESLKEHPVLNSVWDGDRIVLRKRINIGIAVDLEEGALIVPVIKDADDYGIVGLARRIDEVVRRARQRRLSPDDVSGGTFTVNNPGALGSVVSTPIINHPQAAILSAEAIVKRPVVLEDDAIAVRSMMNLEVSFDHRILDGGAALRFLNAVKRRLESYTPESEIG

SEQ ID NO: 13050 - protein, 708 aa, Buchnera aphidicola str. APS (Acyrthosiphon pisum)
MSRIIMLIPLDKDIGLTSIGLSIIYFFYQKKIKKKSVQSILYFSCTQNSSNSTSHVINKYFSKIVHTVDYIDFSKVLFNSPEYSFLLNKVIDEHYNNKFLRELILIEGIKNNYCINSEEMNYDISQNLNAEVIFIANLENSSPEYIKNKEKKINFFLKQKKYKNILGVIFNQINSPFLENKYDFIKKLIVLKKIKNETKTIVPKKILKNNFFSIIACIPWNRNIVTTRVIDLFNFLNIQHTNLVQKKNHIIEEIIIFDTHHLNLLNKHSLNTLVIVSFSRVDVFLNVLNCNVNRSKVKCIILTGILKLKKNIASLYKFLIKRSISIFFTEKNTIEILSQLQNFNFDISVKDITYIKKLQRYISNFFCHSSFMFFKKKYNINVIYPPKEFCYNLKLLSQKKNKRIKLPESYEIRILKSVAICSDSNIAQCVLLGDPKKIYSIANDNGINLKKNIEIIDPISVRQEYLARFLEIRKGKNINEFSAKKQLEDNTVLATLILESNHVDGLVSGSINTTSDTIRPALQIIKTNPQSLLVSSIFFMLLPNQVLIYGDCAININPTAEELAVIAIQSADSAKMFGIEPRIAMLSYSTGCSGFGCQVEKVKEATSIIKNRRSDLIIDGPIQYDAAVSNKVAKLKAPSSPISGSANVFIFPDLNSGNIAYKAVQRSSRIVSIGPMLQGLRKPVNDLSRGASVEDIIYTIALTSIQSE

SEQ ID NO: 13051 - protein, 606 aa, Zea mays
  misc_feature (241)..(241): Xaa can be any naturally occurring amino acid
MPMSDSSLRVLTVLFVLAALVLDVEGRHHRHVCPHFSCDGLSNISYPFRRQGDPSGCGVQSYELVCTDTDATIRIGSGTYKVLSINSTYSYFWVIDANLDIQSSCPLPRWDYHARWINLNSHRLWIELSYYSFYSFYMDSGQWAIFVNCSQPIENNDTDKYHYEPVSCLSNSSFIYLATGYWYDDYVSAGDLEPSSGYLAKTPLGGPGMTVPSNTSYPDVVKFMRSGFALRFPFSYGDNIXNVSQTICIICRFVLMPLAVFVFLAYKYWKTRITIDAVEKFLRMHHMLVPMRYAYTNIIAITAHFRDKLGQGGYGTVYKGVLQPGEVHVAVKMLGNSNCNGEEFISEVATIGKIHHVNVVRLIGFCSEENIRALIYEFMPRGSLDKYIFSSEKTFSWDKLNEIALGIARGLNYLHHGCDMQIVHFDIKPHNILLDSNFVPKVADFGLAKLFPRDDSFVPLSAMRGTIGYIAPEMVSRSFGVISSKSDVYSFGMLLLEMTGGRRNADPHAGSSSQAYYPSLVYRQLSQGDANRISEGVDMHELEKKLCIIGLWCIQMKPQDRPTMSEVIEMLEAGVDGIQMPPRPYFCDEEGDSSYSTISELDTIEE

SEQ ID NO: 13052 - protein, 371 aa, Vitis vinifera
MALSSSKHWPFSPTQDSLNGSLRTTPVQLHLIRNPSPSQSRSPFPSLSLNASKAPSPQTQVTGPPLVVVGSANADIYVEIDRLPKEGETVSAKHGQTLAGGKGANQAACGGKLSYPTYFVGQVGEDAHGKLISEALKDGGVCLDHLSTVSAAPTGHAVVMLQSDGQNSIIIVGGANMSFWPDTLSDEDLKIVRNAGIVLLQREIPDFVNIQVAKAARDAGVPVILDAGGMDAPIPVELLNVVDILSPNESELARLTRMPTESFEQISQAVAKCHEMGVKEVLVKLGEKGSALFVKGEEPIRQPIIYAAKVLDTTGAGDTFTAAFAVAFVEGRSKKECLRFAAAAASLCVQVKGAIPSMPDRRSVLDLLQTC

SEQ ID NO: 13053 - protein, 230 aa, Streptococcus mutans UA159
MTKDLTIEEKSTFDDLVTDLDKAVQSLMVKRINSTYPQDHVFAEENDLVADINNGAVWVLDPIDGTINFVVQGCDFAVMIAYYENGIGQFGLIYDVMNDLLYNGGGQFEVKVNDKVLKPFQDRPFNRSLIGANNGMCAQNVMGIADFGRQTLGIRGIGSAGLSICRVLEGRLMAYFSNISPWDYAAGSVMGEKLGYVALDLYGQKPNYKTRQKIMFIPKMKLKEIQRYIK

SEQ ID NO: 13054 - protein, 97 aa, Guillardia theta
MATYKVKLSGEGVDKTIDCPDDQYILDAAEEQGIDLPYSCRAGACSTCAGKVAAGSVDQSDQSFLDDSQIGDGFVLTCVAYPTSDCTILTHQEEGLY

SEQ ID NO: 13055 - protein, 395 aa, Rhizobium leguminosarum bv. viciae 3841
MISEAERETILFSISKRSEVESFHAMDVLAEATKRRAAGHPVISMAVGQPSHAAPLGALEAARAALAEGRIGYTDALGTARLKSALAWHYKDRHGLEIDPKRIAITTGSSAGFNLAFLSLFDAGDAVAIARPGYPAYRNILGALGLKVLEVPVTAETHFTLTPQSLEAAQKESGITLKGVLLASPANPTGTVTDREGLKALSDYCAAHSIAFISDEIYHGLTFAGEEASALELTDEAIVINSFSKYYCMTGWRIGWMVLPERLVRPIERVAQSLYISPPELSQIAATAALSAGAELDRYKASYAANRDLLMRRLPQIGLSIASPMDGAFYAYLDVTRFTNDSMGFAKRMLAEIDVAATPGLDFDPLEGNRTLRLSYAGSEAEIAEAVERIAAWLK

SEQ ID NO: 13056 - protein, 477 aa, Cleome spinosa
MDINEIIGETASPVTLPTKSAIYVWGYNQSGQTGRNGKEKLLRIPKQLPPDLFGCPSGANSRWLDIACGREHTSAVASDGSLFTWGANEYGQLGDGTEVGRKRPKKVKHLQSEFVKSVSCGAFCTAAIAEPRENDGTLSMSRLWVWGQNQGSNLPRLFSGAFPAETAIRQVSCGTAHVVALSEEGLLQAWGYNEHGQLGRGVTSEGLQAPRLIAAYAKFLDEAPELVKIAQISCGEYHTAAVSEKGEVYTWGLGSMGQLGHISLQVGDKELIPRRVAGLDSLCVKEVSCGGVHTCALSSDGALYAWGGGQAGQLGLGPQSGFFSCILGGTEMLLRNVPALVIPIDVQLVACGHSHTLVYMKDGRIRGWGYNSYGQAANDKSSYAWFPSPVDWCVGQVRKLAAGGGHSAVLTDAFSLKELCEFQLAESVTVSNALKIQDVASRMGSEALARLCERLREQLLDAGHLDHEEDETCGGRL

SEQ ID NO: 13057 - protein, 409 aa, Rhizobium leguminosarum bv. viciae 3841
MGNEMEEFHKVRRLPPYVFEQVNRLKASARAGGADIIDLGMGNPDLPTPQSIVDKLCEVVQDPRTHRYSSSKGIPGLRRAQAAYYARRFGVKLNPDTQVVATLGSKEGFANMAQAITAPGDVILCPNPTYPIHAFGFLMAGGVIRSMSVEPDASFFEPLERAVRHSIPKPLALILNYPSNPTAFVATLDFYKDVIAFAKKHDIIVLSDLAYSEIYFDGAPPPSVLEVPGAMDVTVEFTSMSKTFSMPGWRMGFAVGNERLIAALTRVKSYLDYGAFTPIQVAATHALNGDGSDIAEVRNVYKRRRDVMVESFGKAGFDVPPPAATMFAWAKIPEKFRDLGSLEFSKLLVEKADVAVAPGIGFGEMGDDYVRLALVENEHRIRQAARNIKKFMSTADETMHNVISLNAHR

SEQ ID NO: 13058 - protein, 475 aa, Bordetella parapertussis 12822
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLERFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 13059 - protein, 474 aa, Pyrococcus horikoshii OT3
MPFLPFSYYPFSLEVILMEYPKIVVKPPGPRAKELIEREKKVLSTGIGVKLFPLVPKRGFGPFIEDVDGNVFIDFLAGAAAASTGYAHPKLVKAVKEQVELIQHSMIGYTHSERAIRVAEKLVEISPIENSKVIFGLSGSDAVDMAIKVSKFSTRRPWILAFIGAYHGQTLGATSVASFQVSQKRGYSPLMPNVFWIPYPNPFRNIWGINGYEEPDELINRVLDYLEYYVFSHVVPPDEVAALFAEPIQGDAGIVVPPENFFKELKKLLEEYGILLVMDEVQTGIGRTGKWFASEWFNVKPDMIIFGKGVASGMGLSGVIGRKEIMDITSGSALLTPAANPVISAAAEATLEIIEEENLLKNALEVGEFIMGRLKEIKERFEIIGDVRGKGLMIGVEIVKENGRPDPEMTGKICWRAFELGLILPSYGMFGNVIRITPPLVLTKEVAEKALEIIERAIKDTLTGKVERKVVTWH

SEQ ID NO: 13060 - protein, 97 aa, Zea mays
MAGRSFLIRSPKEEESNAAVREAVLLGAKNAAIAGTVVAVPTLVGCRVLPWAKANLNYTAQALIISAACIAGFFITADKTILRNARQNTIGKLDKST

SEQ ID NO: 13061 - protein, 297 aa, Vibrio campbellii AND4
GTEQKKLLGKNIALIFEKSSTRTRCAFEVAAFDQGAQVSYIGPSGSQIGHKESMKDTARVLGRMYDGIEYRGFGQSIVEELGAYSGVPVWNGLTDEFHPTQILADFLTMQEHGRGKQLHEMAFAYLGDARNNMGNSLMVGAAKMGMDIRLVAPKAFWPEETLVTTCQEIALQTGAKITLTENVEEGVKGCDFLYTDVWVSMGESDQAWDERVALMTPYQVNMTVIEQTGNPHVKFMHCLPAFHNDETSLGKEVAKKYDMKGLEVTEDVFESEYSIVFDEAENRMHTIKAVMVATLGN

SEQ ID NO: 13062 - protein, 122 aa, Vibrio campbellii AND4
MSITNEQILDAVAEMSVMQVVELIEAMEEKFGVTAAAAVVAGGAAGGEAAAEQTEFNVVLTAVGGNKVAVIKAVRGATGLGLKEAKALVDGAPAPLKEGVEKAEAEALKAQLEEAGASVEVK

SEQ ID NO: 13063 - protein, 887 aa, Ustilago maydis 521
MPSDRWQHRRNAEGERESASTSRTTNDDNRFSESSRSAHRSRYSPTSDRYDNSQLDFPNKQRRIDHSDTRRFGASARVYNNDRPGPSSPHRTESIRDTTKPPALTIRGVASTQVTSSSKMSRGDDDRPRRVRSRSLARSPDLFDRLAHPARPQDDTNGSSRYHTDSSRRSRLDNERAGTSDSSRRGPTKLAPRGRYDESGRRIDDASDTRDRNQASGVPTSPHRHDAGARRERERSSSPTDTDRPHYRAADVDQDSRLRDNRSSRNDRSRISRRSPSPTSAEAYRSRWNSSSDRYDRGDRRRSPPPQSDDRYAPEDSNRRERRWGLRAQVGDRDDDAATSRRRRTPSPSARSDVSNRSRRRDRDVEPLQLPARDRDEEQPSERGPRYRPARWRMDNYDSTDDSPRVRERDTSNGGQRQRSPDAHRARILPRSGRLDQGTAERGHILTRKSGVGATFDGKQPPTGPRQDFEPSQRSVRGGGWQTVRPGSRRKWDAPARDGEPAAGTRNGHESGAVDAEVDSTKSTRAALSVATIEPLRAEPGEAYESIHQVGEGTYGQVFKARAERTGALVALKKIRMDSEKDGFPVTAMREIRLLQALCHDNVVRLHEIMLSRTSVYMVFEYMEHDLNGILAHPQVSFSQAHLKSLAHQLFSGLDYLHRKAVLHRDLKGSNILLNNQGRLKLADFGLARFYAKRRAGDYTNRVVTLWYRPPELLFGATQYGSEVDMWGAGCIFVELFVKKPVFQSETELGQVHAITDILGPVTKKNWPEVDTLAWYEMVKPATEKEEDQERDYVKRAFARYLPASALEVASGLLTYNPRKRWSAKQAMSAVYFEEEPQAELPAGLLSSLQGEWHEYESRRAKKKSSASRGTDNAAVLITAGSTVQNQ

SEQ ID NO: 13064 - protein, 220 aa, Cytophaga hutchinsonii ATCC 33406
MNKSALHDIRTFLTPYNTTLIAVTKTHPVEVLQQAYSSGLRIFGENKVQELISKAEVLPKDIQWHLIGHLQSNKVKYIAPFIYMIHSVDSFKLLQEINKEAKKNKRVIACLLQVYIANEDTKFGLDTQELTNLLLHPELEQLENIQIQGLMGMATNTNDQEQVRKEFRYLKNLFKSLAETIEKKNVAWKEISMGMTSDYRLAVEEGSTMVRIGSAIFGNR

SEQ ID NO: 13065 - protein, 305 aa, Oryza sativa Japonica Group
MSFAVVSLCIAWLTIKKNIKYHLPLLNRWTPPTAAAAERHPPPPPVRLPRPCASSHDPVPPPTQPFAPALEAVGASGCATRGDEGERKGEKLGFRLESSRDSDRRRIRFFAVPVLNRKEFRGISPHRRARASRTSTASSRRTPPRKHWICIEDKFRAAGDYVSQKSSSVFGKKKVEPMVKDAAAPGKGGRLKMESSNAQPQDSAYSVPKNPSMTCCRKRTDGATFLEDLKDHIEEFIHASMDEHKTCFKHHPKGQMCKHSDTALLCSFCILDILMMKHFLCFMFRISDVWDVKGCRGAFGGCQGS

SEQ ID NO: 13066 - protein, 195 aa, Oryza sativa Indica Group
MSSPSKRREMDLMKLMMSDYKVEMVNDGMQEFFVEFRGPTESIYQGGVWKVRVELPDAYPYKSPSIGFVNKIYHPNVDEMSGSVCLDVINQTWSPMFGEITLVLVIISTDLVNVFEVFLPQLLLYPNPSDPLNGEAAALMMRDRPAYEQKVKEYCEKYAKPEDAGVTPEDKSSDEELSEDEDDSGDDAILGNPDP

SEQ ID NO: 13067 - protein, 317 aa, Xanthomonas campestris pv. vesicatoria str. 85-10
MPEPVAGPGEVIVAPRLVGLINRDLQILKGTYGGKLAPTRVPVAEGVGIVTSVGAGVGQVAPGDRVVSGHFPTWLEGRFDAEMFAHDLGVTHDGWLAEKVSLPASALIKVPASLEDEDVAALASAAVTAWNALVDVARIKAGDLVLCLGTGGVSMAALQLAKLHGARVAITSSSDDKLELARRLGADITVNYRTHPDWAEAVVQLSGGGVDVIIETGGQDTLGQSIKAAAANATIVVIGVTPGASSPIPDYVALIRKNVTIRGIANGSRAMFVDLLRAIEQHRIKTLHSKTFRFDEAPQALDYFAKAQHVGKVLIRL

SEQ ID NO: 13068 - protein, 540 aa, Nocardioides sp. JS614
MAATASAQPGEGADSPDLHTTAGKLADLDRRLEEAVHAGSAKAVEKQHAKGRKTARERIEMLFDEGSFVELDELARHRSTAFGLEKNRPYGDGVVTGYGTVDGRQVCVFSQDFTVFGGSLGEVYGEKITKVMDLAIKTGCPIIGINEGAGARIQEGVVSLGLYGEIFRRNVHASGVIPQISMIMGSCAGGHVYSPAVTDFTVMVDGTSNMFITGPDVIKTVTGEDVSMEDLGGARTHNTKSGNAHYMGSDEEDAIEYVKALLSYLPQNNLDEVPAFDEAAEPEFTDLDRSLDTIIPDSPNQPYDMHEVIAAALDDQEFLEVQELFAPNIIVGFGRVEGHSVGVVANQPMQFAGTLDIDASEKAARFVRFCDAFNIPVLTFVDVPGFLPGTDQEWNGIIRRGAKLIYAYAEATVPLVTIITRKAYGGAYDVMGSKHLGADINVAWPTAQIAVMGAQGAANIVYRKELKAIEAEGGDVESRRAEVIDEYETTLANPYIAAERGYVDAVIAPHETRLEIVRSLRLLRSKREILPAKKHGNIPL

SEQ ID NO: 13069 - protein, 219 aa, Mycoplasma pneumoniae M129
MTDQNQKANQGNGLQTTNLQAHAQRKHNLRPSSEGIKKAVSKKEGGGHNRNNQNRRFQKPAFKSEFEERIVKLKRISKTTKGGRNMRFSVLVVVGNRKGKIGYGIAKALEVPNAIKKAIKAAHNSLHTIEIHKGSIYHEVIGRSGASRVLLKPAPQGTGIIAGGAIRAIIELAGYSDIYTKNLGRNTPINMIHATMDGILKQLSPRRVAILRNKNLNEL

SEQ ID NO: 13070 - protein, 159 aa, Bacteroides fragilis NCTC 9343
MKIKVGFGFDVHQLVEGRELWLGGILLEHEKGLLGHSDADVLVHAICDALLGAANMRDIGYHFPDNAGEYKNIDSKILLKKTVELIATKGYQIGNIDATICAERPKLKAHIPSMQQVLAEVMGIDADDISIKATTTEKLGFTGREEGISAYATVLINRV

SEQ ID NO: 13071 - protein, 401 aa, Medicago truncatula
MRANETSSDGAWQGDNPMNHALPLLIIQTILVMFVSRTLAFFLKPLRQPRVVAEIIGGILLGPSGIGRNKTFMHTVFPSWSTPILESVASIGLLFYLFLVGLELDLRTINRSGKRAFNIAVAGISLPFLFAIGVTFLLQKVIHFNSETHKVSYFQLFIFLGVSLSITAFPVLARILAELKLLTTQVGETAMAAAAFNDVAAWVLLALAIALAGGGEHRNGVLTSILVLLSGVAFVVFMLFVIRPLMERISLRCSRENEVLDEMFICLTLAGVMLSGFMTDLIGIHSIFGAFVFGLTIPRGGEFASRVTKRIEDFVSNLMLPLYFASSGLKTDVGKLQGVVEWGILLLVIGMACVGKILGTFVVAVICTMPVRESLTLGVLMNTKGLVELIVLNIGKEKKPA

SEQ ID NO: 13072 - protein, 248 aa, Mycoplasma pneumoniae M129
MVYLKSAREVEQIRQACKIFQEAKAYFTIERLLGKSLTAIDQALKQFIESKGATCAFHKYQNFPGFNCLSLNETVIHGIADNRVFGVKDKLTLDIGINLNGYICDAAFTVLGPKAPEPMQTLLEVTEACFTAVVEPQLRPNNPTGNVSHAIQTYFESKGYYLLKQFGGHGCGIKVHEEPLILNYGKPDTGTKLEPGMVLCIEPMVMTDSDAMVMHNNSWNVLTPKSRYNCHVEQMYVITTSGFECLTN

SEQ ID NO: 13073 - protein, 259 aa, Vitis vinifera
MFLRFVFPPPPSLLVTAMSVVSFASMANAGLSELKGKHMEYSKFWELKSGRKYKVDSRTGMIVCYTPAFLAGVASFALFPDESFRFLLLTSALSIHFFKRIFEVLFVHKYSGGMALDAAIVISLSYFISTATMIYAQHLSRDFPEPLMDLKYPGMALFLVGILGNLYHHCQLSKLRSKGEREYKIPKGGLFNLVVCPHYLFEILGFIGFSFISQTVYAFALATGTALYLMGRSYSTRRWYVSKFENFPNNVKALIPYIL

SEQ ID NO: 13074 - protein, 508 aa, Populus trichocarpa
MASIDVLSNPLKFSALVLILSIFIVQLFLRKLNKKQKKYKYHPVAGTVFTQLLHFNRVHHYMTNLAGKYKTYRLRAPFRSEIYTVDPVNVEYILKTNFENYGKGDHNYDNLSGLLGDGIFTVDGHKWRQQRKVSSYEFSTKVLRDFSSVIFRKNVAKLANIVSEAAKSNQSMDIQDLFMKSTLDSIFKVGFGVELDSMCGSNEGGVKFTSAFDDASALTLWRYVDVFWKIKRFLNIGSEAALKKNVKVVNDFVYKLINKKIELMRNSKEVSSLKKDDILSRFLQVTENDPTYLRDIILNFVIAGKDTTATALSWFIYMLCKHPAVQNKIAQEVREATKVKENTDFAEFAASINEEALEKMNYLHAAISETLRLYPSVPVDGKICFSDDTLPDGFNVSKGDMVAYQPYAMGRMKFIWGDDAEEYKPERWLKDGVFQQESPFKFTAFQAGPRICLGKEFAYRQMKIFAAVLVASFTFKLADEKKPVNYRTMINLHVDGGLHVFALHRNST

SEQ ID NO: 13075 - protein, 446 aa, Rubrobacter xylanophilus DSM 9941
MDLQEAKNFLEKNNVRYVLAQFVNIHGVSKTKAVPVKHFENVVTEGAGFAAFAVGNLGLGPETPDYMAVGDLSTLTLVPWMPGYARIVCEGHMRGEPWHYDPRVILKKQTQRLKERGWTFYTGLEPEFFLLARDEENGLLRTADPTDVLEKPCYDYKGLARQRNFLETITEILGEVGIDVYQIDHEDANGQFEINFFHKDCVFSADDMIFFRMAAVEVARRSGMVCSFMPKPFADRTGNSMHIHHSIADEEDNNLFEDKNDPQGMGLSKLAYQFLGGIMAHAPALTVFNAPSVNSYKRLAVGSSRSGATWAPAHVSYGPDNRSALVRVPAGRLELRLTDSGANPYLATAALIAAGLDGIDRNLDPGEPCRDNLYALSSGDLQRRNIRQLPSTLNAACDALEADSVICEALGADFVEEFLETKRQEWDRYNRHVSEWEIDRYLEFWS

SEQ ID NO: 13076 - protein, 492 aa, Bordetella pertussis Tohama I
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSGVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREIEDSEFEIPADLVLLAMGFVSPVATVLDAFGVDRDARGNVRANTDDYRTNVDKVFAAGDMRRGQSLVVWAIREGRQCARSVDEYLMGASELPR

SEQ ID NO: 13077 - protein, 428 aa, Chlamydophila pneumoniae TW-183
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFAYEDSEE

SEQ ID NO: 13078 - protein, 160 aa, Arabidopsis thaliana
LEMGIHLEKSAYLALAGNFLRSNELSKVIDVVKEMVKSQHSLGVYHGAMLIHMLGFGRRPSLAAEALDLLPDDQKGLSAYTALMDVYISAGSPEKAMKILGEMREREIMPSLGTYDVLLSGLEKTSDFQRETSSLRKEQKSLVASTRFREIVHVEDKICM

SEQ ID NO: 13079 - protein, 149 aa, Physcomitrella patens subsp. patens
MADGREQAAPTSSAAAGAGDSAPLHSDAQLVDFLSSLLDYTPTIPDELAEHYLSRSGFQCPDIRVTRLVSIAAQKFVGEIASDALQYCKIRQTAAAKDKKGHVQAKEKRLVLNTEDLSQALREYGVNLQRQEYFADSIAAGTAKEKIGD

SEQ ID NO: 13080 - protein, 468 aa, Zea mays
MASYDKAFESYKKALTTAASVAASMMLVRSVVNELVPPELRDLVFSGFGYLRSRTSSDHTIIVEKKNDGFANNYVYCAVKTYLATRMNTDIQQRLRVSSMDEDDKMMVSMDEGDEMLDVYQGTEFKWCLVCKDNSNDSLNSSQNESHFFELTFNKKHKDKALRSYLPFILATAKAIKAQERTLMIHMTEYGNWSPIELHHPSTFDTLAMDKKLKQSIIDDLDRFMKRKDYYRKIGKAWKRGYLLYGPPGTGKSSLIAAMANHLRFDIYDLELTAVTSNSDLRRLLVNMDNRSILVIEDIDCTIELKQRQEAEGHDESDSTEQNKGEGKVTLSGLLNFVDGLWSTSGEERIIVFTTNYKERLDPALLRPGRMDMHIHMGYCTPESFQILANNYHSIEYHDTYPEIEKLIKEVTVTPAEVAEVLMRNDDTDVVLHDLVDFLKSKIKDANEIKTEHKEADNQLDEKKNDKK

SEQ ID NO: 13081 - protein, 338 aa, Streptococcus pneumoniae TIGR4
MEKQTVAVLGPGSWGTALSQVLNDNGHEVRIWGNLPEQINEINTHHTNKHYFKDVVLDENIIAYTDLAETLKDVDAILFVVPTKVTRLVAQQVAQTLDHKVIIMHASKGLEPDSHKRLSTILEEEIPEHLRSDIVVVSGPSHAEETIVRDLTLITAASKDLQTAQYVQKLFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGESLADIEANMGMVIEGISTTRAAYELAQELGVYMPITQAIYQVIYHGTNIKDAIYDIMNNEFKAENEWS

SEQ ID NO: 13082 - protein, 299 aa, Streptococcus pneumoniae TIGR4
MTSKVRKAVIPAAGLGTRFLPATKALAKEMLPIVDKPTIQFIVEEALKSGIEDILVVTGKSKRSIEDHFDSNFELEYNLKEKGKTDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQRVFAREFKGARYDVGDKFGFMKTSIDYALKHPQVKDDLKNYLIQLGKELTEKE

SEQ ID NO: 13083 - protein, 95 aa, Dunaliella salina
SYMVTLKTPSGEQKVEVSPDSYILDAAEEAGVDLPYSCRAGSCSSCAGKVESGTVDQSDQSFLDDDQMDSGFVLTCVAYATSDCTIVTHQEENLY

SEQ ID NO: 13084 - protein, 218 aa, Triticum monococcum
MTMIYAMVARGTMVVAEHTAYTGNFRDIAAQCLHKLPAGDSRFTYTCDGHAFTFLLHQGYAYCVVATESAGREVPLAFLERIKEEFNKRYAGGKAATATANSLTKDFGPRLKDQMQYCMDHPEEVSRLSKVQAQVSEVKGIMMENIDKVIDRGEQIEGLVTRTEQLHDHALDFRTEGTRIRRRMWYQNMKIKLIVAGIVVAIILIIVLSICHRDHCKS

SEQ ID NO: 13085 - protein, 424 aa, Bdellovibrio bacteriovorus HD100
MEHKIEPLYDGPLFRNAIQTLDEAAKIINCDPNILERLKRPRRCITVSVPVRMDDHSVKVFTGYRVQYSPTLGPYKGGIRYHQNVDLSEVVGLAALMTFKNSVLGLPLGGAKGGITVDPTKLSRTEKQNLTRRYASEIGPFVGPTKDIPAPDVGTDPQTMAWFMDTYSQEQGGFAQPGVVTGKPVEIGGSLGRNHATGLGVVYVAEKAFEVCNMSMKGASIAIQGFGNVGSFAAKFAHERGARIVAVSDVSGGIFNGDGLDINEVNEYIKAHKFLKGYPKAQPISNEELLEVKCDALFPCALENQIDTHNAEKIQAKIIVEGANGPITNAATKILHKRGVFIAPDVIANGGGVIVSYFEWVQDTMSYFWDEDEVNGRLKGIITKAFDKGYSLAKEKNIDMRSAAMAVSVQRLERAMLLRGLYPR

SEQ ID NO: 13086 - protein, 95 aa, Equisetum arvense
AYKTVLKTPSGEFTLDVPEGTTILDAAEEAGYDLPFSCRAGACSSCLGKVVSGSVDESEGSFLDDGQMEEGFVLTCIAIPESDLVIETHKEEELF

SEQ ID NO: 13087 - protein, 230 aa, Arabidopsis lyrata subsp. petraea
LCLTETEMIKELLTKHNPVTGKSWLQQQGTKGFIGRGLLMANGEAWHHQRHMAAPAFTRDRLKGYAKHMVECTKMMTERLRMEVAEEVEIGEEMRRLTADIISRTEFGSSCDKGKELFSLLTVLQRLCAQATRHLCFPGSRFLPSKYNREIKSLKTEVERLLMEIIESRRDSVEIGRSSSYGDDLLGLLLNQMDRNKNNLNVQMIMDECKTFFFTGHETTSLLLTWTLML

SEQ ID NO: 13088 - protein, 95 aa, Equisetum telmateia
AYKTVLKTPSGEFTLDVPEGTTILDAAEEAGYDLPFSCRAGACSSCLGKVVSGSVDQSEGSFLDDGQMEEGFVLTCIAIPESDLVIETHKEEELF

SEQ ID NO: 13089 - protein, 425 aa, Triticum monococcum
MKPIVVHAAAVDRRWLLPLAVGSALSLFLLVLLTTVPFPFFPSSSPSPALFVEHKLAPTPPASRAAGSLPRIAYVISGSAKDASALRRVLLALYHPRNLYVLHLDAEAPESDRRDLAAGLAAHPVIAAAGNVRVVERANLVTYRGPTMVASTLHAAAALLWGHSGAGGSDWDWFINLSASDYPLVTQDDLIHVFSKLPRDLNFIDHTSNIGWKEFQRAKPVIIDPGLYMKKKADVFWIPQRRSVPTAFKLFTGSAWMALSRSLVEYSIWGWDNLPRTVLMYYSNFISSPEGYFHTVVCNAEEFKNTTVNHDLHYISWDNPPKQHPHYLTMDDLDRMIASDAPFARKFHADEPVLDRIDAELLSRHAGPDAPTPGGWCAGTGDNGSDPCSVVGNTSFLQPGRGAVRLQRLVTSLLSDEKFHPRQCK

SEQ ID NO: 13090 - protein, 230 aa, Arabidopsis lyrata subsp. petraea
LCLTETEMIKELLTKHNPVTGKSWLQQQGTKGFIGRGLLMANGEAWHHQRHMAAPAFTRDRLKGYAKHMVECTKMMAERLRMEVGEEVEIGEEMRRLTADIISRTEFGSSCDKGKELFSLLTVLQRLCAQATRHLCFPGSRFLPSKYNREIKSLKTEVERLLMEIIESRRDSVEIDRSSSYGDDLLGLLLNQMDRNKNNLNVQMIMDECKTFFFTGHETTSLLLTWTLML

SEQ ID NO: 13091 - protein, 77 aa, Bacillus pumilus SAFR-032
MADVLERVTKIIVDRLGVDEADVKMEASFKEDLGADSLDVVELVMELEDEFDMEISDEDAEKIATVGDAVNYINSQQ

SEQ ID NO: 13092 - protein, 160 aa, Vibrio campbellii AND4
MFEFPQFSKHSVKNDVLSGLTVALALVPEAVAFAFVAGVDPMVGLYAAFIVGLITSIFGGRPGMISGATGAMAVVMVSLVATHGVQYLFAAIMLAGILQIAAGLFKLGKFIRIVPHPVMIGFVNGLAIVIFLAQLGQFKAPDINGILTWLPQDQMLLMLG

SEQ ID NO: 13093 - protein, 620 aa, Archaeoglobus fulgidus DSM 4304
MISVKILIYGVGNMGKLFRDIFYGKGYYVRGYDIDQMKRDTNSISGFDVIFVCTPMYALEEALEHIKREAKKEALLVDVSSVKKVSVPLFEESGFDFLSIHPMLGGDSEISLSNVIVVRESGREEEKVILEELRKCGAVLSRLDVEEHDRKMAEIQGIAHFALVSMADFLRYGKEELKYASPIFTVLYKLASRIINQNWEMYFQIQKNAEDVREEYLRRAMELHEKMKDRESFREIFESLRKIYTDYESSTIILESYKATKKAESIEELRGLIKSIDSLILRLIERRIDAARQIARIKMERGEPIELKDVEEEKLWEVMSKTTLNPVKLKEIFEGIMSLAKEEEYKVAGVKYTIAVLGPQGSFSEEMALKLVGSRVPLRYCSTTDEIIKLVESGEVDYGLVPIENSVNGTVLPVIDALLNHDVEVFGEAKLEVNHCLVAKRKIELKEIKTIYSHPQAVAQCMGFINNYLPSVAIRYTTSTSDAARMLDDYSAAIMSENAARFYRLHVLRKGIQDLKGRNITRFYLIRRRSGRSEGKITSLFFGVEDKPGALKDVLEVFHKKGFNLRKLESRPAGTGLGDYVFFVEVEAPLREEDLLDLKQVTTFYKVVGVFDEVKRMSTL

SEQ ID NO: 13094 - protein, 502 aa, Ustilago maydis 521
MPASNAPAFDNDTIIVVLGASGDLAKKKTFPALFNLFRLGLLPQATHIIGYARTKMERDAFAEKVTSHLKNVDDDQGKKDIHNFLEICQYISGQYDEDASFQNLNKEMERIEAEMKHDSPSRLFYMALPPNVFTVVAKGLKKNCYSQKGHNRIVIEKPFGKDLESSREMIGALKGLWKEDETFRIDHYLGKEMVKNLLIMRFGNPFIDAGLNNKLVDNVQITFKEPFGTEGRGGYFDEFGIIRDIQQNHLSQVLSLLAMERPKSFSAEDIRDEKVKVLKSVPAIEPKDVLIGQYTAANGKPGYKDDETVPKDSNCPTFAALALFVNNERWKGVPFILKAGKALDEAKVVIRIQFKDTPEGLFNDVPRNELVIRIQPDEAVYFKMNAKKPGLEMATLPADLDLTYKERFSQVRIPEAYEALILDALNGDHSNFVRDDELEVSWAIFTPLLHAIDAGKIKNEPYEYGSRGPASLNEFTERYGYKRTNESYEWPTTNVNKVQGKM

SEQ ID NO: 13095 - protein, 169 aa, Triticum aestivum
GLGPTSHAPRHGRGISVVAAEVLNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 13096 - protein, 516 aa, Oryza sativa Japonica Group
MAHRLLLPTNPLWPPGHRDRHPAAAPRRRHRPRGARDVGGGGEGGDGGGGGAVDPGEADRGQPREPHRGGRPRRRGRAAAPLRGAQRRIHGDLRGARAPRRGRGGVRREGRAQRRPQHQRGHRAQARRRRRQVSRGYGTKPRNQSDVDAIMLDIDGTPNKSKLGANAILGVSLSVCRAGAGAKEVPLYKHIQELAGTKELVMPVPAFNVINGGSHAGNNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPKRIAEAIGKKACNALLLKVNQIGTVTESIQAALDSKAAGWGVMVSHRSGETEDNFIADLAVGLASGQIKTGAPCRSERLAKYNQIVTCVYTSIEMILVGINLSRDSKANPTNEVKVDKQMPTKYHFRLQTTL

SEQ ID NO: 13097 - protein, 493 aa, Triticum aestivum
  misc_feature (229)..(229): Xaa can be any naturally occurring amino acid
  misc_feature (302)..(302): Xaa can be any naturally occurring amino acid
  misc_feature (434)..(434): Xaa can be any naturally occurring amino acid
MDLLADAQPQWLLAGAALLLATVAFLRVLLGSGGGGKRPPPTIPGAPVVGGLLRFLRGPIPLIRAEYARLGPVFTVPILTRRITFLIGPDVSAHFFKSNESDMSQQEVYRFNVPTFGPGVVFDVDYQVRQEQFRFFTEALRANKLRSYVDQMVAEAEEYFSKWGESGTVDLKYELEHLIILTASRCLLGREVREKLFDDVSALFHDLDNGMQPISVIFPYLPIPAHRRXRDQARTRLAEIFATIIKSRKASGQSEEDMLQCFIDSKYKNGRQTTESEVTGLLIAALFAGQHTSSITSTWTGXAYLLKFQQYFAEAVEEQKEVMKRHGDKIDHDILAEMDVLYRCIKEALRLHPPLIMLLRQSHSDFSVTTREGKEFDIPKGHIVATSPAFANRLPHIFKNPDSYDPDRFAAGREEDKVAGAFSYISFGGGRHGXCLGEPFAYLQIKAIWTHLLRNFEFELVSPFPENDWNAMVVGIKGEVMVNYKRRKLIVDN

SEQ ID NO: 13098 - protein, 381 aa, Triticum aestivum
  misc_feature (282)..(282): Xaa can be any naturally occurring amino acid
  misc_feature (306)..(306): Xaa can be any naturally occurring amino acid
LHRTSLYKKAGSVPVRNSRDTVDPPVRVATALYLSLKTRYNEEIHLKVEMFLKTYGTSKPTRYTFSEVKKMARRFKEKVGQGGFGTVYKGELPNGVPVAVKMLEKSTGGGGEFINEVATIGRIHHANIVQLLGFCSEGTRRALIYEFMPNDSLERYIFSNDSNIYRQLLVPRKMLDLSLGIARGMEYLHQGCNQRILHFDIKPHNILLDYNFNPKISDFGLAKLCARDQSIVTLTAARGTMGYIAPELYSRNFGGVSYKSDVYSFGMLAVEMVSGRENSDPXVGSQGDVYLPEWIYEKMNPGQNLXLSWESGPGRKKKVQTLALGGTWVFPGEPKKMTLNDKSGNIFSWRVGNLKIPPHPGPYLKKKKKKKKKKPQGKKRK

SEQ ID NO: 13099 - protein, 917 aa, Bacillus thuringiensis serovar konkukian str. 97-27
MKKTTSTLLSVALVFSSFGALSAHAESLQKEKQFSPQLKTTIEQWGESKIAQHVETKTTKEISVIVELQHAPLAAQSNIQHAPDLQNSHAQSYHTELKKAQEETTKKIKEKAPGAKIKEVYNTLFSGFSISVPGDQITALASLPEVKTVYPNLTYKLHETTKSATSEEAPNIGGPTIGAPEAWNLKDPSGNSLDGKGMKVAIIDSGVDYTHPDLKANYIGGYDTVDEDDDPMDGNVHGTHVAGIIAGNGKIKGVAPNASILAYRVMNDGGTGTTDDIIQGIERAIQDGADVLNLSLGQDLNVPDQPVTLTLERAAKLGVTAVVSNGNDGPKPWSVDAPGNASSVISVGASTVSIPFPTFQVAGSSKTYQGLPLSKSDFPIGNDSPLVYVGYGNPSDYAKQDVKGKFALVLQGTSSTLVKAEQAKQAGAIGVLFISTEKEMNIMPEYFTRENLALPVMQLSNVNGEELKNLITKRKKNIKIGQPVPTELIGNFSSRGPSQGSWLIKPDIVAPGVQITSTVPRGGYESHNGTSMAAPQVAGAVALLRQMHPDWTTEQLKASLANTAKTLKDVNENTYPIMTQGSGLINIPKAAQTDVLVKPNNVSFGLIKPNSGKVKLTQNITLQNLSSKKKSFSTRVELLDTNTKTKVKTSVPSSISIQPNSSTEKPFTITVDSSLPQGVYTGNVYVKEQGAKEETRIPFTFSIDPKDYKRIDGLEIINSTFSPNGDQILDDNLINYYLVAPVDDVTLHANLVTKERVTYQGIIHQAKNETAGYKPFKWDGTKADGTPLADGLYQIEAVASNSGGETKQTAAVFLDRTAPKLTYEIDQENLVITGKVDDILLDWMTESGWVAPGIPVRLQYEINGNGVWESAFLNPWEKNYGIYLDRTQLQEGKNTIHIVATDAAGNTSNLNVDLDVK

SEQ ID NO: 13100 - protein, 434 aa, Erwinia carotovora subsp. atroseptica SCRI1043
MSPEDITFDQRHIWHPYTSMTKPLPCYPVIAASGVELQLDDGRRLIDGMSSWWAAIHGYNHPAINQAVQSQLSQMSHVMFGGITHPAAVALCRQLVNITPDALECVFLADSGSVAVEVAMKMALQYCQARGETRQRFLTLRHGYHGDTFGAMSVCDPQNSMHSLYQGYLPTHLFVDAPPCAAINESGFTDEWQETNIAPLQAMLSAHAHEVAAVILEPIVQGAGGMRFYHPTYLRRVRELCDQWGILLIADEIATGFGRTGKLFACEHAGISPDIMCLGKALTGGYMTLSATLTTRTVAETISNGAAGCFMHGPTFMGNPLACAAANASLSLLADNRWQQQVQNIERQLREALQPCADSPLVANVRVLGAIGVVETHRPVNMARLQRFFVERGVWIRPFGRLIYLMPPFIIQPDELRKLTDAVCAAIHNAQLFE

SEQ ID NO: 13101 - protein, 565 aa, Erwinia carotovora subsp. atroseptica SCRI1043
MELEYESKRPLYIPYAGPILLEFPLLNKGSAFTEEERADFNLAGLLPEAVETIEEQAERAWRQYQEFKHDIEKHVYLRNIQDTNETLFYRLLDGHLNEMMPIIYTPTVGEACEHFSDIYRRARGLFISYPNRANIDDMLQNATKQNVKVIVVTDGERILGLGDQGIGGMGIPIGKLALYTACGGISPAYTLPVVLDVGTNNPQRLNDPLYMGWRHPRITDDEYYAFVDEFIQAVKRRWPNVLLQFEDFAQKNATPLLNRYRDEICSFNDDIQGTAAVAIGSLIAASRAAGTQLRDQTVAFLGAGSAGCGIAEQIIAQMKSEGLSEEEARARVFMVDRFGLLTDKLPNLLDFQSKLVQKSELLADWDCNSDAISLLEVVRNAKPTIMIGVSGQPGLFTEEIIREMYKHCARPIVMPLSNPTSRVEARPEDIIRWTEGSALVATGSPFSPVHYQDKVFPIAQCNNSYIFPGIGLGVLASGANRITDGMLMAASRALADCSPLANNGEGALLPDLSDIQQVSKRIALDVGKAAQLQGVAVVTSADALQKAIDHNFWQPQYRSYKRTSF

SEQ ID NO: 13102 - protein, 454 aa, Nocardia farcinica IFM 10152
MPSPLAISTLFFLQLVVILLAYRLLWPVLRRLGQVQVVAIMIAGFLLGPSLLGAAWPELQQRLFPTEVVLDGVTVPHPNATAIQVVGQLGLVLYMFLVGASFDRAILGGHLRQAGLTSATGVLVPMVLGGSVGWWLVGAGGYFTDAVSPWQGALFLAAAVAVTAFPILAWIVHDSGLTGTRLGTMALACAAVDDLCAWLLLAVVVATAQDSAGGAYLALAGGALYLAVMATAGRRLLTRLETWTPRRGDHETTGGLPVAPVVAVLLVVLAAAAFTDFVGIHSVLGAFVAGVVMPRGELLAGLRRAFEPLVAYLLLPAFFIHTGLSTELSLIFTPNVLAVTALVLVVSFASKFGAVGLVARAQGMGWREAGAMGALANARGLMELVLLGIGLSSGLITPALYTVLALMTTVTTVLATPLQRLFERGAWKRGMVFGPNGEQPPVREPADTAPSATT

SEQ ID NO: 13103 - protein, 232 aa, Streptococcus pneumoniae TIGR4
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGSVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 13104 - protein, 149 aa, Pisum sativum
MATTPALYGTAVSTSFLRTQPMPMSVTTTKAFSNGFLGLKTSLKRGDLAVAMASYKVKLVTPDGTQEFECPSDVYILDHAEEVGIDLPYSCRAGSCSSCAGKVVGGEVDQSDGSFLDDEQIEAGFVLTCVAYPTSDVVIETHKEEDLTA

SEQ ID NO: 13105 - protein, 96 aa, Phytolacca americana
ATYKVTLVTPSGTQTIDCPDDTYVLDAAEEAGLDLPYSCRAGSCSSCTGKVTAGTVDQEDQSFLDDDQIEAGFVLTCVAFPKGDVTIETHKEEDIV

SEQ ID NO: 13106 - protein, 96 aa, Phytolacca acinosa
ATYKVTLVTPSGTQTIDCPDDTYVLDAAEEAGLDLPYSCRAGSCSSCAGKVTAGTVDQEDQSFLDDDQIEAGFVLTCVAYPKGDVTIETHKEEDIA

SEQ ID NO: 13107 - protein, 183 aa, Glycine max
MSSPSKRREMDLMKLMMSDYKVEMINDGMQEFYVHFHGPNESPYHGGVWKVRVELPDAYPYKSPSIGFINKIYHPNVDEMSGSVCLDVINQTWSPMFDLVNVFEVFLPQLLLYPNPSDPLNGEAAALMMRDRATYEQRVKEYCEKYAKPEDIGAATEENSSDEELTEDEYDSSDEQVAGKADP

SEQ ID NO: 13108 - protein, 506 aa, Legionella pneumophila str. Paris
MDQVFDVAIIGGGINGCGCAADAALRGLSVILFEQDDLASKTSSSSTKLIHGGLRYLEHYEFGLVKKALQERQTLLNLAPHLVHSQSFVLPYLKHMRPSWLLRLGLFFYDHLSRKNHLPKSRSIHRNNKNNYFTPLKEELNRGFLFYDATTDDARLTILNAIQAKNHGASIRPHAKVTHAEVINNIWHLTIQPTKGQSYKAYAKSIINATGPWVQSIAQLTHTPIQKDITLVKGSHIIVPKLFEGNHAYFLQHNDQRVIFVIPYHGFSMIGTTDIHYTGDLNHIEIGEEEIDYLIELVNAYFKFKITKEDVVHSWSGIRPLLADDSKEVKSLSRDYSYEFNHYPAPIITIFGGKITTYRQLAEEVVDQLTPVFPQMKPSKTQHTPLPGATLADMSFTQYVNYAKTKYHWLDDELLNRYLNTYGCYTEIFLSQCNNIEAMGKKYGPSLYQVEVDYLILEEWANYCDDILNRRTKLGLTMDNVSKKELADYLSSISTYPSAQAELVFH

SEQ ID NO: 13109 - protein, 147 aa, Spinacia oleracea
MAATTTTMMGMATTFVPKPQAPPMMAALPSNTGRSLFGLKTGSRGGRMTMAAYKVTLVTPTGNVEFQCPDDVYILDAAEEEGIDLPYSCRAGSCSSCAGKLKTGSLNQDDQSFLDDDQIDEGWVLTCAAYPVSDVTIETHKEEELTA

SEQ ID NO: 13110 - protein, 171 aa, Arabidopsis thaliana
MGGSSDIQVSHQFERPPFPQTLEELELEYTRDALELEKKRDKEEDEENNKHRETIRELRESYMKKLAGLRGMNAKQWDDFLQLDAQRRQQQARQQNSGLSYGNYRQFPPYAEFDDGYSSNPPPYGGNNMPMDSKGRYPNHGDNYSSRHQDNNYGGFQRQRREEYGKAYNRY

SEQ ID NO: 13111 - protein, 267 aa, Arabidopsis thaliana
MEACLRCSRGSYLIEAMRPLSSSLRPSSSVSFSTGKPIKRAYDGLLLDAGGTLLQLSKPVHETYASLGQKYGLKTTPAEIKEGFKRVFSAPWPEKLRYQVHGDGRPFWKLVVSEATGCSDNDYFEDVYQYYANGEAWHLPEGAYETMSLLKDAGVKMAVVSNFDTRLRKLLKDLNVIDMFDAVIVSAEVGYEKPDERIFKSALGIGILHSKLNAEQISVDVNRAVHVGDDEGADKGGANAIGIACWLWGEDVQTFSDIQKRILVSEL

SEQ ID NO: 13112 - protein, 347 aa, Mesoplasma florum L1
MLSKKENVHIFGLTQGVELAQEICDILGVKRKEVKTLKFADGEILIESLDSVRGKEIFVIQSTSTPVNESIMELLIAIDAFKRGSAEKINVVIPYYGYARQDRKAKGRQPITSKLVADLLTKAGADRVMSIDIHSPQSMGFFDVPMDNFYTAQTLATEIIDTIELNNWDPSNCILVSPDYGGMTRVHKVESYTGGVTNGIAVIGKRRPEPNKAEVEFVLGDIKDKHCFIIDDMIDTGGTIINAAKALKEQGAKDVHIFACHGLFNGPAKERMEAAIKEKIVEEVVVTNTIQIADEKKFNGLKIISVAPLLAEMIDSSISHESLTEVYNNKKQIIWDRAQCIVNKFKK

SEQ ID NO: 13113 - protein, 314 aa, Triticum aestivum
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSGRSHSRSSRSPSPYRHHARDRDRSSRSRDRGDYYGGSLDRGDYGDYYHHSRRSSERNRNYDSDGSRCRRHRSRTRSPVREGSEERRAKIEQWNREREAPARQGSEERRAKIDQWNRERETAQA

SEQ ID NO: 13114 - protein, 364 aa, Triticum aestivum
ILYLRLGVSGGEEGARNGPSLMPGGDFQAYSNIKDILEKAAAQTEVGPCVTFVGPGGAGNFVKMVHNGIEYGDMQLIAEAYDVLHRVGGLSNSEIADVFAEWNKGELESFLVEITADIFTVADPLEGSTSGALVDKILDKTGMKGTGKWTVQQAAELAVAAPTIAASLDGRYLSGLKDERVAAASVLEEEGMPVGLLEKINVDKKVLVDRVRQALYSSKVCSYAQGMNLLRAKSVEQGWNLNLAELSRIWKGGCIIRARFLDRIKKAYDRNPELANLIVDREFAREMVQRQGAWRWVVARAVEAGISTPGMSASLSYFDTYRCNRLPANLIQAQRDLFGAHTYERIDRPGSFHTEWTKLAREGK

SEQ ID NO: 13115 - protein, 630 aa, Zea mays
MPPQFPTARLLLPSHRLLPLLSPLPSASLSPAPRTLRLPPPQLLHRVARRRPLLRGMASAAAPGSHAAAEAPPVDVGGGGAGAPRRLVLEELPWDHSFVRELPGDPRSDTIPREVLHACYSRVSPSAKVDNPKLVAWSDSVADLLDLDHKEFERPDFPQFFSGATPLVGSLPYAQCYGGHQFGVWAGQLGDGRAIALGEVVNSRGERWELQLKGCGKTPYSRFADGLAVLRSSIREFLCSEAMHGLGIPTTRALCLVETGKSVVRDMFYDGNAKEEPGAIVCRVAPSFLRFGSYQIHASRGKEDIEIVRRLADYTIHHHFPHLENMKKSEGLSFETAIGDSPTIDLTSNKYAAWAVEVAERTAYLIARWQGVGFTHGVLNTDNMSVLGLTIDYGPFGFLDAFDPSYTPNTTDLPGKRYCFANQPDVGLWNIAQFTGPLSSAELISQDEANYVMERYGTKFMDEYQSIMTKKLGLTKYNKQLISKLLSNMAVDKVDYTNFFRLLSNVNADPGIPENELLVPLKAALLDIGKERKEAWISWVQTYIEELVESGVPDEERKAAMNSVNPKYILRNYLCQSAIDVAEQGDYEEVRRVLRVMQNPYDEQPGMEKYARLPPAWAYRPGVCMLSCSS

SEQ ID NO: 13116 - protein, 386 aa, Bacillus pumilus SAFR-032
MNIHEYQGKEILRKYGVSVPNGKVAFTPDEAVKASEELESSVYVVKAQIHAGGRGKAGGVKIAKTKDEVKGFAEELLGKTLVTHQTGPEGREIKRLLIEEGCDIQKEYYVGLVLDRATSRIVLMASEEGGTEIEEVAEKTPEKIVKVVIDPAIGLQGYQAREVAFKINIPTKLVGQAVKFMTSLYNAFIEKDCSIAEINPLVVTGDGKVMALDAKLNFDSNALYRQKDILEYRDLDEEDPKEIEASKYDLSYISLDGNIGCMVNGAGLAMSTMDIIKHYGGDPANFLDVGGGATAEKVTEAFKIILSDQNVKGIFVNIFGGIMKCDVIAEGVVEATKQVGLTLPLVVRLEGTNVELGKKILSDSGLNITSAESMADGAEKIVSLVK

SEQ ID NO: 13117 - protein, 220 aa, Bacillus cereus E33L
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIIDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 13118 - protein, 341 aa, Xanthomonas campestris pv. vesicatoria str. 85-10
MSDWTHKIAVLGAGSWGTALAALLARHGHPTVLWGRDAAMVDTIDRTHENARYLPGIALPDSLRATTDLQAAVADATWILVVVPSHAFTETIRLIAPLRPAGAGVAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLDDAIREIGQVVESVQTADEVMRQAEHHGIELPISNAVRAVLHGEITPEAGLKELLARERKPEYPQTLFT

SEQ ID NO: 13119 - protein, 473 aa, Bradyrhizobium sp. ORS278
MTSFQDFNLADALTRALKEENYTTPTPIQAQTIPLALQGRDVIGIAQTGTGKTASFALPILHRLLENRIKPQPKTARVLVLSPTRELSGQILDSFNTYGRHIRLSSTLAIGGVPMGRQVRAVMPGVDVLVATPGRLLDLVQGNALKLSHVEFLVLDEADRMLDMGFINDIRKIVAKLPIKRQTLFFSATMPKDIAELADSMLRDPARVAVTPVSSTVERIAQRVIQVDHSAKPSLLAQLLKNEPVNRALVFTRTKHGADKVVKGLEKAGIPAQAIHGNKSQNHRERTLAAFRTGEIRTLVATDIAARGIDVDGVSHVVNFDLPNVPETYVHRIGRTARAGADGVAISLVAGADEMSYLRDIERLTKTTLPREDRRTPGQRDAAPAGQHQRQNGHGGGRPGMQNARSNEGGNAAKGPRRRRRSNAKMPPLPGNRQEPQRPPQGGGKAGSIQGVAFLHREGRPKNHAHNRNQRPN

SEQ ID NO: 13120 - protein, 465 aa, Nocardioides sp. JS614
MTSQRVVIIGGGPGGYEAAHVAAQLGAEVTIVDTDGVGGSAVLTDCVPSKTLIATAEVMSDLADAAELGVTFADAEGDVATSIRVDLATVNARVKRLAAAQSADIGRRLDRDGVTVLRGRGSLVGPDRVLARLADGTEQVLEADAILLATGAAPRTLPTAQPDGERILTWEQVYDLTEVPTELIVVGSGVTGAEFASAYLNLGIPVTLVSSRDHVLPGEDADAAKVLEDVLTRRGMTVLARSRMESVSRDGDRVTVTLTDGRTVEGSHCILALGSVPNTAGLGLEEAGVVLDDGGFVNVDRVSRTSARGIYAAGDCTGVLMLASVAAMQGRIAMWHFLGDAVQPLDLKTVSSNVFTAPEIATVGWSQRAMEEGEILAEVVMLPMSGNPRAKMQGVRDGFVKLLCRPGTRTIVGGVVVGPRASELIHPVAIAVAESLTADQLAQAFTVYPSMSGSIAEAARRLHRA

SEQ ID NO: 13121 - protein, 206 aa, Bacillus sp. SG-1
MIEGGNKMNLIPTVIEQTNRGERAYDIYSRLLKDRVIMLGSGIDDNVANSIVAQLLFLESENPEKDISIYINSPGGSITAGMAIYDTIQYIKPDVQTICIGMAASMGAFLLAAGAKGKRLALPNAEVMIHQPLGGAQGQATEIEIAAKRILFLREKLNQILSDRTGQPLEVISKDTDRDNFMTAERALEYGLIDRIITSNEMNENK

SEQ ID NO: 13122 - protein, 184 aa, Salmonella enterica subsp. arizonae serovar 62:z4,z23:--
MSDTLRPYKDLFPEIGQRVMIDTSSVVIGDVRLADDVGIWPLVVIRGDVNYVAIGARTNIQDGSVLHVTHKSPSNPHGNPLIIGEDVTVGHKVMLHGCTIGNRVLVGMGSIVLDGAIIEDDVMIGAGSLVPQHKRLESGYLYLGSPVKQIRPLSDAERLGLQYSANNYVKWKDEYLSQDNHIQP

SEQ ID NO: 13123 - protein, 227 aa, Bifidobacterium breve
MASEEAKFAARADRLAGRQGVAGFMPAAAPTNRYIMPQFVEKTPYGMKTQDAYSRLFEDRIIFLGVQVDDASADDVMAQLLVLESQDPNRDVMMYINSPGGSMTAMTAIYDTMQYIKPDVQTVCLGQAASAAAILLASGTKGKRLMLPNARVLIHQPAIDQGFGKATEIEIQAKEMLRMREWLEETLANHTGQDVEKIRRDIEVDTFLTADEAKDYGIVDEVLAHRQ

SEQ ID NO: 13124 - protein, 603 aa, Oryza sativa
  misc_feature (115)..(115): Xaa can be any naturally occurring amino acid
MGLQTVVTLPNRRRRRRKLAMPLATLLGHLAAGRFGRVQALTGAATAAAAHRLLHLLLRTAPPPPLPDLVSLARWSRAHFRAPLPLRLHGLLLARLASKGLYPLLRSELHVLAAXARLHFPASILRALPSPSASASASTPLIADMLVLRPRPGHPSPLRAYDAFLLAGEKPPGGTAPSTSSVNALFRRASLAPKRGRTSPKKGFKSALRRRVSPDIYTFNTVISGLCRIGQLRKAGDVAKDIKAWGLAPSVATYNSLIDGYCKKGGAGNMYHVDMLLKEMVEAGISPTAVTFGVLINGYCKNSNTAAAVRVFEEMKQQGIAASVVTYNSLISGLCSEGKVEEGVKLMEEMEDLGLSPNEITFGCVLKGFCKKGMMADANDWIDGMTERNVEPDVVIYTILIDGYRRLGKMEDAMAVKEAMAKKGISPNVTTYNCLITGFSRSGDWRSASGLLDEMKEKGIEADVVTYNVLIGALCCKGEVRKAVKLLDEMSEVGLEPNHLTYNTIIQGFCDKGNIKSAYEIRTRMEKCRKRANVVTYNVFIKYFCQIGKMDEANDLLNEMLDKCLVPNGITYETIKEGMMEKGYTPDIRGCTVSQASENPASS

SEQ ID NO: 13125 - protein, 473 aa, Erwinia carotovora subsp. atroseptica SCRI1043
MSSESSTKKKIVAVIIPLLLGLIIWFSPIPDGLTPQAWHMFAIFAATIAAILTQPLPSGAIMLLVLCITIFTGTLTEAKALAGFSSGTVWLIFCAYILSLGFVTSGLGKRIAYKMLSLFGGSSLGIAYSLGVSDLIMAPAMPSVTARSGGIIFPIARSINEVLGSTPGVSGKKIGDFLIMVCFQFTPITGAIFLTGMAANPLVGSLAKTSLGVDITWGGWFIAAVVPAMCCFCLMPLLVYKILNPELKKTPEAKEMGRRSLAELGNMKSAEKKVAFGFVLALLGWGTSLITGFSATSVGLALVAYLFVTQAVQWKDVLSDRAAWDTVIWFSAIISLAAGLSDLGFIKWMTVKLGNSIQGFGAMETFVILGILYIYVHYLFATASGHVAALYAPFAATAIAAGAPPMMVAICFGIFSNLMWGNTEYGGGPGPIYFAQGYFERHRFYKINFCIVTFNVALIFIVGLVWWKLIGYY

SEQ ID NO: 13126 - protein, 174 aa, Pseudomonas aeruginosa
MKYRLGDARVEAHPDSWIAPSAAVIGKVRLDAGASVWFGAVLRGDNELIHIGEHSNVQDGSVMHTDMGYPLTLGKGVTVGHNAMLHGCSVGDYSLVGINAVILNGAKIGKYCIIGANALIPEGKEIPDGSLVMGSPGKVVRELSEPQKKMLEASAAHYVHNARRYARDLVEDPA

SEQ ID NO: 13127 - protein, 147 aa, Brassica napus
MAGQGEEDVPRDAKIVKSLLKSMGVEDYEPRVVHQFLEIWYRYVVDVLTDAQVYSEHATKSTIDCDDLKLAIQSKVNFSFPQPPPREVLLELATSRNKIPLPKLIAGLGVPLPPEQDTLLSPNYQLVIPKKSASIEPEETEEDDEDV

SEQ ID NO: 13128 - protein, 518 aa, Rigidoporus microporus
MFRFNTFSTLIPLALSLGVRAAIGPVADLHISNANISPDGFTRAAVLAGGSFPGPLITGNKGDNFQINVINDLTDADQLKTTTIHWHGFFQHGTNWADGPAFINQCPIASGNSFLYNFQVPDQAGTFWYHSHLSTQYCDGLRGAFVVYDPDDPHASLYDVGDESTVIALADWYHGLARLGPKFPTTNSTLINGLGRYDFGPSSDLAVISVQAGKRYRFRLVSISCDSNYVFSIDEHTFTVIEVDGVNHQPVDADSLQIFAGQRYSIVVNADKSEGGNYWIRASPTPGPQGFANGINSAILRYVGSDEVEPTTNQTTSTNPLVEANLVPLENPGAPGDPTPGGVDVPLNLAVAFDGTGLDFQVNGQTFIPPTVPVLLQILSGAQSATDLLPSGSVYVLPSNATVEISIPAGAVGGPHPIHLHGHTFDVVRSAGSSTYNYVNPPRRDVVSIGNAGDNVTIRFRTDNPGPWFLHCHIDWHLEAGFAVVFAEDIPNVASVNSPPQAWSDLCPIYDALDPSDH

SEQ ID NO: 13129 - protein, 463 aa, Neptuniibacter caesariensis
MTFQANEFDAKEVVNNDRDYVWHHLAQHENFKTNDPMVIVKGEGMRVWDAKGNEYLDAVSGAVWTVNVGYGRTEIAEAVKDQLVTMNYFAQTAGNVPAAEYAEKLLEKMPCMSRVYYSNSGSEANEKAFKMVRQIAELKYGGKKSKILYRERDYHGTTITCLSATGQFERRNQYGPFTPGFVEVPHCCEYRAQEGADLENYGVWAANQIEKVILEEGADTVGAICLEPITAGGGVIEPPQGYWERVQEICQQYDVLLHIDEVVCGLGRTGKWFGYQHYGIQPDIVTMAKGVASGYAAISCTVTTEAVFELLNDAEAGRMGYFRDISTFGGCTAGPAAALANMAIIERENLLDNVNEQGEYLRGRLNQLMEKHSLIGSVRGKGLFAGFELVKDRQTKEPVDESVSLAIAAHCMTNGVIIGRTNRSFKTLNNCICLSPALIARREDIDRIVDALDDALESVTSDS

SEQ ID NO: 13130 - protein, 97 aa, Cyanidium caldarium
MYKIQLVNQKEGVDVTINCPGDQYILDAAEEQGVDLPYSCRAGACSTCAGKLVKGSVDQSDQSFLDEEQINNGFILTCVAYPTSDCVIQTHQEEALY

SEQ ID NO: 13131 - protein, 95 aa, Dunaliella salina
AYKVTLKTPSGDQTIEVSPDAYILDAAEEAGLDLPYSCRAGACSSCAGKVEAGTIDQSDQSFLDDDQQGRGFVLTCVAYATSDCTISTHQEESLY

SEQ ID NO: 13132 - protein, 93 aa, Equisetum arvense
AYKVTLKTPDGDITFDVEPGERLIDIGSEKADLPLSCQAGACSTCLGKIVSGTVDQSEGSFLDDEQIEQGYVLTCIAIPESDVVIETHKEDEL

SEQ ID NO: 13133 - protein, 93 aa, Equisetum telmateia
AYKVTLKTPDGDITFDVEPGERLIDIASEKADLPLSCQAGACSTCLGKIVSGTVDQSEGSFLDDEQIEQGYVLTCIAIPESDVVIETHKEDEL

SEQ ID NO: 13134 - protein, 221 aa, Oryza sativa Japonica Group
MAAAAPATTSSAAARPSSSSSSSRQSDAPLRAATVSFPYSPRPAALAAGARASRVSPVVVAAGGGHQRLMGSLTNTQGLRFGVVVARFNEIVTNLLLQGALETFERYSVKKENITVVSVPGSFEIPVAAQKLGKSGKFDAILCIGAVIRGDTTHYDAVANSAASGVLSAGLSAEIPCIFGVLTCDDMDQALNRAGGKAGNKGAEAALTAIEMASLFQHHLA

SEQ ID NO: 13135 - protein, 464 aa, Nocardioides sp. JS614
MTHFNVLVLGAGPGGYVAAIRAAQLGQTVAVIEEKYWGGVCLNVGCIPSKALLRNAEIAHIITKEKDTFGISGEATMDFGATHKRSRGVAEASAKGVHYLMKKNKITELDGWGTIKSPREVEVDKDGQKQTYTCDNLIIATGARVRMLPGMSVSQNVVTYEEQILTDQLPKSIIIGGSGAIGVEFAYVLTNFGVDVTIVEFLDRMVPTEDADVSKELLKQYKKLGVKVLLSTKVDQVEDTGSGVRVTVSPAAGGDAQVLEADKMLAAFGFAPRIEGYGLENAGVEVSDRGAIEVDARGRTSVENVYAIGDVTGKLMLAHTAEAMGVVAAETIAGAETHEIDFDMIPRATFCQPQIASFGYSEAQAKEKGYDVKVATFPFSANGKARGMAEGVGFVKIVADATYNEIVGAHMIGPEVTELLPALTLAQQWDLTADEVARNVFAHPTLSEAMKEAVEGIAGHMINL

SEQ ID NO: 13136 - protein, 369 aa, Capsicum annuum
MRSMNLVDLWAQQACLVFNQTLSYKSFNGFMKIPLKNSKINPKLNKKRPFSPLTVSAIATTKEDERIEAAQTEEPFNFKIYVTEKAISVNKALDEAIIVKEPHVIHEAMRYSLLAGGKRVRPMLCLAACELVGGNQENAMAAACAVEMIHTMSLIHDDLPCMDNDDLRRGKPTNHKIYGEDVAVLAGDSLLAFAFEHIVNSTAGVTPSRIVGAVAELAKSIGTEGLVAGQVADIKCTGNASVSLETLEFIHVHKTAALLESSVVLGAILGGGTNVEVEKLRRFARCIGLLFQVVDDILDVTKSSEELGKTAGKDLVVDKTTYPKLLGLEKAKEFAAELNREAKQQLEGFDSRKAAPLIALADYIAYRDN

SEQ ID NO: 13137 - protein, 303 aa, Archaeoglobus fulgidus DSM 4304
MDVEKFVENAIKEIRERVKDGKAIIALSGGVDSSVCTVLAHKALGDRLIPVFVDTGLMREGEPEKIKEIFGNMGLVFIDAKEEFFKALKGVTDPEEKRKVIGELFVRIFERVAEEHNAEYLIQGTIYPDIIESQGGIKSHHNVGGFPTSYKFKDVIEPLRELYKDEVREVARYLGLPKEISERMPFPGPGLAVRIVGEVTPEKVEIVRKANKIVEEELADYDKWQCFAALIGKATGVKGDVRVWGYIIAVRAVESRDGMTADPIKIDYDRLRRIALRITGEIDKVSRVVYDITPKPPATIEYE

SEQ ID NO: 13138 - protein, 270 aa, Burkholderia vietnamiensis G4
MKIAFIGGGNMAAALIGGLVKRGVAADGLYAIDVNEDVRARAAQQFGIRTGAAVDATLADYDAIVLAVKPQVLKEVAQALAPHLKSQLVISIAAGIRGADLARWLGGYTRVVRTMPNTPALVGMGVTGLAALPGVDATGRELASSVLGAVGEIVWFADEVQLDAVTAISGSGPAYVFYFIEALQEAARRLGLNDEQGRALAVATFAGAAQLAAQSGEPASVLRERVTSKGGTTAAALASFDAQQVKEAIVRGALAAHARAQEMGDELGRA

SEQ ID NO: 13139 - protein, 232 aa, Burkholderia vietnamiensis G4
MSDLAARLDSVHRRIADAARAAGRDPATVSLLAVSKTFPADDVRAAHAAGQRAFGENYVQESIDKIDALADLRSALEWHFIGPLQSNKTRAVAERFDWVHSVDRLKIAQRLSEQRPPQLPPLNVCIQVNISGEESKSGVAPADVAELARAVAALPALRLRGLMAIPEPAGDTDAQRAPHRALHALFDTLRAHGLALDTLSMGMSADLEAAVLEGATIVRVGTAIFGARDYSH

SEQ ID NO: 13140 - protein, 181 aa, Saccharomyces cerevisiae
MGLFASKLFSNLFGNKEMRILMVGLDGAGKTTVLYKLKLGEVITTIPTIGFNVETVQYKNISFTVWDVGGQDRIRSLWRHYYRNTEGVIFVVDSNDRSRIGEAREVMQRMLNEDELRNAAWLVFANKQDLPEAMSAAEITEKLGLHSIRNRPWFIQATCATSGEGLYEGLEWLSNSLKNST

SEQ ID NO: 13141 - protein, 247 aa, Ralstonia eutropha JMP134
MFSRLKEDIDTIMLRDPAARSRLEVLTCYPGLHAVVFHRFAHACWNGGFHWLGRWISHWSRFLTGIEIHPAVKLGRRVFIDHGMGVVIGETAEIGDDCTIYQGVTLGGTSLYKGQKRHPTLGANVVVSAGAKVLGGFVVGDGARVGSNAVVLKPVPPGATAVGIPARIILPDAPTSQQGAKQEFSAYGITPNADDPVSLALKGLIDNAAKQNDRIEAVLAALDRLGEHLENTPNDRFDASELRRLMK

SEQ ID NO: 13142 - protein, 552 aa, Oryza sativa Japonica Group
MTGGLEVAMVAGGGNGGAAVLVGITVLLFVVVVVVVVLVRWWSGGEGGAAPSPPALPVLGHLHLLKKPLHRSLAAVAAGVGAPVVSLRLGARRALVVSTHAAAEECFTACDAALAGRPRTLAGEILGYDHTIVLWTPHGDHWRALRRFLAVELLSAPRLAALAADRHAEAASLVDAILRDAAGGAKVTLRPRLFELVLNVMLRAATTRRRHASVDARKLQEIIEETFSVNGTPSVGDFFPALRWVDRLRGKVGSLKKLQARRDAMVTGLIDDHRQWRSGSAGDGDQDKEKKGVIDALLALQETDPDHYTDNVVKGIILFSITVPLLHFYSIVINMYNGFDHGVQSLLFAGTDTSALTIEWAMAQLVTHPETMKKARAEIDANVGTARLVEEADMANLPYIQCVIKETLRLRTAGPVIPAHEAMEDTTVGGFRVARGTKVLVNAWAIHRDGDVWDAPEEFRPERFVDSDAGGAVTAPMMPFGLGRRRCPGEGLAVRVVGVSVAALVQCFDWEVGDDDVVDMTEGGGLTMPMATPLAAVCRPREFVKTILSTSM

SEQ ID NO: 13143 - protein, 201 aa, Pseudomonas aeruginosa
MLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQVMHGKTSPIHHKDLGVFAGLANPLTVTRYHSLVVKRESLPECLEVTAWTQHADGSLDEIMGVRHKTLNVEGVQFHPESVLTEQGHELLANFLRQQGGVRGEGN

SEQ ID NO: 13144 - protein, 334 aa, Neptuniibacter caesariensis
MSDLTSLLKNADEYRAELLAQLQEESTTCYRLFHGTNEGALGLTVDRYGSQLLIQTFHEALSDEQVAQISGHYMPLFDVQEVVYNDRSAKNSRRQDEHNKRSIDRVGQEIGVNYRVRGKHAGQDPLLFLDMRVGRRYVLDNANNKTVLNLFSYTCGVGVCAAVAGAEKVVNVDFAERNLDVGKENAQLNNLNNDQIEFIQSDFFTAAKQFAGMPIKQRVKRGQKPRPYPQLEEQQFDLVYLDPPRWAKSHFGTVDLIRDYQSVLKPSVLATKPGGTLICTNNVAKVDINEWLELVKRCANKAGQPVVDYEILHPEADFPSADGQHPLKIAVLHF

SEQ ID NO: 13145 - protein, 291 aa, Arabidopsis thaliana
  misc_feature (15)..(15): Xaa can be any naturally occurring amino acid
  misc_feature (72)..(72): Xaa can be any naturally occurring amino acid
  misc_feature (87)..(87): Xaa can be any naturally occurring amino acid
  misc_feature (93)..(93): Xaa can be any naturally occurring amino acid
  misc_feature (155)..(155): Xaa can be any naturally occurring amino acid
MEGKEEDVNVGANKXSQSRQPIGTAAQRESKDYKEPPPGPSLEPGEPQILVFLQQSGIAEFIDTFLFLYVTXLTAMGVKRAPNMCAXLGIQGXIAWAFGGMIFALVYCTAGISGGHINPAVTFGLFLARRLSLTRALFYIVMQCLGAICGAGVVXRGFNQGLYQTNGGGANVVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 13146 - protein, 407 aa, Jatropha curcas
MASSICINEILTDDELRSILSKLESDKDKEIFGLVCKRWLRLPSTERKKLAARAGPHMLQKMAQRFSRLIELDLSQSISRSFYPGVTDSDLAVIAHGFKGLRILSLQYCKGITDSGMRSIGCGLSSLQSLDVSFCRKLTDKGLLAVAEGCKDLQSLHLAGCRLITDGLLRALSNNCHKLQDLGLQGCTSITDDGLTYLVSGCQQIQFLDINKCSNIGDVGISNLSKACSSCLKTLKMLDCYKVGDESISSLAKYCNNLETLIIGGCRDISDNSIKLLASACKNSLKTLRMDWCLNVSDSSLSCILTECRNLEALDIGCCEEITDAAFQGLATIKTELGLKILKVSNCPKITVTGIGMLLEKCNGLEYLDVRSCPHVTKSGCDEAGLQFPKCCKVNYTGSLNEPDVLV

SEQ ID NO: 13147 - protein, 149 aa, Populus trichocarpa
MATAAALSTSAMVSTSFAKQKPVTSLRALPAVGEALFGLKASRGGRAKAMAAHKVKLITPDGEEEFDCPTNVYILDHAEEAHGMDLPYSCRAGACSSCAGKVVQGTVDQSDGSFLDEDQIAEGWVLTCVAYPTSDVVIETHKEEEFSAF

SEQ ID NO: 13148 - protein, 98 aa, Phytolacca americana
AASYKVTFVTPSGTNTITCPADTYVLDAAEESGLDLPYSCRAGACSSCAGKVTAGAVNQEDGSFLEEEQMEAGWVLTCVAYPTSDVTIETHKEEDLTA

SEQ ID NO: 13149 - protein, 485 aa, Solibacter usitatus Ellin6076
MEQTADIALIGLAVMGQNLIMNMNDHGYTVVAYNRTTSKVDEFLNDAAKGSKVIGAHSIEEMVKLLKRPRKIMLMVKAGKPVDEFIETLLPYLEPGDLIIDGGNSHFPDTIRRTQYLESKGLLFVGTGVSGGEEGARFGPSMMPGGTPAAWPLVKDIFQAICAKTPEGEPCCDWVGRDGAGHFVKMTHNGIEYGDMQLICEAYQLMKEGLGMSNEEMHEVFAEWNKGELDSYLIEITRDILGYKDPATGEQTLDKILDTAGQKGTGKWTSVSSLDLGMPVTLIGEAVYARCLSAMKDDRVKASKILTGPKAKFPGDKKAFVEDIRQALLASKIVSYAQGFMLLAEAAKEYKWDLNYGSIAMMWREGCIIRSVFLGKIKAAFANNPTLANLLLDSYFRGLLDRCQGSWRHTVSEAVLNGVPVPAFTTALAFYDGYRSERLPANLLQAQRDYFGAHTFERVDQPRGKFFHTNWTGKGGNVSAGVYTV

SEQ ID NO: 13150 - protein, 170 aa, Musa acuminata
RVYKGVLPSSRSEVAVKRVSHGSRQGMREFIAEIVSLGRLRHRNLVQLLGYCRRQGELLLVYDYMPNGSLEKFLHDQAMPTLDWATRFRIIKGVASGLLYLHEDWEQVVIHRDIKASNVLLDNELIGRLGDFGLARLYDHGTDPQTTHVVGTMGYLAPELARTGKATTIT

SEQ ID NO: 13151 - protein, 98 aa, Phytolacca acinosa
AASYKVTFVTPSGTKTITCPADTYVLDAAEDTGLDLPYSCRAGACSSCAGKVTAGSVNQEDGSFLDEEQMEAGWVLTCVAYPTSDVTIETHKEEDLSA

SEQ ID NO: 13152 - protein, 331 aa, Novosphingobium aromaticivorans DSM 12444
MTFEVGVVGAGAWGTALAQMLSSDGREVLLWARESEVVREINEDRRNGPFLPSACLNPTITATADLADMARIPVLLLVTPAQHLASVLGGIGRDGGDVVLCSKGIEAGTGRLMADVARDAAPDASIAVLSGPTFAHEVADGLPTAVTLACAGGEEQWLRLSTAIARPTFRPYYSDDVTGAEIGGAVKNVLAIACGVVEGLRLGQNARAALISRGFAEMQRFGLALGARPKTLSGLSGLGDLVLTCSSTSSRNFSLGKALGEGASATAVMADRATVAEGAFTAPVLADLARGRGISMPIVEAVVTLLEGAAPAREVVAGLLSRPLTAENPLV

SEQ ID NO: 13153 - protein, 488 aa, Neptuniibacter caesariensis
MAQLESLNFDNSYLRLPESFYQRVEPTPLRDPHLISFNPAVAKLLDLDPCGIKPAQIADYFSGNALLPGSEPLAMKYTGHQFGVYNPELGDGRGLLLGEVVNKQGERWDLHLKGAGKTAFSRFGDGRAVLRSSIREYLISEAMHGLNIPTTRALCLVGSEEMVMREGMMEPCAAVLRVTQCHIRFGHFEHLYYTRQHDALKELADYALERFFPEFLEAEQPYLAMFTEVVQRSASLVAKWQAYGFVHAVLNTDNMSLIGETFDYGPFSFLDTYNPSLISNHNDHQGRYAFAQQPGIIHWNLSCLAQALLPLIEREDLVKVLDSYPERYRLAELAEFRKRMGLQLEMEVDEELIRDLTKLFASEAVDMNRFFRKLSDFDGSEESLANLMGLLRNPAQLTPWLLKYEARLKDEPASFPIRRAQMRSVNPEFILRNYMAEEAIQQATKGDFSLVNELLGLLRNPMEELENYEVYAEKPPEWAAGICLTCSS

SEQ ID NO: 13154 - protein, 471 aa, Anaplasma marginale str. St. Maries
MGVCDYDVAVIGAGPGGYKCALKAAKLGLKVASIDNNSLLGGTCLRVGCIPSKALLDYSYKYHAAKDIFKDFGVTASNVKFDLRKMFEVRDREINALGSGIGSLFSSAGVERLCGAATVTRAMGDGFEIVVRREGAPTDDELSAKNVVLATGSLPASLPGIDIDEVRILSSDGALGMDVPGKLLVIGGGAIGLEMSSVWSRLGAEVTVVEYADCIAPGFDSEVSKALLSHLKKQGINFMLSHKVVSVSEKKGGKLVVSCEALSSGAVSAVEVDKVLVAVGRRPNVGKTVAVDGLVLDDRGFVSVDSRYETSIKGIFAIGDVIGGAMLAHKAEMEGHAVAELVAGHDSNVDYGVIPAVVYTHPAVASVGRSEDYVKSVGYDYKVGKSNFAANGRARVTGEGEGFVKVVACKRTDTILGVHIVGTYADTMINEAVVALGYRASSKDICHICHSHPDVNEVFRDACEVACSRKG

SEQ ID NO: 13155 - protein, 371 aa, Glycine max
MADGPQHPSVVQKLAGQSYLVSRLSPNFNSRNYSATGSYVNGGMHSPGLAVVSPVSPVTVHAPAEKGVSGFLVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGVAGLYRGFNISCVGIIVYRGLYFGMYDSLKPVVLVGGLQDSFFASFLLGWGITIGAGLASYPIDTVRRRMMMTSGEAVKYKSSLHAFQTIVANEGAKSLFKGAGANILRAVAGAGVLAGYDKLQLILFGKKYGSGGG

SEQ ID NO: 13156 - protein, 97 aa, Spinacia oleracea
ATYKVTLVTPSGSQVIECGDDEYILDAAEEKGMDLPYSCRAGACSSCAGKVTSGSVDQSDQSFLEDGQMEEGWVLTCIAYPTGDVTIETHKEEELTA

SEQ ID NO: 13157 - protein, 404 aa, Solibacter usitatus Ellin6076
MRLSAVFAVLGPGFITANVDNDPGGILTYSQAGAKFGYTLLWTLIPTTIALIVVQEMAARMGAVTGKGLSDLIREEFGLRITFFTMVVLGLADLGNIAAEFAGIASGMGIFGLSKYLTVPIGAAVVWFVIVRGSYKPVERIFIILSLIYFTYPISAILAHPDWTTAIRQTFIPEWNSSPDYIVMIVGLIGTTVTPWMQFYLQASIVEKGITEKHYSITRWDVIIGCIVTDVIAFFIVVACAATLFKAGHHELNDASEAAQALVPFAGRFAGLLFAVGLVNASMLSAAILPLATAYNVCEGLGFESGIDRRFGEAPIFYGLYTFLIVVGAGCVLIPGLPLLKLILFSQVANGVLIPFVLIFMLILINKRGLMGDWRNGMWANLIAGATSVIMICLTAVMVWNAVH

SEQ ID NO: 13158 - protein, 461 aa, Chlamydophila pneumoniae TW-183
MTQEFDCVVIGAGPSGYVAAITAAQSKLRTALIEEDQAGGTCLNRGCIPSKALIAGANVVSHITHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 13159 - protein, 96 aa, Raphanus sativus
ATYKVKFITPEGEQEVECDDDVYVLDAAEEAGIDLPYSCRAGSCSSCAGKVVSGSVDQSDQSFLDDDQIAEGFVLTCAAYPTSDVTIETHREEDMV

SEQ ID NO: 13160 - protein, 341 aa, Vitis vinifera
MEDGKLPGQCCSLHPLYIFYMYIDKFSDLTFTFQPAISRTLRYIQPSDYLFRVECVSSLMNTNIEKYESGKFEAGGYKWRLCLYPNGNIKSNGKGYISLYLAIADTKMLPLGWEVNVNFKLFVFNHKHDQYLTVQDAGGKLTRFNVMKTQCGFPQFLSLDVLNDPCNGYLMEDSCIFGAEVFVIKYSGKGECLSMIKEPVDGTFTWVIENFSTLKEKVMKLILYPKGSSKTKNKSLSLFLELADCETLDNQSKLYAEFELLISDQGNLGYVKHHGISRSMRYLPPAHYTFKIEPFSLLLKSNIEKIHSAYKLIIALIGNMNVKAMADSRIQSAAWILLGAS

SEQ ID NO: 13161 - protein, 392 aa, Arabidopsis thaliana
MEETRGISDPENGSSSYGGKPPNPLSFSSSSAAAAVYRQTFDGERSLAPCNKRSLVRHSSLVKTMVSDISVENEFTIEKNKSEFVPATRSGAWSDIGSRSSMEDAYLCVDNFMDSFGLLNSEAGPSAFYGVFDGHGGKHAAEFACHHIPRYIVEDQEFPSEINKVLSSAFLQTDTAFLEACSLDGSLASGTTALAAILFGRSLVVANAGDCRAVLSRQGKAIEMSRDHKPMSSKERRRIEASGGHVFDGYLNGQLNVARALGDFHMEGMKKKKDGSDCGPLIAEPELMTTKLTEEDEFLIIGCDGVWDVFMSQNAVDFARRRLQEHNDPVMCSKELVEEALKRKSADNVTAVVVCLQPQPPPNLVAPRLRVHRSFSAEGLKDLQSYLDGLGN

SEQ ID NO: 13162 - protein, 130 aa, Triticum aestivum
MIKVENIEENRRQYRHLLMSTKTDISEYLGGIILFHETLYQKDDSGKLLKDLMVEKGIAIGIKVDKGVVKLLGTKDETTTQGLDGLGDRCAQYKADGCDFAKWRCVLKITDSTPSQLAIDENANVLARYA

SEQ ID NO: 13163 - protein, 469 aa, Geobacter metallireducens GS-15
MPDDTHDLVILGSGSTAFAAALRAQSYGTRVLMVEKGVPGGTCINWGCVPSKTLIHAALFYQEGKLGARLGLGECGGTVVLERLMARKDQVVGHLRQTKYLDILQDVPGLQLVKGTGRFLGPDRLEVGDREIRSERFLVAVGGDPRVPRIPGLESTPFLTSRGTLLLKTIPQSLVIIGGGVIAVEMGQMFQRLGAKVTILEHGPRILGPVEPEPALAVRDFLRAEGMKIVCRTTICLAAQDGAGVRVEAERDGERVSFTAEKLLVATGTAPATNGIGLELAGVETDPRGFVTVDERMRTTAPGIWAAGDCTGGMMIATVGAREGIVAVDDMLNPGCGCSMDFLSAPMAIFTDPEVGMVGHTEEGAKAAGFDVVVNVMPVAAIPKAHVTGHTAGVIKMVADKATGRLLGVHLACHRGADIINEAALAIRFRATVEDLANALHVYPSMGEGLRLCAQGFSRDISRLSCCAE

SEQ ID NO: 13164 - protein, 278 aa, Leptospira interrogans serovar Lai str. 56601
MNNKENPLKQTIMLNNGISMPILGLGVWKTKSGKECKEAVLNALEAGYRHIDTARIYDNEVDVGQAIRESGIPRKEIFITTKLWNADQGSDKTRKALENSLDRLGIDFVDLYLIHFPVTSKRMDSWKELEKLYHDKLCKAIGVSNYTIIHLTELLKNSQITPAVNQVEFHPFLNQIHLLEYCKKHKIQLEAYSPLAHGQKIEDPTIAKIAQKYDKTPAQILIRWAIEQKIVVIPKSIKKERIIENSKVFDFAISEEDMKILNSLDEDFRTCWDPSEVV

SEQ ID NO: 13165 - protein, 484 aa, Nocardioides sp. JS614
MPSLFEYAPAPESRAVVDIKPSYGLFVNGAFVDGHGASFKTISPATEEVLAEISEADESDVDAAVKAARTAYDKVWSRMPGRERAKYLYRIARIIQERSRELAVLESLDNGKPIKESRDVDVPIAAAHFFYYAGWADKLEYAGHGRDPQPLGVAAQVIPWNFPLLMLSWKIAPALACGNTVVLKPAETTPLSALLFAEICQQADLPPGVVNIVTGAGGTGQALVGHPGVDKVAFTGSTEVGKAIARSVAGTSKRVTLELGGKAANIVFDDAPIDQAVEGIVDGIFFNQGHVCCAGSRLLVQESIAEDLLERLKARMSTLRMGDPLDKNTDIGAINSGEQLKRIRELSEVGDAEGAERWEVACDLPTKGFWFPPTIFTGVSQAHRIAREEIFGPVLSVLTFRTPAEALEKANNTPYGLSAGVWTDKGSLILKMAASLRAGVVWANTFNKFDPTSPFGGYKESGYGREGGRHGLEAYLRSPHEGAR

SEQ ID NO: 13166 - protein, 498 aa, Leptospira interrogans serovar Lai str. 56601
MIKISGLNKAFTTKVLFDDLNLSINRGEKVGLVGRNGHGKSTLFQVILGNVEADSGTISIPKGYKIGHLQQHLHFTKPTVLEECSLGLPEGEEYETWKVEKILSGLGFSEQDMEKNPNEFSGGYQIRMNLAKLLVSSPDMLMLDEPNNYLDIVTIRWLEEFLREWEGEIILVTHDRGFMDAVVTHTIAIHRTKAIKVQGDTDKLYNQINQSEEIYEKTRLNEAKKRKQEEIFIAKFKAKASFASRAQSRVKKLEKQGEMKELEKIQDLELYFNSAPFNANQMLSAENLSFSYDGKEPFLIENFSISVGSRERICIIGKNGKGKSTLLKILAGELETSQGTIKKHPVLKEGYFGQTNKLNLNENSTVVEEIMISDPSCNEWKARTIAGGLMFSEDQALKKIKVLSGGEKSRVLLGKILVTPCHLLYLDEPTNHLDMQSCDSLIEAIDEFDGSVIMVTHDELHLRAVATKLIVFDNDSIQIFNGSYDDFLNDVGWSNEHY

SEQ ID NO: 13167 - protein, 398 aa, Bacillus cereus E33L
MAVEVVMPKLGMAMKEGIITSWNIKAGDHVSKGELIASINSEKIETEIEAPADGTVLDIAVSEDEGVPPGTVICYIGKPNEKVEVHESTKVEEELVASEVSQNVQHPEPLGKEVTNKQRIKISPVAKKIAKTENLDIKSLLGTGPGGRITKVDVLKALEERVAIPEVLEESKVIPVTGMRKAIANRMHASLQNSAQLTLTMKVDVTDLVALHKEIAKVVQKRYNNKLTITDFVSRAVVLALGEHKEMNSAYMDDTIHQFEHVHLGMAIALEKGLVVPAIRFANNLSLVELSKQIKNVAQKARAGSLSSDDMQGTTFTISNLGSFGIEYFTPVLNTPEAGILGVGAIEHVPVYKGKKLKKGSMLPLSLTFDHRVLDGAPAAAFLRTIKRYLEEPVTILL

SEQ ID NO: 13168 - protein, 459 aa, Bacillus cereus E33L
MSKLVVIGGGPAGYVAAITAAQNGKNVTLIDEADLGGTCLNVGCMPTKSLLESAEVHDIVRKSNHYGVTLNNGSISIDWKQMQVRKSQIVTQLVQGIQYLMKKNKIKVIQGKAKFETDHRVRVTYGDKEIVVDGEQFIIATGSEPTELPFAPFDGKWILNSTHAMSLKNIPKSLLIVGGGVIGCEFASIYSRLGTKVTIVEMAPQLLPGEDEDIAHILRRELENDGVKIFTGATLKGLNSYKKQALFEYEGSIQEVNTEFVLVSVGRKPRVQQLNLEKAGIQYSNKGISVNEHMQTNVSHIYAAGDVIGGIQLAHVAFYEGTTAALHASGEDVKVNYHAVPRCIYTAPEIASVGLTEKDAREQYGDIQIGEFPFTANGKALIIGEQMGKVKVIVEPKYQEIVGISIIGPRATELIGQGTVMIHTEVTADIMRDYIAAHPTLSEAIHEALLQAVGHAVHA

SEQ ID NO: 13169 - protein, 235 aa, Oryza sativa Japonica Group
MGRQEVSSAISVLAEYRFEEEDYPVIDYELFKRAAEHEDPAILAKETTFSVSEVEALYELFKKISHSIFKDGLIHKEEFQLALFRNSNKKNLFADRIFDLFDLKRNGVIDFGEFVRSLNIFHPETPLAEKIAFAFRLYDLRGTGYIEREELYEMVLAILNESDLLLSDDAVEQIVDQTFKQADLNSDGKIDPDEWKAFASKNPALLKNMTLPYLKDITMAFPSFVLNSGVDDEEL

SEQ ID NO: 13170 - protein, 551 aa, Archaeoglobus fulgidus DSM 4304
MKEVIMKYVVQNAAKYGKASEKAVMGKVMAENPELRKKAKEVLELVKECITEFEALSEEVRKELIKKYSMDSEAKRELETKKLPELEGAEKGKVVMRFAPNPNGPPTLGSARGIIVNGEYAKMYEGKYIIRFDDTDPRTKRPMIEAYEWYLEDIEWLGYKPDEVIYASRRIPIYYDYARKLIEMGKAYTCFCSQEEFKKFRDSGEECPHRNISVEDTLEVWERMLEGDYEEGEVVLRIKTDMRHKDPAIRDWVAFRIIKESHPLVGDKYVVYPTLDFESAIEDHLLGITHIIRGKDLIDSERRQRYIYEYFGWIYPITKHWGRVKIFEFGKLSTSSIKKDIERGKYEGWDDPRLPTLRAFRRRGFEPEAIKSFFLSLGVGENDVSVSLKNLYAENRKIIDRKANRYFFIWGPVKIEIVNLPEKKEVELPLNPHTGEKRRLKGERTIYVTKDDFERLKGQVVRLKDFCNVLLDEKAEFMGFELEGVKKGKNIIHWLPESEAIKGKVIGEREAEGLVERNAVRDVGKVVQFERFAFCKVESADEELVAVYTHP

SEQ ID NO: 13171 - protein, 203 aa, Zea mays
MHAPRRFKKAFMAQLLLSLRAAGQASKSMGLRERRDAVRLSSDVAMALASARARAAPRSTVWARALIARHAAEQRNEALMRRIMGGAGYEMAAAAVRARKEARCRRIVRRSRRVCSGVGRKRRSLLAAEGGGGIRCSAMAAARRMVKARLQVLRSLVPGGEAMGGLSLLTETLDYVVCLKAQVELMQRLCKGSWFPVPAWLRR

SEQ ID NO: 13172 - protein, 295 aa, Bacillus sp. SG-1
MIPVTLENFTAQYKDLLEEKLNELLLDLDAPEKVKEAMAYSLKAGGKRIRPLLLFATLHTLGKDPKIGLESAAALEMIHTYSLIHDDLPSMDNDDLRRGKPTNHKVFGEATAILAGDGLLTYSFEVLAGTPDVSAEKLIRLVSLLAKSAGPEGMVGGQAADMEGESQSLSVEELEYIHKNKTGRLLAFSVMAAAILADSTEEQISLLEEYAFHIGLAFQIQDDILDVEGSEEKIGKPVGSDENKFKSTYPALLTLEGAKEKLRNHLQKGKSALAASDLDNGLLVEIADMIASRDH

SEQ ID NO: 13173 - protein, 630 aa, Bacillus sp. SG-1
MDLLSIKDPSFLKSLSQQELESLSEDIRKFLIETLSKTGGHIGPNLGVVELTIALHKCFDSPKDKIIWDVGHQSYVHKILTGRAGQFGTLRQYKGLCGFPKMVESEHDVWETGHSSTSLSAAMGMAIARDVKKEDSFIVPVIGDGALTGGMALEALNHIGHEQKDMIVVLNDNEMSIAPNVGALHNVLGRLRTAGKYHWVKDELEYILKKIPAVGGKLAVTAERVKDSLKYLFVSGMFFEEMGFTYLGPIDGHDYNDLLENIQYAKKTEGPVILHVITKKGKGFHPAESDKKGTWHGTGPYKMDSGDLIKPVNAPPSWSGLVSETVRKLAREDERIVAITPAMPVGSKLEGFASEFPDRMFDVGIAEQHAATVSAGLATQGMKPFLAIYSTFLQRAYDQVLHDICRQNLNVFIGIDRAGLVGADGETHQGVFDIAFMRHLPNVVLMMPKDENEGQHLVNTAIKYDDGPIALRFPRGNGLGVKMDKELKTIPIGEWEVLKEGRDTAILTFGTTIPMALEAAEQLEKQGVSVKVVNARFIKPLDEKMLSGIMRDNMPILTIEEAVLQGGFGSAVLEFAHEHGFNEVTIERIGIPDKFIEHGSVKELLKEIGMTTENVVDRIQTMIPKKQKRA

SEQ ID NO: 13174 - protein, 214 aa, Salmonella enterica subsp. arizonae serovar 62:z4,z23:--
MKLPLCTATLLTLFLPPLSTFAAIQEEAHQPCQTDINQPPGDIRSTSEVHVSPLEVQYIDSPSELINNGQPLQASMKSFAANTIRLDDQLYTLEEFHFHVPAENTIDGKRYAMELHLMHRNSNGDLAVVAVIFTEGTANKTLERLWQSIPTLLEKRATLFAPVDINQLLPADKTYWRFNGSQPSPFCLENAAWVVLQHPLTLSSAQLEKFACRS

SEQ ID NO: 13175 - protein, 399 aa, Haemophilus influenzae R2866
MAFDYQTFRQAFPYFQREDAVIYLDNAATALKPQVLIDRTAEFYASAGLVHRSQYDAAQTAQYEQARTQVKKWVNAEDKRAVIWTSGATHAINLVANGLLPQLNAEDEILISQADHHANFVTWHETAKKCGAKIRVLPILDNWLIDENVLISTLSEKTKLVALNFVSNVTGTEQPIKRLIQLIRKHSHALVLVDAAQAISHIKIDLQDLDADFLAFSAHKIYGPNGLGVLTGKLTALSQLQPLFFGGKMVERVSNNRITFAELPYRLEAGTPNIAGVIGFNAVLDWLQKWDFTAAEQHAISLAESVKVRLKSYENCRLFNSPQASTVVCFVFDGIDCSDLSTLLSEQNIALRVGEHCAQPYLARLGERTTLRLSFAPYNTQEDVEAFFTALDKALDLLQ

SEQ ID NO: 13176 - protein, 416 aa, Ralstonia eutropha JMP134
MALIVHKYGGTSMGSTERIKNVAKRVAKWHRAGHRVVVVPSAMSGETNRLLGLAKEISAQPDPRELDMLASTGEQASVALLAIALHGENIDAVSYTGWQVPVKTDSSYTKARIESIDDERILGDLDAGRVVVITGFQGIDDDGNITTLGRGGSDTSAVAIAAAIEADECLIYTDVDGVYTTDPRVVEDARRLDKITFEEMLEMASLGSKVLQIRSVEFAGKYRVKTRVLSSLTDPLMPLENEINSGTLITFEEDSNMEAAVISGIAFARDEAKITVLGVPDKPGIAYQILGPVADANIDVDMIIQNQSVDGKTDFTFTVPRGDYQRTLTLLTDSVKPHVGAANVSGDPKVSKVSVVGVGMRSHVGVASKMFRTLSEEGINIQMISTSEIKISVLIDEKYMELAVRALHKAFELEQA

SEQ ID NO: 13177 - protein, 319 aa, Magnaporthe grisea 70-15
MSTLFVAKRQAARAASQLRCFSSTPSRGAAEVKKLGVLGAGQMGLGIALVAARVAQVPVTLVDPSQGALDKGLSLADKLLSKDLQKSRISQEDADATRGRLSPTTSMDSLADVDFVIEAVPEIPNLKYEIFSKLAQICPKHAILATNTSSISITRIAAATTKDATDLSASSRVVSTHFMNPVPVMKGVEIISGLQTSQETLDTAVAFCKAMGKVPSTSADSPGFLANRILMPYINEAVICLETKVGDRDSIDTIMKTGTNVPMGPLQLADFIGLDTCLAIMKVLHTETGDSKYRPSVLLQKMVDAGWLGKKSGKGFYDY

SEQ ID NO: 13178 - protein, 525 aa, Anaplasma marginale str. St. Maries
MRRWCADDSYLLWRVRYCRIGPVFLLAQIKCMSGSAVVLCILDGWGNGNGDECDAIHAARKPFWESVVSGCPRSSLSASGEDVGLPAAQVGNSEVGHISLGAGRVVLQDLQRINAEIGEIHSNPYLLQFAEAIKNGRGVCHIMGLLSDGGVHGLQDHITQLARVLAELRIKVLIHAFLDGRDVSPRSAKKHVTALNDAVHSYDISIATISGRYYAMDRDHRLDRTEKAYEAIALARGPRYRDAMTAIESSYSEGISDEFLVPSVIGDYQGFSPKDGILLTNFRSDRIVQILSMILHRSQEVSNILGMVRYSEKIQVPSLFPPRNICNTLGEVVSKCGLKQLRIAETEKYAHVTFFFSGGKEEPFPGEDRVIIPSPQVSTYDLQPEMSAFPMTEVLVERIESRQYSLIVVNYANADMVGHTGNLEAVKKAISVIDACLQMVFNAAKKAGATMLITADHGNAEKMFDMRGTPFTAHTSNTVPLVLCNCDKRFGLVDGRLCDVAPTILELMEIAKPDEMTGSSLLTPE

SEQ ID NO: 13179 - protein, 239 aa, Neptuniibacter caesariensis
MEPIQQFIQENWLNLLALVWFLICFKGYMYYAKKRSYDTPCLASMLHMYRREWMKRMLTHEVRIADTTAIANLERGVSFFASTTMLILAGLMTVLGSTQQAIDVVADIPFARHATRGEWELKILLMISLFVYAFFKFTWSLRQYGFVSIMIGGAPQPEEQISETQAEAHANRIAKMTSMAANNFNIGLRTYYFCLAILGWFINPWLFMVLSGGVVFVLYRREFKSSTLKTLMMSDGAEK

SEQ ID NO: 13180 - protein, 310 aa, Streptococcus pneumoniae TIGR4
MMRSTKELRHVYRDFLLEANQSDSDIVVLEADLSSSMATNNLEKDFGDRYVNVGIMEAEMVGLAAGLSIQGFRPYLHTFGPFASRRVFDQLFISLGYAQLDATVIGSDAGVTAEMNGGTHMPFEEIGLLRLIPKSIIFEATDDIQFREILNQTLDLKGLKYIRTIRKAPVPVYQGGEDFSKGYIELRHGEDLVIVASGIMVAPSIRVADELSKLGYSVGVIDLFRIKPIPEQIKTMLSGKTIFTVENHNQIGGIGSALCELFSDDGITKIHRMGVQERFGQVGKMDYLLNEYGLSESNIKEKVLEIYNAR

SEQ ID NO: 13181 - protein, 365 aa, Nocardia farcinica IFM 10152
MSAPVQTARTRPARHRAFHDLRVADVERLCDDAVAVTLDVPAELAEEFAFRPGQSLTVRRVLDGVEHRRSYSICAPVGAPPRIGVRRVAGGAVSTWLVDQLRPGDRIEVQGPSGTFAADPDAGGRHLLIAAGSGITPMLSIAASVLAHPDSEVVLLYGNRRVRSVMFVDEIADLKDRYGDRIEVVHVLSREPRDVELFTGRLDAERLRAILSTVVPIGDIDHAWLCGPFGMVTDARAVLAEFGVAPERVHFELFFVEDAPPPQAEHREPGVEGPTSSVTVVLDGRSTTGLLPRDRSILDAAEQIRSDLPFACKGGVCGTCRAKITGGEADMRRNYALEDAEVADGFVLTCQTYPVSDSVVVDFDA

SEQ ID NO: 13182 - protein, 137 aa, Chlamydomonas reinhardtii
ANWALNGLEPSRHVAAAEDAFEFLERAGKAREKWEVVIIDPPSFAPSKQAVEKAKASYTRLFAAAASVTAPHGTLALASCSSHIDSAMFMEICDEALGKARRQGYVLGVGGQPADHPYPAAADELRYLKFVTFRLEN

SEQ ID NO: 13183 - protein, 372 aa, Zea mays
MAKDGGPDWNGLLKWSLAHGDGTNPPRALSEEDRKWFMDAMQANTVDVVKRMKEITQVMKTPEDVLQSQGVTPENIEDMLDELQEHVESIDMANDLHSIGGLDPLLGYLKNSNAGIRAKAAEVVSTIVQNNPKSQQLVMESNGLEPLLTNFKSDPSTNARTKALGAISSLIRHNQPGVSAFRLGNGYAGLKDALGSDDARLQRKALNLIQYLLHNYKADRSVATELGLPKLMMHLVSSDDSLVREAALGGLLELARDKTSGNALPDQEKLKDMLKSRIEGISAMDTDDLHAAREERQLVDSLWKECYNEPSSLREKGLVVLPGEDAPQQPPPDVAGKMFEPPLRAWAAARPAQEDDSDSGSGKKDPPLLLKF

SEQ ID NO: 13184 - protein, 99 aa, Fremyella diplosiphon
MATYQVRLINKKEDLDSTIEIDEDTTILEGAAENGIELPFSCHSGSCSSCVGKVVEGEVDQSDQIFLDDEQMSKGFALLCVTYPRSNCTIKTHQEPYLV

SEQ ID NO: 13185 - protein, 409 aa, Oryza sativa
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 13186 - protein, 314 aa, Solibacter usitatus Ellin6076
MTHDRLKVFAGNANPALALEICRALGIAQSQAMVRQFSDGEIYLQLKENVRGMDVFVIQPTCAPVDRNMMELLLMLDALKRSSAQRITAVLPYYGYARQDRKDKPRVPISAKLVAALLERAGADRVLTLDLHAAQIQGFFDIPVDHLFAMPVMIEYFRSQEIPALTVVSPDAGGVERARAFAKRLNSPLAIIDKRREEANVAEVMNVVGDVGGRNCLLVDDLIDTAGTLVKGTEALLEKGAASVSACATHAVLSGPAVSRIEESALKEVVFTNSIPLSEAARNSTRIKSLSIAKLMADAIRSIHEETSVSTLFV

SEQ ID NO: 13187 - protein, 138 aa, Bdellovibrio bacteriovorus HD100
MADKVLKCGLPSDEGELKKILTPEQYRIMVENGTERPFQNAYWNHHEQGIYVDAISGVPLFSSDDKFDSGSGWPSFTRPISADAVKEIADYSHGMTRIEVRASSSNSHLGHVFDDGPAPTGLRYCINSASLKFIPRKG

SEQ ID NO: 13188 - protein, 500 aa, Arabidopsis thaliana
MATIWFLSLLFLSCILLAAFTHKKRRQHQRKPPSPPGFPIIGNLHQLGELPHQSLWSLSKKYGPVMLLKFGSIPTVVVSSSETAKQVLKIHDLHCCSRPSLAGPRALSYNYLDIAFSPFDDYWKELRRICVQELFSAKRVQSFQPIKEDEVKKLIDSVSESASQGTPVNLSEKFTSLTVSVTCKAAFGVNFQGTVLNSDRFDKLIHDAFLFLGSFSASDYFPNGGWIIDWLTGLQGQRERSVRGLDAFYEQMFDLHKQGNKEGVEDFVDLLLKLEKEETVLGYGKLTRNHIKAILMNVLLGGIGTSAITMTWAMTELMRNPRVMKKVQSEIRNQIGNKSMITLDDIDQLHYLKMVINETWRLHPPAPLLIPRQVMSEFELNGYVIPAKTRLYVNVWAIGRDPDTWKDPEEFLPERFVNSSIDAKGQHFELLPFGSGRRMCPAMYMGTTMVEFGLANMLYHFDWKIPVGMVAEDIDLEESPGLNASKKNELVLVPLKYLGH

SEQ ID NO: 13189 - protein, 264 aa, Bacillus anthracis str. Ames
MIQSGKIYIRGRTVVFMIIRNEQDLEGLRKIGRIVALAREEMKKEAKPGMTTKELDLIGKKVLDEHGAISAPEKEYDFPGVTCISVNEEVAHGIPGDRVLKEGDLVNVDVSAALDGYYADTGISFVLGEDEAKEKLCQAAVDAFWAAMKKVKAGSKQNQIGRAVSNFAHKNGYNVIQNLTGHGIGLSLHEAPNHILSYFDPMDNALLKDGLVIAVEPFISMKADHIIERGDDGWTFVTPDKSLVAQCEHTVVVTRGEPIILTEI

SEQ ID NO: 13190 - protein, 527 aa, Oryza sativa Japonica Group
MDRQEEEDDDAALREAGGGASFPGGWLRRLSRELHWSFVLAVVAVYGACQGVGDAVGGVAAGYYWKDVQRVQPSAAQFYQGFVSAPWVVKPIWGLLTDVVPVAGYRRRPYFLLAGVIGASSMLTLSLHRKLGIMPAILALTAQSAGAAVADVTVDALVAQNSITHQPLAADMQSLCGFSSSVGALLGFSISGLLVHSMGSQGALGLLSIPSALVFLAGVLLKERRVTDFDYKQVHRKFYKAIQSMGATLKCAEVWRPCVYMYVSLSLSLDIQAGMFYWYTDPIVGPGFSEEFIGLVYSVGSIGSLLGVLLYQISLKDCPFRGVLFWGQVLSSLAGMLDLIMVTRLNTRIGIPDYVFAVIDNSVSQMVGRLKWLPLLVLCSKLCPPGIEGTFYALLMSIQNAGLLMSGWWGGLMLQLLNVTRTEFSNLWVAVLIRNLSRLLPLMLLFLVPQSDQNSMLLPAEMLQDNESTEARKGGQDTAEFSVLVADDSSCHALNVAVEDERIKVVDAGTGTVELIPLMNELQDRGS

SEQ ID NO: 13191 - protein, 450 aa, Xylella fastidiosa 9a5c
MRVAIFGTGYVGLVTGTCLAEVGHEVLCVDINQAKVDGLNCGVIPIYEPGLEPMVKANHATGRLRFTTDSVAAIAHGEITFIAVGTPPDEDGAADLQYVLAVARTIGQCIDRSTIVVNKSTVPVGTADQVRAAIQHEMDVRGVDFKFEVVSNPEFLKEGDAVADCMRPDRIVIGARSRDAVVRMRRLYAPFNRNHDRIVEMDVRSAELTKYAANAMLATKISFMNEVANIAEYVGADIEYVRKGIGSDPRIGWYFIYPGVGYGGSCFPKDVKALARTAQQYGVDPKLLNAVEDVNHAQKGHLFELMLRHYGCSGESTVLAGKTFAVWGLAFKPNTDDMREAPSCRLLVQLWKAGAQVRAYDPEAMQEARRIFGERDDLVFCETAYAALQCADALIVVTEWKQFRSPDFFVIRDALKDAVIFDGRNLYDPQEIEEAGLAYYGIGRGRSLHA

SEQ ID NO: 13192 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVALTGSQKALSTPPGLAIVAFSSEYSRELEKREPSGIYFDFLSLSREMESTRNYHITPAVNLVFALNASLKKILSEGLENRFERHRVLASAFTSAMEALGLRLVAEEPFRAWTVTAVYLPQGIDWSRFYSVMRKRGVEIAGGLGGLKGKIFRVGHMGEVDANDLIATIAAIERSLVELGYREARLGQGLEAAQKELSSLGL

SEQ ID NO: 13193 - protein, 537 aa, Gibberella zeae PH-1
MSTKQFYLLGEVVSTARDIELPPAVDFEELQSVGFIHDGRKLNAVSEILEVNESIAISVDGNAVRDVPGPAGIPYFGNYLEIYPDHLGNHQRLFEKYGPLFTTTSMGNRLYQTNSAELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADNVVDYFLRATDNKGNKLPPSQFAPALLVATAAGFTTTSSLLSWLIYSLVKYHGNQERLLQELIDNDWDENTQVTADTTSKLTFLDKFIKETQRLHNPSFQPGRTAKVDMILPGGYRLPKGAVVISALHHMHNNKDVWENPGRFDPDRWDTEQVKNRPPGSYIPFATGPRMCVGFNFALQEIKVFLPKLVYRYKFSLAQDGPIEYDPYFQLIRPNNLYVQAEKRVKWPPKSE

SEQ ID NO: 13194 - protein, 229 aa, Oryza sativa Japonica Group
MGCVSSKQFKRAAQHEDPAILAKETTFSVSEVEALFELFKKISHSIFRDGLIHKEEFQLALFRNSNKKNLFANRNLFLCENADSVSPQVQIFDLFDLKRNGVIDFGEFVRSLSIFHPETPLGDKIAFAFRLYDLRGTGCIEREELHEMVLALLNESDLFLSEEAVEQIVDQTFKQADLNDDGKIDPDEWKTFASKNPALLKNMTLPYLKDITMVFPSFILNSEVCEEEL

SEQ ID NO: 13195 - protein, 243 aa, Cytophaga hutchinsonii ATCC 33406
MSATVKPYQEMESGKREQVELMFNNISPKYDLLNRVLSLGIDKIWRKQALNLLKQDKPAHILDVATGTADLAIEAATRLKPTSVVGIDIAEDMLQIGRGKIAKKNLDKIIRLEKGDSEKINFPDNTFDAVIVSFGVRNFEHLEIGLAEIHRVLKPAGSIMVLEFSKPQNAPFKQVYQFYFKNILPTVGKLISKDSAAYTYLPDSVNAFPDGKAFCSILEKTGFTIKHYKPYTFGVCTAYVGKK

SEQ ID NO: 13196 - protein, 152 aa, Brassica napus
  misc_feature (112)..(112): Xaa can be any naturally occurring amino acid
  misc_feature (138)..(139): Xaa can be any naturally occurring amino acid
  misc_feature (143)..(143): Xaa can be any naturally occurring amino acid
  misc_feature (146)..(146): Xaa can be any naturally occurring amino acid
  misc_feature (149)..(149): Xaa can be any naturally occurring amino acid
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREYGXTPGYYDGRYWKMGKLSLVRDAPTPAXXVKEXPEXKTXYPN

SEQ ID NO: 13197 - protein, 1338 aa, Bacillus thuringiensis serovar konkukian str. 97-27
MLDWMKKLFNKEEEQTAMNKEVPKQVESQPKIPRVNHYTEAREAQMASRNAGKCRFPLVPDNGFDEEDVIETGRFEEQPVQAVTYENEPVQRGIKVERSRRPYVEKVVSTYEEPEMQYEPERESVVKKASAPAQESNRRPFRPTEMISPIYGYNRPSVEKKEEKQEEVKEREDLEISVEGKSVVDAWLEKKGYTLSDFSDGQAPTSSSHRAANEQGERQYEESKKEEKSVVDQWLEKNGYEIERQEPIVEEKEVVQEMSAPQEVPAAELLHETIAERMEGAKQESDVVDKNILQEELVDSKVEHEDTILSEEIKRSTEIEQPTIEVEKQAPEESVIVKAEEKLEETIVVEIPEEVEVIAEAEEREEVEVIAETEESEEVEVIAETEELEEVEVVAETEELEEVEVTAETEELEEVEVVAETEELEEVEVIAETEELEEVEVIAEAEESEEVEVIAETEAPEEVEPVALEEMQQEMVLNEAIEQKNEFIHVAVADEQTKKDVQSFADVLIAEEQSVVEETPIVEEQPVAEEAPVVEEQSVVEETPIVEEQPVAEEAPVVEEQSVVEETPIVEEQPVVEEAPVVEEAPIAEEQSVVEEAPVVEEQPVAEETSIVEEQPAAEETSVVEEQPVAEETSVVEEQPVAEETSIVEEQPVAEEAPVVEEQPVVQKEEPKREKKRHVPFNVVMLKQDRARLMERHASRTNAMQPSMSERVENKPVHQVEEKPQVEEKPVQQVVEPQVEEKPMQQVVVEPQVEEKPVQQVVEPQVEEKPMQQVVVEPQVEEKPVQQVVEPQVEEKPMQQVVVEPQVEEKPVQQVVEPQVEEVQPVQQVVAEQVQKPISSTEVEEKAYVVNQRENDVRNVLQTPPTYTIPSLTLLSIPQQAALDNTEWLEEQKELLDTTFNNFHVGAHVINVSQGPAVTRFEVQPDPGVKVNKITNLSDDIKLSLAAKDIRIEAPIPGKSAIGIEVPNKESKPVFLREILRSPVFTKSESPLTVALGLDISGDPIVTDIRKMPHGLIAGATGSGKSVCINAILTSILYKAKPHEVKLMLIDPKMVELAPYNSVPHLVAPVITDVKAATAALKWAVEEMERRYELFAHAGARDLTRYNTIVSGREIPGETLPYIVIVIDELADLMMVAPGDVEEAICRIAQKARACGIHLLVATQRPSVDVITGLIKSNIPTRIAFTVSSQVDSRTIIDIGGAEKLLGRGDMLFLGNGTSKPVRVQGVYVSDDEIEKTVDHVKKQMKPNYLFKQEDLLAKTEQAESEDELFLDACQFVVEQGGASTSSVQRKFRIGYNRAARLIEEMESQGIISEGRGTKPRDVLISEDEFAAMQETNV

SEQ ID NO: 13198 - protein, 199 aa, Cytophaga hutchinsonii ATCC 33406
MKMNAKFISSYDDYQKCPEITKPEYAFIGRSNVGKSSLINSLTGVKNLAMTSSKPGKTQLINLFTIEETWILADLPGYGFAKASQSSRIKWGRMVHDYLKNRTNLTTVFLLVDSRHEPMKSDLEQITWLASNGIPFSLIFTKIDKQSLTQTNKILASWTKVLSENWEELPKMFLTSSESGKGTEELLTYIDEINKQIAN

SEQ ID NO: 13199 - protein, 503 aa, Oryza sativa Japonica Group
MYVPQPSRSDAAGRDAGDQPRVYQVWRGSNGEAGAGSVLSGALCAVIVSMVRMSMLVENNSSSQNRNEASICAQFEVIQLTLKIYAGLHAKYFDELCHHTNSEIIQWNFEMPSGPALEFFLRGRFIFGPDVRSIFLTMFLIVAPVVAFCVFVARHLIDDFPGDWGISVMVVVVVFTVYDLTLLLLTSGRDPGIIPRNTHPPEPEGFDGSNDSGVQTPQQLRLPRTKDVIVNGISVRIKYCDTCMLYRPPRCSHCSICNNCVERFDHHCPWVGQCIGLRNYRFFYMFVFSTTLLCLYVFAFCWVYIIKIRNAESLSVWKAMLKTPASIVLIIYCFLCVWFVGGLSVFHCYLMSTNQTTYENFRYRYDRRANPYNRGVLNNFLEIFCSRIPPSKNNFRARVTVEQGLQQTRVASRGFMSPNMGKPVGDLEMGRKPVPWDEPRTAADIRDLEAGLGGFLDEKEGRLTHASPDLSRDDLPADLMKGRAGTHSRRSSWVNRTGTSESE

SEQ ID NO: 13200 - protein, 212 aa, Bacillus thuringiensis serovar konkukian str. 97-27
MGTNKPVVIGIAGGSGSGKTSVTKAIFDHFKGHSILILEQDYYYKDQSHLPMEERLKTNYDHPLAFDNDLLIEHLQQLLAYKQVDKPVYDYTLHTRSEEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDIMVTKIATILEQKVNL

SEQ ID NO: 13201 - protein, 390 aa, Vitis vinifera
MGSICSRHKHYHEADAEENAQIKLLFQTGFDEAELKSYISVVHANVYQTIKVLYDGSRELAQNTTDSSKYALSIENKDIGEKLSEIGGRLDYPRLTRELANEIETLWKDAAIQETYSRGNELQVPDCAHYFMDNLERLSDANYVPTKEDVLYARIRTTGVVEIQFSPVGENKKSGEVYRLFDVGGQRNERRKWIHLFEGVTAVIFCAAISEYDQTLFEDENKNRMMETKELFEWVLKQPCFQVPLNVCEWFKDYQPVSTGKQEIEHAYEFVKKKFEELYFQSTAPDCVDRVFKIYRTTALDQKLVKKTFKLSRSPEFVFPALHVLQVELLRHRLSGSFREDLLAETGDFGLAWPPGWKRREEGLLGLGLKCGVKAGLDMGFDPESDPYRI

SEQ ID NO: 13202 - protein, 473 aa, Bacillus sp. SG-1
MSQEYDLVILGGGTGGYVAAIRASQMGLKTAIVEKGKLGGTCLHKGCIPSKALLRSAEVFATAKEADSFGVMINDVKLDFTRVQERKEKIVEGLHKGVQHLMKQGKIDVYEGTGRILGPSIFSPMPGTISVEMNNGEENEMLIPKNVIVATGSRPRTLPGLDIDGEFVLSSDEALELEKLPESIIIVGGGVIGIEWASMLSDFGVEVTVIEYANRIVPTEDHEISKEMQRLMKKKGVKIVTGAKVLPETIEKDGGVKIKAEIKDTQKEFTADQLLVSVGRQANVEGIGLENTDIVIEKGFIKVNKHMQTKESHIYAIGDVIGGLQLAHVASHEGISAVEHMANENPEPIDYSLISKCIYSNPEIASVGLTENEAKDKGHNLKVGKFSFRAIGKALVYGESDGFVKIIADKDTNDILGVHMIGPHVTDMISEAGLARVLDATPWEVAHTIHPHPSLSEAIGEAALAVDGKAIHS

SEQ ID NO: 13203 - protein, 173 aa, Solibacter usitatus Ellin6076
MPDLKSLIREVPDFPKPGILFYDITTLLKDPSGFHGVIDGLKDHYRDIKVDTVLGIEARGFIFAPALAYALGAGFVPVRKPKKLPAECVRITYDLEYGTDTLEMHKDAIGNGHRVLIVDDLLATGGTASAAARMVQDAGGIVVGLGFVIELTFLAGRQRLNGHDVFSLLQYDK

SEQ ID NO: 13204 - protein, 551 aa, Bradyrhizobium sp. ORS278
MYAYDDIDRTLVNERVAEFRDQVKRRLSGELTEDEFKMLRLQNGVYLQLHAYMYRIAIPYGTLSSDQLRRLAHVARRYDRGYGHFTTRQNIQFNWIKLAELPDAMADLAEVGIQSMQTSGNNMRNVTSDQWAGVAPGEVEDPRIWAELLRQFTTLHPEFSFLPRKFKIAITASEHDRAAIKIHDIGLRLKKNEQGETGFEVLVGGGLGRSPFIAKTIKPFVHGHDILSYVEAILRVYNQYGRRDNIYKARIKILVHELGIEKFAAEVEEEWQQIRDGVLKLDQGIVEDIRSRFFYPAYETLPHMPDELKQAAHDAKFEAWRKNSVFPHKQQGYAIAVVSLKPVGKPPGDATADQMDALADIADRYSFGEIRVGHEQNLALPHVRKRDLPAVWKALEAIGLAIPNVNLVSDIIACPGLDYCSLANARSIPIAQEITRRFANHDTANLIGRLHINISGCINACGHHHVGHIGILGVEKNNEEFYQITIGGRADEGAELGTLIGPAVPYAEVADVVEDIVEAYLALRVSPEELFVDTVKRLGVEPFRERVYATR

SEQ ID NO: 13205 - protein, 598 aa, Lentisphaera araneosa HTCC2155
MDKIGVLDFGGQYAHLIANRVRRMGVYSEIVSPTAELSTLSSYKGLIFSGGPSSVYAENSPSFNKDILNFNGPILGICYGHQLICQTLGGQVKPGEVKEYGIARVAKSFESPLYEGLGDSEVMWMSHGDSVAEIPAGFEITAATPDCPVASVQNLEKKIFGLQFHPEVTHSENGLKLMKNFLKQCGCSFEWDIKAFMQQSIDNIRHENAGKKVFLLVSGGVDSNVAFALLNKALGDENVYGLHVDNGLMRKDESAWVKEELKQAGFSNFHVVDAGDTFLKNLAGVSEPQAKRVIIGDTFLDVKCEAVEESDLVDDSWLLGQGTIYPDTIESGGTENSHLIKTHHNRVDRIQELINQGKVIEPLAELYKDEVRELGELLGLPHKLVWRHPFPGPGLGVRLLCSDSEGSEDYSEAEARINTFLEKYKVTGRILPVKSVGVQGDARTYAHPCLISGKADWETLEEISTSLTNRFPEVNRVIYNAGGDDWSGEILLHKCDTNKERLDRLREADQVVTDYLFDKGLYEDIWQMPVALLPVGRTLNGESLVLRPINSTEAMTASFSRIPQNQLSEMISEIRKKAELEGVFYDVTNKPPGTIEWE

SEQ ID NO: 13206 - protein, 700 aa, Cryptococcus neoformans var. neoformans JEC21
MSHSPSASPRLRPFAIPIRKPEETSNLQALPIDDRNDDTGCVKTRPQEESCHAPIPPEPCSPDLSKLKVTDDEEISPTRVQVRSSSCNCQALLIGFIEWTYQTPRRFSLASTPSTTPGLTSTPFTSRSSFTADSNNTPHTPYTPGFVGYRRHSDSSDELSCLSGKVSTSAGHSIETLGRYLLITQVPNEVSEFEFRDMIQSMADFKALIVKHLKSKGCIIIVFYDLRQNLKVYERLQEGPVTIGVAHPMVQLQCMPVSRDVVETVTGHGGAWDQVWKTSESTIKIEIKGGHPVTTEVMENVMQSIGDVRQIDPIGYDGREFAVDFYDTRDAAQSITDLNGRTAGQALLCVDYHDHRDKEYLYSRPSNNRAFSLGSAAYIPGCLSASRLESTSSDAFNLTRIADGNSDLRTPSNMALNTLRTDDFFSSHPSSLTPSKQSVAAPDFACSTSPSWSLDKSFFDYETPPRILSLSRRLSEAGTVQGLVNRADMAARARQKQGLGGHWDANDRKAIPEQNRVFPERIMAGLDSRTTVMVKDVPNKLSRQELVDILNRVVPGEFDFVYLRFDFKNCCNVGYAFVNFCSVQSLLRFIQARVGKKWNLFSSEKVLQVSYADIQGKLALINKFRNSAVMGVIEPWRPQIFYSSGTLKGQPEPFPDSDNLAVRERSGLSQTSIFSTQPSSLFHSQHRPYDYTSASFDHSF

SEQ ID NO: 13207 - protein, 331 aa, Lentisphaera araneosa HTCC2155
MSMPAEWHPQSAIYLAWPCSEKLWPNSRPHIFAEFAKLVETIAPHTAVKILCEKSHQDQALAHLSTRDNITLIDIKTDDVWIRDYGPIFTYSQSDQTQLLSWQFNAWGGKFADFVNDNAVAQQIADHSSLQLTKSKFNFEGGAIDTNGAGLGITTKSVIHNINRNPAEQQADVTQAIKTHYGLDELIILDDGLINDDTDGHIDNITRFFKERGILTCTCDATNPNYTQLQANLKELEKFRTPNGEGLEILELPLPDPIFHEGEILPASYTNFLISNKAVFIPSFDQKENDLRAQNIIQNCFPNKKIIPIDCRIFILEGGAIHCLSQQEISP

SEQ ID NO: 13208 - protein, 393 aa, Carnobacterium maltaromaticum
MTVLSEKFNQQTYKIEVSDIRRFDERVSVIEDMLKLTLGEPDFNTPEHVKLAGISAIENNDSHYTGMAGDLELRKAVATFMQKKYQVSFAPENEILVTVGATEALSASLLAVLNPGDKIIVPTPIYPGYEPLITLARAEPIYIDTTSNGFVLTPEIIEAAMLEHGDQVKAIILNYPSNPTGVTYNREEVKAIADAVKKYSIFVISDEIYSELTYGETHVSIAEFARDQTILINGLSKSHAMTGWRIGFILAPQELIGQIVKVHQYLVTSATTMAQKAAIAALTAGADDALPMKIEYMKRRDFLYEKMKNLGFEIARPNGAFYIFAKIPDGYTQNSMNFCVDLAEKNKLAIIPGSAFGAAGEGFVRLSYAASMEKLELAMERLTAYMATNKPTP

SEQ ID NO: 13209 - protein, 97 aa, Arctium lappa
ATYKVTLITPEGKQEFEVPDDVYILDHAAEEVGDLPYSCRAGSCSSCAGKVTAGSVDQSDGSYLDDDQMEAGWVLTCVAYPTSDVTIETHKEEELTA

SEQ ID NO: 13210 - protein, 338 aa, Xylella fastidiosa 9a5c
MSVALSIDLSKKKTILCFGEALIDMLAQPPVKKGMPRAFLQCAGGAPANVAVAVARLGGAVQFVGMLGRDMFGDFLFDSFAEAGVVTDGIVRTSAAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTARGQVPTFRVQVQDSNAAGDAFVGGMLYTFAQQFDDAAALIDFCHDPESIASMLRFAAAVGALAVTRHGAFTAMPMLSEVLSLIQEQS

SEQ ID NO: 13211 - protein, 341 aa, Streptomyces coelicolor A3(2)
MSGDDGTPGNSGYGKKAFKRSRSHFADRITADGRDGWPVEAGRYRLVVSRACPWASRALVSRRLLGLEDALSLAVADPVQDDRSWRFTLDPDGRDPVLGIRYLGEAYDRRETGYPGGVSVPAVVDVPSGALVTNDYQQITLDLATEWTALHRPGAPDLYPRALRDEIDEVMAGVYEDVNNGVYRAGFATGQEEYEAACAGVFRRLEQLTPRLERQRYLVGDTITEADIRLFTTLVRFDAVYHGHFKCNRWKLTENPVLWAYVRDLFQTPGFGDTVDFDHIKRHYYQVHTGINPTGIVPLGPDLAGWLTPHHRQELGGRPFGEGTPPEPVRAEEEVPARGRP

SEQ ID NO: 13212 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGFYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIAAIERSLVELGYREARLGQGLEAAQKELSSLGL

SEQ ID NO: 13213 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVDESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGIYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIAAIERSLVELGYREARLGQGLEAAQKELSSLGL

SEQ ID NO: 13214 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGIYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIAAIERSLVELGYREARLGQGLEAAQKELSSLGL

SEQ ID NO: 13215 - protein, 473 aa, Bdellovibrio bacteriovorus HD100
MQNFDVVVIGAGPGGYVAAIRSAQLGFKTAVIEREFLGGVCLNVGCIPSKAMITATHLLHKAQHNFKEMGLNIKGGIDVDMKQLVKWKQSVSDKMSGGVNQLLKGYGVTIIKGDAEFKSSKEISVKSSAGTESVQAKYFVVATGSRPIEIPGFKFDEKDICSSTGALAFDTIPKRVAVIGGGYIGLEISSYLRKLGTEVTVIEAQSALLAGVVDPDCAQIVTRKLTKAGVNVLYGAKAKGQKKVKDGYEVTVEINGKDEVVKCDKILVTVGRRPNGDQANLKAAGIQVDERGFVKVDAQRRTNVSNIFAIGDIAGQPMLAHKASHEGVLVAEVIAGHNRVYDAKTVPAVVFTDPEIAAAGMTEAEAKAKGHTDLLISKFPFAANGRAVSMMETDGFVKMIADKKTHVLLGVHIVGPEASNLISEAVLAIEMGARIEDLALSIHPHPTLGETMMEAAEATLGHAIHIIQKPLKA

SEQ ID NO: 13216 - protein, 543 aa, Bdellovibrio bacteriovorus HD100
MNNERNSRNMATDVKLPELGEGVTEGELVKWLVKPGDAVKADQAIAEVLTDKATVEVPSPVAGVVKDLKFKSGDVVKVGATMITLDGAGAAKPAAAQPAAAAPAPAASTPAPAAGGGKAQDVKLPELGEGVTEGELVKWLVKPGDSVKADQAIAEVLTDKATVEVPTPVAGVVKELKFKSGDVVKVGSTMIILEGAGGAAAPKAAPAAAAAPAPAAAPATKAAAPVATASSDIFPPVADSKVLATPATRRLAREMGVDINSLTGTGLAGRVTREDVMSSGGGAAPAAAKAAPAAASMTIPKPAYQGPAGAAEERVPMIGIRKKIAENMQRSKHVIPHFTIMDEAKVDAMVALRESLKEHAEKNGTKITYLPIIMKALIATIREFPMFNASIDDAAGEIVYKKYFNLGFAADTPNGLVVPVIKNADQKSILEISKEILDLSKRARDGKLKPDEMKGATITVTNIGSIGGTYATPVINHPEVAILGMYKIDEKVVLKNGQVSAIKVMNYTMTADHRLIDGAVAARFLAAFIGRIENPGKLLVELI

SEQ ID NO: 13217 - protein, 209 aa, Bacillus cereus E33L
MKTSEWIDISQPLNNDIATWPGDTPFSYEVSWSKEESGSVNVGKLTMSIHTGTHIDAPFHFDNEGKKVIDLDVQVYVGPARIIDVSNLESIGKKELENFHLEGVERLLLRTSSHGKANEFPDVIPHLRADIAPFLSEKGIRLIGVDVPSVDPLDDKELAAHHQLFKHGIHILENVVLDHVADGDYELIALPLALSDADGSPVRAVIRPI

SEQ ID NO: 13218 - protein, 317 aa, Streptomyces coelicolor A3(2)
MRDIAVFSGSAHPDLAEEVCAQLGVPLSPTRVSRFANDCLEVQLMANCRERDVFLVQPLVTPVQEHLVELLMMCDAARGASAGRITVVMPHYSYARSDKKDAPRISLGGRLVADLLVAAGASRVLAMTLHSPQVHGFFSVPVDHLHALRELAAHFRQYDLSRATVVSPDLGNAKEAAAFARMLGAQVAAGAKQRYADDRVSISSVIGDVAGRDVIVLDDEIAKGSTVLELLDRLRESGPRTIRLACTHGLFAAGALGRLSEQPDVLEIVCTNTVPVPADDHTDKLRILSIAPALAEAVRRIHNGESVSALFDARPAG

SEQ ID NO: 13219 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDKAGDVDVVFVQHVETSTSVANPVREIAGVVKKNGARLVVDGIASVGGMDLRLDEWGVDVALTGSQKALSTPPGLAIVSFSSEYSVELEKREPSGIYFDFLSLSREMESTRNYHITPAVNLVFALNASLKRILSEGLENRFERHRILARAFTSAMEALGLRLVAEEPFRAWTVTAVYLPQGIDWSRFYSAMRKRGVEIAGGLGGLKGKIFRVGHMGEVDANDLIATIAAIERTLVELGYREARLGQGLEAAQKELSSLGL

SEQ ID NO: 13220 - protein, 174 aa, Oryza sativa Indica Group
MLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 13221 - protein, 158 aa, Triticum aestivum
IVKDQLVENSERSHFDEKTNHLHGSAPIGEKVERHARNRDRPDRGVWAPRRYDKSTSGGGSHASSSDFPQIQSHSGDNVSQIADGHGDRKTDTRGHGGSRGVPVENGHRHANRRGPPRGPKETEISASVPDGKNSKRGSASYGAHERQVWVQKSSSGS

SEQ ID NO: 13222 - protein, 2145 aa, Saccharomyces cerevisiae
MPVLKSDNFDPLEEAYEGGTIQNYNDEHHLHKSWANVIPDKRGLYDPDYEHDACGVGFVANKHGEQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRNVPVDSTILGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLFLVDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRKMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPVGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYGRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRDYKLLKELASQV

SEQ ID NO: 13223 - protein, 314 aa, Erythrobacter sp. NAP1
MPPVGFGLWKIPREDTAASVVEAVKAGYRHFDSAADYANEAETGQGLAQAMTDGLVARDELWITSKLWNTFHAPEHVEEACRKTLADLKLDTLDLYLIHFPIALEYVPIETRYPPEWLHDPDAAEPVMMPAKVPLHETWAAMEALVDKGLVKQIGVCNYNSALVHDLMTYARIKPAMLQIEAHPYLTQEKLIRCAKGYGIDVTAFSPLGAQSYFELGMADEGESLLGAAPVMVAAQAHGKTPAQVLLRWGVQRGTAVIPKTSKPERMRENLDIFDFELSSVEMAAISALNQDRRFNDPGVFTEAAFNTFHPIYD

SEQ ID NO: 13224 - protein, 438 aa, Yarrowia lipolytica CLIB122
MPVEKLHARYVYDSRGNPTVEVDLTTQHGLFRAIVPSGASTGVHEALELRDKDASKWGGKGVLKAVQNVNEIIAPAVIDAKLDVKDQAAFDKFLLELDGTENKSKLGANAILGVSIAAARAGAGEKGVPLYEHIASLASSPQPYVLPVPFLNVLNGGSHAGGRLAIQEFMIAPTEFESFSESLRAGTEVYHELKKLAKKEYGASAGNVGDEGGVAPDIQTAEEALNLITEAIDAAGYTGKIKIAIDAASSEFYNEEANKYDLDFKNPDSDKSLWKTGEELAAYYSELIKKYPIVSFEDPFAEDDWAAWSHFVSTTDIQIVGDDLTVTNPVRIKRAIEEKSANALLLKVNQIGTITESIQAANDSYDAKWGVMVSHRSGETEDVTIADLAVGLRAGQIKTGAPSRSERLAKYNQLLRIEEELGDKAIFAGPKFHLSRAI

SEQ ID NO: 13225 - protein, 365 aa, Desulfovibrio desulfuricans G20
MTAGDFCSIFPPVIFYAHRLRSGAAEQESDMHILVTGAAGFIGFHLSRRFLAEGHTVVGLDCLNDYYDVQLKKDRLALLQQEKGFTFTPTDLADDAAMDALFAREQFTHVVNLAAQAGVRYSIENPRSYIQSNLVGFGNIIEGCRHNGVKHLVYASSSSVYGLNTNMPFSVHDNVDHPISLYAASKKANELMAHTYSHLYRLPTTGLRFFTVYGPWGRPDMALFLFTKAILEGKPINVFNEGHMRRDFTYIDDIIEGVVRVTMRTPEPNPQWDGTAPDPSSSPAPYRIYNIGNNNTVELGEFIATLEECLGKKAVKNMMPMQPGDVEATYANVDDLIADTGFKPGTPLKEGIANFVSWYREYYKK

SEQ ID NO: 13226 - protein, 445 aa, Bacillus sp. SG-1
MGIEKMKMPQLGESVTEGTITKWLVSPGDQVNKYDPIAEVNTDKVNAEVPSSFTGTIKELIAEEGDTLEVGEFICSIEVEGAGSADEEAPAQETPASDDSAAKEDKQEEKKPVKKADKAQGKVRFSPAVLRLSQEHDIDLDQVEGTGRDGRITRKDLQKLIDSGNIPKAGDAKPAAPAKEEPKQAPVQEAPAPAAAAPSKPAAPAPNVPVMPGDVEIPVTGIRKAIAANMLRSKHEAPHAWTMMEVDATNLVGYRNTIKGEFKQREGYNLTFFAFFVKAVAQALKEFPMINSMWAGDKIIQKKDINISIAVATDDALFVPVIKNADEKTIKGIAREITELAGKVRSGKLKSEDMQGGTFTVNNTGSFGSVQSMGIINYPQAAILQVESIVKRPVVMDNGMIAVRDMVNLCMSLDHRVLDGLVCGRFLQRVKEIIENISKENTSIY

SEQ ID NO: 13227 - protein, 485 aa, Dioscorea caucasica
MAIKSFALVFLFLFFVSRCSGECEDPQRRRRRRLNAARQCRLQQLSPSRPSQRIEAEGGVTEFWDEREDQLQCSGVSARRHIIRSRSMLVPLFENAPGVLYIQQGKALVGISAPGCPESFHSGQRSPRSFEEGSSQQFQTDSHNKLYRVRQGDIMILPAGTTHWCYNDGDQDLIAIAVFDLNNQANQLEPSLRTFLLAGNFQEQSSSAGQQYEQEKDPQRSSPRDNIIRAFDQQMISEALNIPQDIVRQMQRSDKRGHIIRVEQGLSHVWPEEQEEQEECMDEARPKESQFANGLEEAICYARVQYNLDRPEEDSDVYSRQAGRLKSVDLNKLSALRFVDMSVEKINLRPGAMFVPHWTMNAHTIMYVTRGEGQVQVVDNRGRNLFNGRVRQGELIVVPQYYVTMMKAGRNGFEWVSFKTAGMPVRNPLVGQFSMFRGVPVQVIANSYRISIGQARQLKQCRQQHFMLFPPTSSSASSDATVASA

SEQ ID NO: 13228 - protein, 540 aa, Vitis vinifera
MPLPHQKPVAVANFQSTEAGGRPSHLETSILNLNNENWIAWVPCYAVRRVYIWLVTVHGDSGTYRGFYPIQVLFLSFSLRHSTEYYWRKIKDKLTRSFRRLFFPEPDTLALIGMASHHPSELDSVASDSVASSPRSDYPTHDIQPRVRFMCSFGGKILPRPHDNQLRYVGGDTRIVAVHRATTFSGLLLKLSKLSGTTNISVKYQLPNEDLDALISVTTDEDVENMMEEYDRLALSGIGLKTARLRLFLFPSDDGSRASSISSLLDGSSKRENWFFDAINGGGLERGRSEASSIVSEVPDYLFGLDNSDDIQALPRESKLKTRTALAENVSVSDPGSPAPAITSPFCSTSSGPSVPAIPDLPPVKTKPDKSIPPVEVKDNPPEGFADVIEPAVPQSGGYAGNPMWHYNPDSHYPGQPVHQIPVYYVPGPVPPGNMPVQSVPVRPQYVPQYPGPPGQIPVGFRHPGPGMGQVYGGAIRAVGPMEGYDMPMRVVSDGMNQQVYYGVRTTGMVQAYPPGMVVPAGEEFQGNGSDKKPGRVSTT

SEQ ID NO: 13229 - protein, 292 aa, Geobacter metallireducens GS-15
MQHLIEKANTLMEALPYIRRFSGKTIVIKYGGHAMSDEALKKSFALDVILLKSLGINTVVVHGGGPQINETLKRYGIVSEFVRGMRVTDAATMQVVEMVLTGQVNKEVVGYLNQHGGRAVGLSGKDGSLLLCRKLLQEVKQGDGSLEKVDIGFVGDVVKVNQELIQTLEHGKFIPVIAPVGVGEDGESYNVNADLVAGRVAGALKAEKLILLTDVEGVKDKAGELIPGIVLDDVPRLIDGGVITGGMIPKVTCCVDAIEEGVKKASIIDGRVLHAVLLEIFTDVGVGTEIRR

SEQ ID NO: 13230 - protein, 386 aa, Saccharomyces cerevisiae
MSAATVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 13231 - protein, 635 aa, Erythrobacter sp. NAP1
MTDFLVLATILLGVGVIAVPIATRLGLGSVLGYLIAGMAISPVLGALGVDVIQLQHFAEFGVVMMLFLIGLELEPRKLWEMRSRLIGLGGGQVLVTTLLIASTAIFIVGDPWQTGLAIGMILALSSTAIILQTLDEKGLMKSEGGQSAFSVLLFQDIAVIPMLAILPLLALPDLGGAELAADVAHAGGGHAGEAGDHGGGAGSLMDGMPAWQSGLITLGAIAFVALAGNYLTRPVFRFIASAGLRELFTATALLFVTGIALLMTVVGLSPALGTFLAGVVLANSEYRHELESDIDPFKGLLLGLFFITVGAGINFSLLATQWGEVLMWTAVLVVTKLAVLWVLGGIFKISGTARWLFALSLAQAGEFGFVLLSFAVGNSVIPQDTADLLLLVVAMSMLITPLLFILYDKVILPRFDREREFDAIEESRDIIVAGRGRVGGIVDRMLETAGYRTTVIDYSSSQIERLGRFGMRVYYGDATRPDLLASAGIDSAKLLVVAIDDKEATNRLVSYVHKAYPHVHIIARAYDRNHVFELWSLGCRDIIRETYDSSLRMGRSAYEALGLTREKAEDLVRVFEDMDREMMVPMANVWDADTPPWENEEMIALVKKLRSEWDPLLRDQMDQIMGRDDLDEAAE

SEQ ID NO: 13232 - protein, 399 aa, Geobacter metallireducens GS-15
MKSADWIAKGDKYIMKTYGRYPLVPVRGEGCRVWDADGKEYLDFLAGVAVNNLGHCHPKVVAALQKQAAEMIHCSNYYNIPTQIELAELLCSNSFADKAFFCNSGAEANEAAIKLARKYAREKTGDVERYEIITAIASFHGRTMATISATGQEKVQKFFDPLLHGFTYVPFDDADALEAAVTPKTCAVMLEPIQGEGGVVIPSADYFRKVREICDRHGLLLIFDEVQVGIGRTGKLFAHEHFDVTPDIMTLAKALAGGAPIGSMLAKDEVAASFSPGTHGSTFGGNPLVTAAGVAAVRAVLEEGLLNRAEEMGEYLVGELERLKEKYAFITDVRGIGLMIGMELSAPAGEIVLKGLERGVLLNVAQDKVLRFVPPLIVTKQEVNEMIAVLDGILEEIKQ

SEQ ID NO: 13233 - protein, 303 aa, Geobacter metallireducens GS-15
MTRHFLALNQYTKEALDALFALTRELKEEQKKGIPHRILEGKSVALIFEKSSTRTRISFEVGVHQLGAHPLFISSATSQMGRGEPVRDTARVMARYCDGVMIRTYGQEIVEEFARYSSVPVINGLTDLFHPCQIMADLFTVIEHKGKYDGLKFAWVGDGNNMANTWIEAAAILGFDLALACPEGYEPDRTVWDWAQKKATSSITITRDPKEAVRDADVVNTDVWASMGQEQEQKVREVAFKGYCLDDDLVALAKPDCMVLHCLPAHRGEEITDSVIEGPRSAVWDEAENRLHVQKAIMASLLK

SEQ ID NO: 13234 - protein, 547 aa, Bacillus halodurans
MSVMFDPQSYPYPSRRNVVYAKNGMVATSQPLAAQAGLDILKAGGNAIDAAIATATALTVLEPTSNGIGSDAFALVWTKGKLHGLNGSGRAPMSLTMEAVKAKGYEQELPPYGVIPVTVPGAPGAWAELAKMYGNLPLAASLAPAIRYAEEGYPVTPTLAKYWKAAYDRVKTEWTDDVYQPWFDTFAPKGRAPRVGEVWRSQGHADTLRSIAESNGESFYRGELADQIHAFFDKHGGYLTKEDLACYRPEWVEPISIDYRGYRVWEIPPNGQGLVALEALNIVKGFEFYHKDTVDTYHKQIEAMKLAFVDGMKYVTEPSDMSVSVEQLLSDEYATERRKEIGEQALTPEPGTPPRGGTVYLATADGDGNMVSFIQSNYMGFGSGVVVPGTGIAMQNRGHNFSLDPNHDNALKPGKRTYHTIIPGFLTKNDQPIGPFGVMGGFMQPQGHMQVMMNTIDFGLNPQAALDAPRWQWTNGKQVQVEPTFPVDIAQALVRRGHKIQVVLDEGAFGRGQIIWRDPTTGVLAGGTEPRTDGQVAAWEGHHHHHH

SEQ ID NO: 13235 - protein, 199 aa, Photobacterium profundum
MSPITDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAKGKRYCLPNSRVMIHQPLGGFQGQASDIQIHAKEILTIKHRLNSLLAKHTGQPLEVVEGDTDRDNFMSADQAVEYGLVDSVLTQRD

SEQ ID NO: 13236 - protein, 216 aa, Lentisphaera araneosa HTCC2155
MMMKLFKLLVLALFIVGCQSSDSSKETQAEMTPVPNKPSKPYSHPVVKITSSKGVMIAELYEDKSPNTVANFVSLTESGFYNDMHFHRVIRGFMAQGGCPYSRSNDKTRKRPGTGGPGYSFNNETHPQLRHSQKGILSMANSGPHTNGSQFFILFKESSFLNGSYNVFGRVIEGLDVLDKIEAIGAQRDGFPLKEKVTFSVELLQKNDHLYKVKKN

SEQ ID NO: 13237 - protein, 338 aa, Streptococcus pneumoniae TIGR4
MTNSVFQGRSFLAEKDFTRAELEYLIGLSAHLKDLKKRNIQHHYLAGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTVQENFGRLEGLTLVYCGDGRNNVANSLLVTGAILGVNVHIFSPKELFPEKEIVELAEGFAKESGAHVLITEDADEAVKDADVLYTDVWVSMGEEDKFAERVALLKPYQVNMDLVKKAGNENLIFLHCLPAFHDTHTVYGKDVAEKFGVEEMEVTDEVFRSKYARHFDQAENRMHTIKAVMAATLGNLYIPKV

SEQ ID NO: 13238 - protein, 246 aa, Triticum aestivum
NKFVQKSRLVPVRNSRDIVDPRVRISVFLLVGVIFVPIGVASLLASNKVVEIVDRYDDACVPSNVTDKLAYIQNSTISKTCRRTLKVPKDMKQPIFVYYQLNNFYQNHRRYVKSRNDQQLRDASKANETTLCDPEKTRDGMAIVPCGLIAWSTFNDTYTFQHNTNNLSIDKTDISWKSDRDHKFGSDVFPKNFQKGPLIGGKTLNESIPVCFWVSIPLCIIRLLLHMWLTSNNCSGVLWLSNLKIN

SEQ ID NO: 13239 - protein, 175 aa, Lentisphaera araneosa HTCC2155
MSNPRVKIITDKGTMIAELFEDKAPNTVANMIELAESGFYKDLRFHRILKGFMAQGGCPNTKKDAESGSPGTGGPGYTFDNEHHPEAKHDARGILSMANAGPNTNGSQFFVCFGATPFLDGGYSVFGQVVEGLEVIDALEAVGSAQDPIPPSEKVYFSIEVESKGDKDYKVSKNG

SEQ ID NO: 13240 - protein, 98 aa, Bryopsis maxima
ASYKVTLKLDDGSEAVIDCDEDSFILDVAEEEGIDIPFSCRSGSCSTCAGKIEGGTVDQSEQTFLDDDQMEEGYVLTCVAYPTSDCTILTHQEEEMIG

SEQ ID NO: 13241 - protein, 479 aa, Nocardia farcinica IFM 10152
MSVLDADKSRNQGSESHEESSDYLARRQLKRGSAGWLLLAGLGVSYVISGDYSGWNFGLEQGGFGGLAIAAVIIAGMYLAMVLGMAEMSSALPAAGGGYTFARRALGPWGGFATGTAILIEYAIAPAAIATFIGAYVESLGLFGIQEGWWVYLAVYAIFIGIHLSGVGEALKVMFVITAIALVGLIVFVVAAIGEFDPANLTDIPVSDAAGASSVLPHGYLGIWAAIPFAIWFFLAVEGVPLAAEETKNPERNVPRGIVAAMGVLLVTCALVLVLTTGAGGAEAMQSSGNPLVEALGDSGAAKVVNYIGLAGLIASFFSIIYAYSRQLFALSRAGYLPKSLSVTNSRKAPVLALIVPGAIGFGLTFTGQGSMLLNMAVFGAALSYVLMMTSHIVLRRREPGMARPYRTPGGIATTGFALVVAAFAVVATFLVDTAAALCCLAVFAAFLAYFGLYSRHRLVANSPDEEFAVLARAEEELE

SEQ ID NO: 13242 - protein, 397 aa, Legionella pneumophila str. Paris
MSQFPRIKRLPPYVFNTINQLKMEARARGEDIIDFGMGNPDQPTPPHIVNKLIEVAQRPDTHRYSMSKGIPRLRRAMATWYLRHYDVHLDSETQILATIGSKEGLAHLALAISGPGDTVLVPDPAYPIHTYGFIIAGANVKQIPLIDEVQFLAAVEDAINRTWPKPKALVLNFPANPSTHCVEYEFFEKVVDLAKRNNIWIIHDLAYADIVFDGYKAPSILQVPGAIDIAIETYSMSKSYNMPGWRVGFACGNEELVAALTRIKSYLDYGTFTPIQVAAITALEGPDDCVLEIRNLYEKRRNLLCDGLNDIGWEVSKPKGTMFVWAPIPLNYRAMGSLEFSKYLLKEAQVAVSPGIGFGQQGDGYVRFGLIENKDRIRQALRNLKALFKRDGLLKAI

SEQ ID NO: 13243 - protein, 680 aa, Zea mays
  misc_feature (673)..(673): Xaa can be any naturally occurring amino acid
MRSPSPPPWRLRRIRFAFPMLLVVASLAGADDLASDARALVAFRDAVGRRLAWNASDVAGACSWTGVTCEHGRVAVLRLPGATLSGTVPAGTLGNLTALHTLSLRLNGLSGALPADLSSAAALRNVFLNGNRLSGGFPQAILALPGLVRLSLGGNDLSGPIPTELGNLTHLRVLLLENNRFSGEISDVKLPPLQQFNVSFNQLNGSIPASLRSQPRSAFLGTGLCGGPLGPCPGEVPPSPAPAGQTPSPTPVPSGSGGGGGTNGGSGVENGHKGKKLSGGAIAGIAIGSALGAALLLFLLVCLCRRSGGIRTRSLEMPPSSPAPAGGRKPPEMTSAAAVAPLTTIGHPNAPIVQSTSGKKLVFFGSSAAVASFKLEDLLRASAEVLGKGTFGTTYKAVLESGATLAVKRLKDVTLSEPEFRERISEIGELQHEFIVPLRAYYYSKDEKLLVYDFMPMGSLSAVLHGNVSSGRTPLNWDLRSSIALAAARGVEYIHSTTSTASHGNIKSSNVLLGKSYQARVSDNGLTTLVGPSSSSSRTTGYRAPEVIDSRRVSQKADVYSFGVLLLELVTGKAPSQAALNDEGVDLPRWVQSVNRSEWGSLVFDMELMRHQTGEEPMAQLVLLAMDCTAQVPEARPSMAHVVMRIEEIKKSSVTPNIEQVDDQSSKAESEAXPTNPFAS

SEQ ID NO: 13244 - protein, 98 aa, Bumilleriopsis filiformis
ETYSVTLVNEEKNINAVIKCPDDQFILDAAEEQGIELPYSCRAGACSTCAGKVLSGTIDQSEQSFLDDDQMGAGFLLTCVAYPTSDCKVQTHAEDDLY

SEQ ID NO: 13245 - protein, 330 aa, Legionella pneumophila str. Paris
MVNSIFSKLSIAPMIDWTNSPFRTLMRLLAPNALLYTEMQTTGAVQNNPGRALYFNSVEHPIAIQLGGADKSALVKCAIIAEQKGFNEINLNLGCPSDKVQAGRFGACLMREPEHVADCIRAIKEVVGIPVTAKTRIGIDNQDSYEFFRSFSLHLVEAGCDKLIVHARKAWLNGLNPKQNRTIPPVNYDYVYELKKEIPHIFITINGNILTIEEINSHLMYVDGVMLGRLACDNPYQIAEIHQALYPEFIKIKRSQLLMNYLDYWFDQSPANLSLSILVKPLFNLAFGLPGAKHWKKKLMNIIQEKNTSGFSELIQYLLNLEAINQVEFV

SEQ ID NO: 13246 - protein, 382 aa, Aeropyrum pernix
MARLLMIPGPTPVDPGVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDKAGDVDVVFVQHVETSTSVANPVREIAGVVKKNGARLVVDGIASVGGMDLRLDEWGVDVALTGSQKALSTPPGLAIVSFSSEYSVELEKREPSGIYFDFLSLSREMESTRNYHITPAVNLVFALNASLKRILSEGLENRFMRHRILARAFTSAMEALGLRLVAEEPFRAWTVTAVYLPQGIDWSRFYSAMRKRGVEIAGGLGGLKGKIFRVGHMGEVDANDLIATIAAIERSLVELGYREARLGQGLEAAQKELSSLGL

SEQ ID NO: 13247 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDKAGDVDVVFVQHVETSTSVANPVREIAGVVKKNGARLVVDGIASVGGMDLRLDEWGVDVALTGSQKALSTPPGLAIVSFSSEYSVELEKREPSGIYFDFLSLSREMESTRNYHITPAVNLVFALNASLKRILSEGLENRFERHRILARAFTSAMEALGLRLVAEEPFRAWTVTAVYLPQGIDWSRFYSAMRKRGVEIAGGLGGLKGKIFRVGHMGEVDANDLIATIAAIERSLVELGYREARLGQGLEAAQKELSSLGL

SEQ ID NO: 13248 - protein, 207 aa, Burkholderia thailandensis E264
MANPSTVSRAMPFNFPIFLTWVRIVLIPLVVGVFYLPDTMLSADHRNLAAAVIFILAALTDWFDGYLARKWNQTSAFGAFLDPVADKLMVTAALLMLVQLARIDAAIALVIVGREIAISALREWMAQIGASKSVAVNSLGKFKTACQMVAIPMLLFYGRLPFGGGVAIDTRVWGEWLIYLAAVLTIWSMLYYMKLAWPQIRERGGAA

SEQ ID NO: 13249 - protein, 362 aa, Burkholderia thailandensis E264
MATPQFHPLRIRDVRPETADAVTVSFEVPPELRDAYRFTQGQFVTLKAHVDGEETRRSYSICVGTTDYDRDGELRIGIKRVRGGRFSNFAFDTLKPGHTIDVMTPDGRFFTHLNAEHGKQYVAFAGGSGITPVLAIVKTTLELEPRSAFTLIYGNRSVDSIMFAEELEDLKNRFMQRFALYHVLSDDVQDVELFNGVLDQAKCAAFIESLVPAATIDEAFICGPAPMMDAAEAALAEAGVPRERVHVERFGTPLPQAGAPAVEITDDTPAADLEIVLDGKKRKLRLPYEGVSLLDVGLRAGLALPYACKGGVCCTCRAKVLEGEVWMEKNYTLEPQEIADGFVLTCQCHPVSEKIVVSYDER

SEQ ID NO: 13250 - protein, 336 aa, Gossypium hirsutum
MESDTIECVSSIDEIVEDHEIPHHNLLHHPHPRHAPHHQFSSSKPHHNGTNNVNSISNIVGPTAIAPAASVHELLECPVCTNSMYPPIHQCHNGHTLCSTCKIRVHDRCPTCRQELGDIRCLALEKVAESLELPCKYYKLGCPETFPYYSKLKHEGICIYRPYNCPYAGSECSVVGDIPFLVAHLRDDHKVDMHTGCTFNHRYVKSNPREVENATWMLTVFHCFGQYFCLHFEAFQLGMAPVYMAFIRFVGDETEARNYSYSLEFGANGRKLIRKSAPRSIRDSHRKVRDSHDGLIIQRNMALFFSGGDRKELKLRVTGRIWKEQQNPDANMCIPN

SEQ ID NO: 13251 - protein, 382 aa, Aeropyrum pernix
MARLLMIPGPTPVDPGVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDKAGDVDVVFVQHVETSTSVANPVREIAGVVKKNGARLVVDGIASVGGMDLTLDEWGVDVALTGSQKALSTPPGLAIVSFSSEYSVELEKREPSGIYFDFLSLSREMESTRNYHITPAVNLVFALNASLKRILSEGLENRFERHRILARAFTSAMEALGLRLVAEEPFRAWTVTAVYLPQGIDWSRFYSAMRKRGVEIAGGLGGLKGKIFRVGHMGEVDANDLIATIAAIERSLVELGYREARLGQGLEAAQKELSSLGL

SEQ ID NO: 13252 - protein, 398 aa, Chlorobium limicola
MAKILEGPAMKLFNKWGIPVPNYVVIMDPDRLAQLGEANKWLRESKLVVKAHEAIGGRFKLGLVKIGLNLEQAIEAAKEMLGAKVGTAEIGQVIIAEMLEHDAEFYVSIIGNKDGAELLISKHGGVDIEDNWDSVRRIQIELDENPTIEQLTELAKDAGFEGEIAERVGKICSRLILCFDNEDAQSIEINPLVIRKSDMRFAALDAVMNVDYDARFRHADWDFKPVSEIGRPFTEAEQQIMEIDSRIKGSVKFVEVPGGEIALLTAGGGASVFYADAVVARGGTIANYAEYSGDPADWAVEALTETICRLPNIKHIIVGGAIANFTDVKATFSGIINGFRESKSKGYLEGVKIWVRRGGPNEAQGLAAIKQLQEEGFDIHVYDRSMPMTDIVDLAMKS

SEQ ID NO: 13253 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVALTGSQKALSTPPGLAIVAFSSEYSAELEKREPSGIYFDFLSLSREMESTRNYHITPAVNLVFALNASLKRILSEGLENRFERHRILARAFTSAMEALGLRLVAEEPFRAWTVTAVYLPQGIEWSRFYSAMRKRGVEIAGGLGSLKGKIFRVGHMGEVDANDLIATIAAIERSLVELGYREARLGQGLEAAQKELSSLGL

SEQ ID NO: 13254 - protein, 281 aa, Zea mays
  misc_feature (249)..(249): Xaa can be any naturally occurring amino acid
HTYLRTGAFSPPGLPFTPGKEGAGEVVAVGDGVTEFARGDRVAYVETLGAYAEQCVVSEHFLVHLPEAIDFETAAASMLKGLTAQYLLRRTFRVEPGHTVLIHAAAGGVGLILSQWAKHLGATVIGTVGTPEKAEAAAQYGCDYVINYGEENFAERVREITQGEGCDVVYDGVGKATFPASLDCLKPMGCFVSFGVSSGPIESFNIMMLAEKGSLYATWPVLTQYLAKREDILSMSQELFDVIGSGAVXIRIHDRLPLAEAATAHRLIESRKIVGGTVLLP

SEQ ID NO: 13255 - protein, 497 aa, Magnaporthe grisea 70-15
MNIQLSAPNGKKWIQPTGLFINNEFVKSSNGQKLTTVNAATEEDITSVYSATEEDIDKAVKAARAAFKHPSWRNLSGTERGEMMHKLADLVVKNAETLATIEALDGGKPYSVALGEDVVEFEKTIRYYAGFADKNFGQTIDVGPNKFAYTIKEPIGVCGQIIPWNYPLCMAAWKLGPALACGNTVVLKLAEQTPLSMLYVATLIKEAGFPAGVVNVINGLGGEAGAAIVQHPDIDKVAFTGSTATGKQIMKACAGTMKNITLETGGKSPLLVFDDADLDLAAEWSHIGIMSNQGQICTATSRILVHESVYDKFVGRFKDTVEKVSIVGDPFDEKTFQGPQVTKAQYEKVLGYIKLAQEEGATIATGGKPAPQNGKGFYVAPTVFTNVKTSMRVYKEEIFGPCVSIISFKDEEEAVELANDTTYGLGAAVFTRNLTRAHRVAREIQSGMVWINSSNDSDCRVPFGGVKQSGIGRELGEAGLASYCNIKSVHVNMAAHL

SEQ ID NO: 13256 - protein, 125 aa, Zea mays
TAPEKPRMRGPKRASKFRKLFTLTKEDDVRKYVNTSPRPFLPKNGKKVTKAPKIHRLVTPLPLQRKRARIAAKKKGIIKKKFGAAESQKLFPQRRKEQRAPRSESLPKRGSKLFAPVKVFAPPFV

SEQ ID NO: 13257 - protein, 515 aa, Saccharomyces cerevisiae
MFQRKTLQRRNLKGLNLNLHPDVGNNGQLQEKTETHQGQSRIEGHVMSNINAIQNNSNLFLRRGIKKKLTLDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 13258 - protein, 451 aa, Nocardioides sp. JS614
MVDQATLEVPAQLRSDRGLPLVGRLFDYTRDPIGFFRHQWETYGPVSPFDSALDHAVVLLGPDACEQVLRNKDKAFANEPAWGKIVGPFFKRGLMLLDFDEHHAHRRIMQEAFTRDRLETYATRMHPAIAEGTASWDTERRFRSYPALKQLTLGIAADIFMGGAGDTSRAEMDRVNRAFIACVQAAAGIVRADVPFTRWGRAYRGRKVLEEFLRHYLPAKRATRTEDIFSVLCHIETEDGQRFSDEDVVNHMIFLMMAAHDTSTITTSTILQLLGQHPLWQERCRAEALALGPEPTLAELEGLQALDWVMKEALRLHAPVPILVRRTVKDTVVQGHLIPADTDVMVGVQFSHVMEDYWTDPMVFDPERFSPERREDRSHRYAWEPFGGGVHKCIGLYFAGIEVKAILHRLLRNHRWSVDPGYAAPYDNHSLPFAKDGQPIDLVRTDPRGES

SEQ ID NO: 13259 - protein, 215 aa, Mycoplasma pneumoniae M129
MLNLVVNREIAFSLLPLLHQFDRKLLEQFFADGLRLIHYDVMDHFVDNTVFQGEHLDELQQIGFQVNVHLMVQALEQILPVYLHHQAVKRISFHVEPFDIPTIKHFIAQIKQAGKQVGLAFKFTTPLVNYERLVQQLDFVTLMSVPPGKGGQAFNSAVFNNLKQAHKYHCSIEIDGGIKLDNIHQIQDDVNFIVMGSGFIKLERWQRQQLLKTNQ

SEQ ID NO: 13260 - protein, 227 aa, Mycoplasma pneumoniae M129
MRSPFPVPMVPLTIKTWQKKLPNWLTIYRIFIAVPTIIFLGLNHLLGSVASFTVLGNVTIHLQVSLFIGGVLFITAVISDYLDGYWARKWRVVSNFGKLWDPLADKVIINGVLIALVAYGYFHFSFLIVIVLRDLVLDGLRFYAQEKQLIIPANQWGKWKTTWQMIAILMSCFVFSFSLKETNSANTKIFYWAIVHLPYYLATAFSLVSFGIYAQQIYKTIKVKVKL

SEQ ID NO: 13261 - protein, 381 aa, Bacillus thuringiensis serovar konkukian str. 97-27
MERIYLDHAATSPTHPEVVEKMIPYMTETFGNPSSIHFYGRQTRHAVDEARRACARSIHANPNEIIFTSGGTEADNLALIGVARANRHKGNHIITTQIEHHAILHTCELLEREGFEVTYLPVDETGRVQVSDIQKALTEETILVSVMFGNNEVGTMQPIAEIGKLLKEHQAYFHTDAVQAYGLVEINVKEFGIDLLSISAHKINGPKGVGFLYAGTNVKFEPLLIGGEQERKRRAGTENVPSIVGLQHAILLAEKTREQKNAQYEEFKDIMVSVFQNEGITFEVNGNLEYRLPHVLNISFTGMNIEPFLVNLDLAGIAVSSGSACTAGSIDPSHVLVAMFGKDSDQIRSSVRFSFGLGNTKEQIEKAAYETVKIVKRLTQN

SEQ ID NO: 13262 - protein, 427 aa, Saccharomyces cerevisiae
MHHNSQSLSSGHIRSPEDENVAPIGNLKHRTGSLSHISSAHPRVALSDVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 13263 - protein, 284 aa, Bacillus sp. SG-1
MDIYEKINELYDRRREVELGGGDKRIEKQHEKGKLTARERIDILVDKGSFVELNPFIEHRSTDFGLDEMKGPGDGVVTGYGKVNGRPIYLFSQDFTVFGGALGEMHAKKIAHVMDLAVKNGAPFIGLNDSGGARIQEGVVSLDGYGHIFYRNSIYSGVIPQISVIMGPCAGGAVYSPAITDFVFMVDKTSQMFITGPKVIETVTGEKISSEDLGGSKVHNTISGNAHFRGETEEEVLHSVRELLSYLPQNNEEKPPMLKADEEDDYRPDLTDIIPFDAIRPYDV

SEQ ID NO: 13264 - protein, 209 aa, Enterococcus faecalis V583
MKDSQPIIIGVTGGSGSGKTSVSRAIFNNFPDHSIMMLEQDSYYKDQSHLSFEERLNTNYDHPFAFDTDLLIQHVEQLLNYQAIEKPVYDYVAHTRSTETVIQEPKEVIILEGILILEDRRLRDLMDIKVYVDTDDDIRIIRRIKRDMEERGRTLDSVIEQYLTVVKPMYHQFIEPTKRYADIIVPEGGENHVAIDLINTKVDSILTKM

SEQ ID NO: 13265 - protein, 338 aa, Mycoplasma pneumoniae M129
MSETKSKVLVLGGLGYIGSCFIDQLLKQYPDVTVSVIDINHTSLALQLLPRQVNVHFVNLLDRAQLTDTIAQINPDVVFHFAAKTSVKESTEQPLTYFDHNLVGTLNLLHALKELQKPIQLFFSSTAAVFGSASTLPIPENLVLEETLASNPYGISKFLSEIVLQTLTRSPHFQVIALRYFNVAGASNPFGNFNKNTTLLIPNLIKAFMEKRTFFLYGDDYDTKDGSCIRDYIHVVDLCDAHLLAWKWLQANPKVRFESFNLGSGQGFSNWEVINTAQAIFAPEQLQLKIESRRAGDPPVLVVDCTKAKRLLNFQPTRSLHKMLSDETIFYRDFYNRL

SEQ ID NO: 13266 - protein, 440 aa, Legionella pneumophila str. Paris
MVNTDQLIAKDLKHIWHPCSQMKDFETFPPIVVNKAQGSYLYTNKGPVIDAISSWWCKSLGHGHPAVIAAIKNQLDCFEHVISANTTHPAAVELAEKLSEITGKQHVFFASDGSSAVEIAMKLAIHASQIKGHKNKNQFIALKNGYHGETIGTMSVSDLGLYKTPYASFGVQCHFIDDIPYVSGLKDPLWTNCDAYWNNVVQQLNKICDKVCAILLEPIIQGAGGMLCYSADFLSKISSWAKEKDIYLIADEIMTGIGRTGEWLACDHARVQPDLICLSKGLTSGSIPFSCVMIDSTLFDLFYDDYHTGKSFLHSHTYSGNPLAIGAALATIKTIEQDNILMHSQELGKIMFSYLQDIARDSRKLVNVRGVGAVVAADLIESGQARIGFKIYQEAIKQGALIRPIGNTLYWLPPLNTDKEIIGKLAEITLNSIEKAYNKA

SEQ ID NO: 13267 - protein, 143 aa, Gossypium hirsutum
GCERTTEGYGCEEDDRRELKHESQCSYRPYSCPYAGSECTVIGDFPYLVAHLKDDHKVDMHNGSTFNHRYVKSNPHEVENATWMLTVFSCFGQYFCLHFEAFQLGISPVYIAFLRFMGDDNEAKNYSYSLEVGGNGRKMIWQG

SEQ ID NO: 13268 - protein, 422 aa, Bdellovibrio bacteriovorus HD100
MSEIISVISREILDSRGNPTVEVEVTTADGNMGRAAVPSGASTGAHEACELRDGDKNRFLGKGVYKAVDNVREKIAPEIVGLQATEQVYIDKILRDIDGTENKSNLGANAILGVSLAVAKAAAKDCRLPLYRYVGGSQASRLPVPLMNVLNGGAHANNGLDIQEFMIVPTVNNSYAESLRAGTEIFHTLKKILAKKGLSTAVGDEGGFAPKLGSNQEALDLLMNAIVDAGYDPGQNVFLALDVAATEMFKEGKYEWQGGHISPTELLGIYKSWAEKYPLVSIEDGFAEDDWDSWVQSTAQMGSTMQLIGDDLFVTNPKRLRMGLEKKAGNALLVKVNQIGTLTETYEAVNLAQRNKFRTIMSHRSGETEDVTIADLAVGLNCHQIKTGSLCRGERTAKYNQLLRIEEDLGGMGLYWDKAAFR

SEQ ID NO: 13269 - protein, 473 aa, Glycine max
MENYQYPASYPDSGESSPRSREIDFENPPPWDEQQNQNYKAKFMCSYGGKIQPRTHDNQLSYVGGDTKILAVDRSVKFSAFLSKLSAVCDSAPQDLTFKYQLPGEDLDALISVTNDDDLEHMMHEYDRLYRPNLKPVRMRLFLFTLSSSNPNSSFSSERDHFVEALNSGPIPSQPDPIKTPPVTPSNVDYLFGLDKAVAPPPNLPPNFAAVKFHDPVPEPVAPPVEYQSRGSDRVVGSDPNVNPIEIQRQLQQEMERLQIAENEYRRRSEDGFAAGYAAAAAAGGDYYMQKVQEKVPPQNAAAYWSEKQFSGEGYQTTVTTAPGGGDQPMYVMAPPGTFYHAPVVRPPAAAQGYYAVQRMGSEGYREQQAVYGGVAPSKAAFSSAGMAKGTAYSEGYGGGVVRPAGVPDNAAYAQVAYDSASGRQVYYTAQGGMVHAPPPPQYQGVPPQEFRPGGVSVGQDGKVVNKVNQGSA

SEQ ID NO: 13270 - protein, 97 aa, Colocasia esculenta
ATYKVKLVTPSGQQEFQCPDDVYILDQAEEVGIDLPYSCRAGSCSSCAGKVKVGDVDQSDGSFLDDEQIGEGWVLTCVAYPVSDGTIETHKEEELTA

SEQ ID NO: 13271 - protein, 507 aa, Cryptococcus neoformans var. neoformans JEC21
MASTQPPVAAPDQSKIRPQDVGWQFVPQYYNFVNSQPHRLHCFYNKRSTFIHGEEGEDVTPAFGQQEIHDRILQIGYNQCKVYIHSMDSQSSADGGIIILVLGELSNNHQSWRKFSQTFFLAEQPGGYFVLNDIFRYLREDVDEDESAPQETVQPQEEPAQPEVAAEKLPEATTVTQEPAEDPVPEPAPVSAPAEVVVDAVPEEAEIAAVPDKDVAPEQEPPVVKEPEAAPEPVEETPKPAASVTESIASPAPAAPIPAAKAASPSPAAPKAAAPTTNGSSPASTTPAAPSKPMTWASMAASNVWGKTASPSATAPAPAPAPAPAAAPAPGPAQPKKDEKPAPAAGTGQGQRRQQTIDPSKVQTAHCFVKLPNWSPDSQSSSDFLTDAELSKIASRFGEVKSTEIVKSKACAFVEFARVESARKAIQHSLPVEQGGEGGTKFPNGTLYFEPRKEKDDRPKAKGQRTGGQQGQGQGQRQVNGGAGGRGGRGPRGRGGQGNQGDRQPQK

SEQ ID NO: 13272 - protein, 355 aa, Prochlorococcus marinus str. MIT 9301
MSLSNTSANKNLPNSVPSERLWLRSELMGTQVITTDTGRRLGVVGEVVVDIDRREVVALGLRDNPLTRFLPGLPKWMPLESIKQVGDVILVNSLDSLSESFSPERYGKVINCQVITESGQLLGRVLGFSFDIETGDLISLVMGAVGVPLLGEGVLSTWEIPVEEIVSSGTDRIIVYEGAEEKLKQLSSGLLEKLGVGGSSWDEREVNGYSANLVPVENQLLSGSESEQQNNLVEEYEEVVEQDDYADDYEDDYEDDYEDELEYVEIKGSEEEINYRKKLYMENDDSDQIQNQNSVNQINEKNNIDLKQKQKSTTNLASKRPIQNATETLDIEPMNEQNLVQDNKKSEKFEIDDPW

SEQ ID NO: 13273 - protein, 473 aa, marine gamma proteobacterium HTCC2080
MYINGQWLEEGPTFEVYNPATGVSIGSVIDVSNEQVLDAVAAAEAAFPAWSKTTAYERSAILTRCHTLMMERQRTLAELMTSEQGKPLKAAMNEVKYAADFLLWFAEEAKRIYGETIPSARSDQRFLVHKQAVGVVAAITPWNYPISMLTRKLGPALAAGCTAVLKPAEATPLCAVAVFEILHEAGLPAGVANLVTVSDPKPVGEIFCTHRAIRKLTFTGSTAVGKSLAQAAAPQLKRVSMELGGHAPFIVFDDADPVHAAKGVSLVKFLNTGQACISPNRIFVQRKILDSFLDTLQGRIEKLHAGDGMEPSTTIGPLINHAAIEKIDRQVQDAVAQGASLHSGGRRLTEDGLEKGCFYSPTLLSNVSSDMLIYREETFGPVAAVIAFDDDDDVIAMANDTDYGLAAYVYTQNLSRALRTFEELNFGIIGINDINPTSAAAPFGGMKESGLGREGAREGLEEYLETKLGGLSI

SEQ ID NO: 13274 - protein, 94 aa, Arabidopsis thaliana
  misc_feature (66)..(66): Xaa can be any naturally occurring amino acid
FLAQCNARKAKESNPHCQVLVKRKTDEQPPQITVPFVNGVEEAFYAAATSGQLIKKMIFYKGQYFXTKQMFCETGEQWPVIIPDEKLFQKAPGV

SEQ ID NO: 13275 - protein, 480 aa, Rhodococcus sp. RHA1
MIEGLNLIDGQWVPSSSGATFERRNPADHDDVIGVFPDSTEADVDAAVSAVAKAAPQWAATPPERRAAILEAAAGHLEARTGDLVEELVREEGKTRAEATMEVGRTPMNLRFYAGEALRTTGSTYPTPGEGLVITLREPVGIVGAITPWNFPLNIPSRKLGPALAAGNVVVFKPSELTPLMGQRLVEALLAGGLPAGALALVQGSGRAGGAVAADERVDAVTFTGSTQVGRAIHAAVGPSRRSQLEMGGKNPVVVLGDADVDKAAALIVKGAFGLSGQACTGTSRVIAVDAIHDRLLDRVVELAEGITVGPGADPGVGMGALASKAQLAKFLEYVQIGRDEGAELVCGGASLDRGNGYFAVPTVFAGGSPDMRVVTDEVFGPLLVFLRASGFDEAVALANDTEFGLSAGIVTNDVTKALAFAGRSESGLVKINQPTTGMSMNAPFGGYKASSTQTHKEQAGDSMMQFYQAEKTVYLSPSA

SEQ ID NO: 13276 - protein, 527 aa, Streptomyces coelicolor A3(2)
MAQTAREPARDGLPKGFRSAELGWPELHRIPHPPYRLPLLGDVVGASRRTPMQDSLRYARRLGPIFRRRAFGKEFVFVWGAALAADLADEARFAKHVGLGVANLRPVAGDGLFTAYNHEPNWQLAHDVLAPGFSREAMAGYHVMMLDVAARLTGHWDLAEASGRAVDVPGDMTKLTLETIARTGFGHDFGSFERSRLHPFVTAMVGTLGYAQRLNTVPAPLAPWLLRDASRRNAADIAHLNRTVDDLVRERRANGGTGGGTGSGSGSGDLLDRMLETAHPRTGERLSPQNVRRQVITFLVAGHETTSGALSFALHYLAQHPDVAARARAEVDRVWGDTEAPGYEQVAKLRYVRRVLDESLRLWPTAPGFAREAREDTVLGGTHPMRRGAWALVLTGMLHRDPEVWGADAERFDPDRFDAKAVRSRAPHTFKPFGTGARACIGRQFALHEATLVLGLLLRRYELRPEPGYRLRVTERLTLMPEGLRLHLVRRTAAAPAPGRRTAAPGAADDAGDTVSAPGCPVHRAGD

SEQ ID NO: 13277 - protein, 530 aa, Rhodococcus sp. RHA1
MNPRPSTLSADGMVSSSHPAASTVGARVLADGGNAIDATLAMAAMTWLTLPGQCGIGGDAFAVVREPDGSVWTVGGSGFGPDGGDVDFYTERGLRSIPLDGALAVAVPGAPAALGALHAGGATRSLTDLWAPAVRAAEKGLPCSAKTRDDVREAQTAIAADPGLRAVYLPDGRLPQVGERLPQRDLALTIEALARDVHGFYTGSFAQQAVEALRAGGAPFGGDEWAAGADVRPEDAISGHYAGAVVHQTPLPTPGWMVLQQAALNDGVIGFSPWLTAPAVDRMARAARLAFEDRFATCGAGNDGWRAVLEPAAIGAARDRLDGRRASSGAFSVSTGDTTSTAAVDSDGRAVSFIHSLAFTFGAKTTVSGTGVVLNNRFGRGAYLIPGHPNAAAPRRKPLHTLNAWVITDTSGNLLHVGNTPGGDGQVQWNMQLISHLLDHGLDPAEAVAAPRFTVFPGSDADVIGRPAELRCESRIPEEVRTELERLGHDVALQGPWAAGGSAQIISLDVARGLLSGAADPRQEGIALGV

SEQ ID NO: 13278 - protein, 331 aa, Synechococcus sp. WH 8102
MTSFLTAARAEQEKLTPDTRRLRLFSGTSNPGLAREIAAYLGVPDGPRVCKRFADGELYVQIQESIRGCDVFLIQPTCAPVNDHLMELLIMVDACRRASARQITAVVPYYGYARADRKTAGRESITAKLTANLLVKSGVDRVLAMDLHSAQIQGYFDIPCDHIYGSPVLVDYLSTQNLDDIVVVSPDVGGVARARAFAKQMNDAPLAIIDKRRTGHNLAESLTVIGDVSGRTAILIDDMIDTGGTICAGARLLRQQGAKRVIACATHAVFSPPASERLSADGLFEQVVVTNSIPIQQERTFPQLQVLSVANMLGEAIWRIHEESSVSSMFR

SEQ ID NO: 13279 - protein, 520 aa, Candida albicans SC5314
MSRHHSFPLDYDSPPKHLTVHSYHSKYQTISSLGNGSFGTVDLAKIKFFKFDLLNSHKNKSGTLLCPLEDSKCNTSNLVAIKTMKKKLPLLQEYSNVKEVKFILSVPSHPCLVQIYEMFIDDIQYQLHISMEALNQNLYQLIRSRRNIKFSPVTLKSILSQLLCAIRHIHKCNYFHRDVKPENILVIPTLHFYGSKAAIPPYRKNDNFIIKLGDYGLARHVSNIKPYTAYVSTRWYRSPEILLRQKWYSRPIDIWAFGAVAVETANFVPLFPGSNELDQIWKILKILGTPFVPEPKAINASYVVPLGGYWTEALFLTNKLGIKLPDESGMSIEDIVQHPDSLALIEVIQSCLKWDPSARADATEIAKMQYFKESITMMDTYFETDTVSMNTALNKLAGIPNSPSRKLLTPSKLQKNSNGTCNTTGSVPVFQDSDDGYENYFGEYIAKQPERNSSGNESYKLFAQPWLLKVNEVLGTRESEMEPRRAGNEAHDLKKKSSKVAGTKRSFTTFSLDSEEVVNL

SEQ ID NO: 13280 - protein, 229 aa, Zea mays
FDDKPNDGTAAHVISRGGPVERGQIDEEGIREGEDLHRGLKARQISMIAIGGSIGTGLVIGSGSGLAKGGPVGLLIAYVIMGAMCFGVMCSLGEMATYLPHKKGFGGYASRFVDPSMGFALGWNYLMKYLVVTPNNITAGAIVVRYWTDKVPIGAWITIYIGGCFLVNLLGIEVFGEVEFWASFIKIIVLAGLILLGIIIDLGGAVVDRIGFRYWRGQPFSHYIFQNDT

SEQ ID NO: 13281 - protein, 311 aa, Geobacter metallireducens GS-15
MTARKYSDEELKQRLTPLQYRVTRKSGTEPPFDNTYWNEHREGLYVDIVSGEPLFSSRDKFDSGTGWPSFTRPVAPNSVKEETDIGFGTVRTEVRSKEADSHLGHLFTDGPRDKGGLRYCVNSAALRFIPVDDLEKEGYGSYLPLFGRKAPAAAVKQVATLAGGCFWGMQDLLRKQPGVIATEVGYTGGSVPNATYENHEGHAEAVRIEFDPTKTSYEALLRFFFRMHDPTTLNRQGNDIGSSYRSAIFYHDAEQKRIAEKVKAEVDASGKWKRPVVTEIVPAGPWWRAEEYHQDYLVKNPGGYTCHWVRE

SEQ ID NO: 13282 - protein, 799 aa, Ralstonia eutropha JMP134
MAINTTQLVWFEELRRADIWRVGGKNASLGELLASLTTHGIRVPPGFAIPVDAYWNFLEANGLRAVLSSTLSALASGKLTLSDAGQKMRRTILTGEWPRETAQAIGQAYATLNRRTGQSNVDVAVRSSATAEDLPEASFAGQLESYLNIRGEHALLDACRRCYASLFTDRAISYRQAKGINHLQIGLSVGVQRMVRSDLSGAGVMFSIDTETGFDKVVLINAAWGLGENVVQGDVDPDEYEVFKPLLSDLSLTPIVGKKLGTKARKLIYTSDSTCPTRNVSTTSGEREAFVLSDEEILTLSRWACAIADHYGQPMDIEWAKDGKTGELFIVQARPETVQSRRESSAIKTYRIKKAGMPLVTGVSIGDAIATGPICVIENLREMGRFVDGAVLVTRTTDPDWVPVMRRAAAIVTDQGGRTSHAAIVSRELGLPAIVGTGNATGVLHEKQDVTVSCAEGREGFVYEGIAEYEVEEIDFGSIPTTRTKVMLNLANPAAAFRWWRMPADGVGLARMEFVVSNHIKIHPMALARYDTLKDDTAKRTIAELTAAYASKTEYFVSRLARGLGRIAAVQYPRPVLVRMSDFKTNEYARLIGGAEFEPTEENPMLGFRGASRYYSPLYRDGFALECQAIVRLRKQMGLNNVIVMIPFCRSTKEADLVLEVMAENGIVRHKDGLEVYVMCEIPSNVILAKAFAQRFDGFSIGSNDLTQLVLGVDRDSANLAGLFDEEDDAVKWMIRNVITQAHEANAHVGLCGQAPSDHPDFAGFLVQCGIDSISVTPDSFLAVKRAVAAAEAAIASVR

SEQ ID NO: 13283 - protein, 460 aa, Bacillus licheniformis ATCC 14580
MTEDVTDNDIHEQKLSRGLKNRHIQLIAIGGAIGTGLFLGSGKSIHFAGPSILFAYLITGIICFFIMRSLGELLLSNLEYHSFVDFVRDYLGDMAAFITGWTYWFCWISLAMADLTAVGLYTQYWLPDVPQWLPGLIALIILLIMNLATVKLFGELEFWFALIKVIAILALIAIGLFMIFKGFSTHSGTAAFHNLWSHGGMFPNGLHGFLLSFQMVVFAFVGIELVGLTAGETKDPEKVIPKAINNIPVRVLLFYIGALLVIMSIYPWNVINPNESPFVQVFAAVGIIAAASIINFVVLTSAASASNSAVFSTSRMIYSLAKEHNAPGAMTKLTSRKVPGNALFFSAVVILIGIMLNYIMPEQVFTLITSISTICFIFIWGITVICHLKYRRTRPDLAKRNKFKMPLYPFSNYVVLGFLAFILIVLALAQDTRVSLFVTPVWFIMLIAIYKLRKPKSRQV

SEQ ID NO: 13284 - protein, 293 aa, Bradyrhizobium sp. ORS278
MKIRKAVFPVAGLGTRVLPATKAMPKEMLTIVDKPLIQYVFDEAKEAGIEHFVFVTGRNKTAIEDHFDRMYELDATLAARGKKTEMEILARDQPEAGAVSFTRQQAPLGLGHAVWCARDIVGDEPFAVVLPDELVLNSPGCLAQMIAAANKLPEKSNVLAVQEVPADQTHQYGICGVGPRDGKIFEVDGMVEKPAKGTAPSNFSITGRYILQPEIFKILATQERGAGGEIQLTDAMIGLSKTQKFYGVDFDGERHDCGSKSGFLKANIAFGMARADLRDGLRADMQKYLEAKS

SEQ ID NO: 13285 - protein, 390 aa, Thermobifida fusca YX
MGHLGFRTIDDMSTTPTTEQVNAALATVKDPEIHRPITELDMVKSVEIHDDGTVSVGIYLTVAGCPMRGRIEKDVADAVSKVPGVTGVKVTLDVMSDEQRKALQAKLRGGHAEKEIPFAKPNSLTKVFAVASGKGGVGKSSITVNLAAAMAAQGHKVGVVDADIYGHSVPRMLGVSDRPTKVEDMILPPTAHGIKVISIGMFTQGNQAVVWRGPMLHRALQQFLADVYWGDLDVLLMDLPPGTGDVAISVAQLLPNAEILVVTTPQQAAAEVAERAGSISAQTHQRVAGVIENMSYYQAPGSDERVYIFGEGGGQAVCDGLSRTLGTKVPLLGQVPLDVALREGGDRGVPLVLDAPDSEAGKVLRSIAEELLGKPRGLAGMMLGLSPTRR

SEQ ID NO: 13286 - protein, 283 aa, Saccharomyces cerevisiae [sequence omitted]

SEQ ID NO: 13287 - protein, 450 aa, Lentisphaera araneosa HTCC2155
MSNQSNAELKHFMQGLIKRNPGELEFHQAVEEVAISLMPFILDHDKYRVGRVLERLTEPDRIIIFRVCWEDDLGNLRVNRGYRVQFSNCIGPYKGGLRFHPSVSLSILKFLGFEQIFKNSLTTLPLGGGKGGANFNPKGKSDREVMRFCQSFMTELTRHIGADIDIPAGDIGVGAREIGYLYGQFKRLNNRHTGAITGKGFDYGGSLMRPEATGYGCVYMMREALSHAGDDLDRKTCLVSGAGNVAQFCAEKLIQLGAKVLTMSDSGGTIYDAEGINEEKLTWIKELKNVRRGRISEYTKQFPKAEYLEGKRPWAIPADLSFPCATQNELEENDAKNLVSNACQAVCEGANMPSTKEAIDVIQAAKVIFVPGKAANAGGVAVSGLEMTQNSMRIHWSAEEVDQKLLGIMQNIHRKCVRYGETDDYTDYVKGANIAAFSKIADTMLAYGVT

SEQ ID NO: 13288 - protein, 78 aa, Triticum aestivum
MKFFSAFDPWPVFFRREWGRTWPFLAGFAVTGALITKDDRRLQPRKDLKESKFRPRTKYHRPPRFAAKQGAAADYMFL

SEQ ID NO: 13289 - protein, 291 aa, Anaplasma marginale str. St. Maries
MITPPMHHSYSDIQQKVEDFASLVQKELAQVVHEKAECPSAALHEALGYVISNPGKCIRSFLASTSAQVFGVSTERTLRLSAAIEVVHAYSLVHDDLPSMDNSPIRRGKESCHIKFGEAVAVLTGNALLTLTFELLSTMNEGCAVRCEIIELLSKACGRCGMIAGQMLDMEAHSSTSFEGVRRIHELKTARLFSAACEAGAVLGGASAEERAALAKYGAALGCAFQAKDDLSDAWEDGERCYGSMAHILGMDETQGYVDGLLRKCEEHLRKLPGNVDTLGGLVVFVENLSV

SEQ ID NO: 13290 - protein, 346 aa, Nocardia farcinica IFM 10152
MTLSPHLNADLAAARADEAVAVAHPNIALIKYWGKRDETAVLPVTASLSLTVNIFPTTTAVALIDGPADIVTLDGKPASGPALARVVRFLDLVRARAGRADRVMVISVNSGPTGAGLASSASGFAALAAAAATVFGLDRDARSLSRLARRGSGSACRSIFGGFAVWHAGEGLGEAGDLGSYAEPVEDGGLDPALVVAVVDAAAKAVSSREAMRRTRATSPLYGAWAASSATDLTRMRAALARGDLAEVGEIAERNALGMHATMLAARPAIRYLSPHSLAVLDRVLALRAEGVPAYATMDAGPNVKILCARADAARVASAVRAVGDFVTTRIGYAGPGVAVTVGGGR

SEQ ID NO: 13291 - protein, 200 aa, Bdellovibrio bacteriovorus HD100
MGGALIVLAMPKTIQFIKSAVLEKDFPVHKKAEVAIAGRSNAGKSSFINALTKNKIAKVSSTPGKTRLLNFFELDQSYVMVDMPGYGFAARSGDEMREWHRMIETYLMNREQLRGLLLVMDIRRSWTEDEELLKEFSERRGFPLAVVLTKADKMSRSQMLQAVAKVKKASGLSAVFGVSALKKEGQDAVEDYIYENWIKE

SEQ ID NO: 13292 - protein, 332 aa, Parvularcula bermudensis HTCC2503
MAPQFDVIAIGNAIVDLLAHVPDGFPEAHDVPRGGMVLIDSEKAAAMTRAMPGSEQVAGGSAGNSMVCLSRLGGAGGFVGKVANDELGDAYRRSMEEAGVQFIAAPLDQGPPTGRCHIAVTADAERSMATYLGAAGEVSEADIDDDMIRRAEMVFFEGYLFDGELPRSAFEKAAAIAHKAGKRAALTLSDVGVVERNRDELIRILEKHVDLIFANEDEARALFGHHETPAELAAEMAKLVPFGAITCSERGSIVYGPDQDATTVPAVAPVQLVDTTGAGDAYAGGFFYGFTRGKPLPSCATLGSVIASEVISHMGPRPVADIRQMAADRDLL

SEQ ID NO: 13293 - protein, 130 aa, Brassica napus
MSRSLGIPVKLLHEAAGHVVTVELKTGEVYRGSLVECEDNWNCQLENITFTAKDGKVSQLEHVFIRGSRVRFMIIPDMLKNAPMFKRLEARIRGKGSAIGVGRGRAVAMRARAAAGRGGGPVGRGSAPPV

SEQ ID NO: 13294 - protein, 337 aa, Rhodococcus sp. RHA1
MPSETEPQERVWMAFPPLGASMTATEDDAHEARTAWTAVAHAIVEFEPVTMVVDPADRDVARQYLSADVDVVEAPLDDAWMRDIGPTFVLDEDDRLGAVDWTFNGWGQQEWATWDRDRSIGGAVTRWSGAQPVPSSMVNEGGGIQVDGRGTVLVTETVQLDPLRNPGLDAAGVEAELARTIGAEHVVWLPRGLTRDSEKFGTKGHVDIVAALPAPGVALVHSQRDRSHPDHEVSAEILKVLSDSRDRSGAPWRIVEVPAPTVLRDEEGWVDYSYINHLVVNGGVIACGFDDPHDVLARDILSSVYPGRRVVTVDARQIFARGGGIHCITQHQPRGRI

SEQ ID NO: 13295 - protein, 417 aa, Prochlorococcus marinus str. MIT 9301
MDTIQNFPEITKKDFPLLNKNLKSSEQIIYLDHAATTQKPIQVLEKINEYYRNFNANVHRGAHQLSAKATEEFENSRYLISKFIKANSTKEIIFTRNATEAINLAARSWGESSLKENDEILLSIMEHHSNIVPWQMVAAKNNCKLKFIGIDKNGKLDLDDFKSKLTSRTKLVSLVHISNTLGCCNPIKEITKLAKQKGSLVLIDACQSLAHQKLDVNDLNIDFLAGSGHKLCGPTGIGFLWSRKEILEKIPPLFGGGEMIQDVFEETSTWADLPHKFEAGTPAIAEAIGLAEAINYINTIGLSEIHEYEKNITKYLFEKLSAIENVEIIGPSPEIDPERASLATFYVKNIHSNDIAEILDSKGICIRSGHHCCQPLHRYIGIKSTARISMNFTTNKEEIDMFIEKLKDTIDFLKINS

SEQ ID NO: 13296 - protein, 719 aa, Zea mays
MTVTPMITVGDGRLVAHGRSVLAGVPDNIVLTHASGAGLVDGAFVGATAAEPSSMHVFTFGTLRDLRFVCCFRFKLWWMTQRMGTSGRDVPLETQFMLLECGPGDGHGDGDAAVYVAMLPLLEGQFRAALQGNDRDELEITFESGDKAVQTAQGTCMLYVHAGTNPFDTITQAVKVVERHMQTFHHREKKKLPSFVDWFGWCTWDAFYTDVTAESVKQGLKSLADGGTPPRFLIIDDGWQQIGSENKEESANAVVQEGAQFASRLTGIKENAKFQKKTKTKESGGGGGEQQAQTPGLKLLVEEAKREHGVRYVYVWHAMAGYWGGVKPAAEGMEHYESALAYPVQSPGVMGNQPDIVMDSLSVLGLGLVHPRRALSFYDELHSYLASCGVDGVKVDVQNIIETLGAGHGGRVALTRAYHRALEDSVARNFPDNGCISCMCHNTDMLYSARQTAVVRASDDFYPRDPASHTVHVSSVAYNTLFLGEFMQPDWDMFHSLHPAADYHGAARAIGGCPIYPVSVNDKPGNHNFELLKKLVLPDGSVLRAQLPGRPTRDCLFADPARDGTSLLKIWNVNKCTGVVGVFNCQGAGWCRVTKKTRVHDAAPGTLTGSVRADDVDVIAGLAGDGWGGEAVVYAYRSGELVRLPQGATLPVTLKVLEFEVFHVSPVRAVAPGVSFAPIGLLDMFNSGGAVEQCEVRGGASAAALEYPSRGPSLRVPSF

SEQ ID NO: 13297 - protein, 267 aa, Salmonella enterica subsp. enterica serovar Paratyphi B str.
MTIPAFGLGTFRLKDDVVIASVKTALELGYRAVDTAQIYDNEAAVGQAIAESGVPRSELYITTKIWIENLSKDKLIPSLKESLKKLRTDYVDLTLIHWPSPGDAVSVEEFMQALLEAKKQGLTREIGISNFTIPLMEKAIAAVGAHNIATNQIELSPYLQNRKVVDWAKAHGIHITSYMTLAYGKALKDEVIARIAAKHNATPAQVILAWAMGEGYSVIPSSTRRENLASNLLALDLHLDVEDKNAIAALDCNDRLVSPEGLAPAWD

SEQ ID NO: 13298 - protein, 202 aa, Chlamydomonas reinhardtii
MADGREEGEIDSVEPDFSKKHPLENRWTLWFDNPNQKQTQKQYGQSLRSVYTFDTVEDFWCLYNNIRTPSQVNVGATYYLFKEGIEPKWEDPKNLKGGSWTAPVPNKGDSKKTLDAWWLNTVLACIGEQFTDGDEVNGIAVVIRARGDRIELWSRTASNEAAQTMIGKQLKQYLDIPESAKIGFSVFEEKITSGKAKDRYMV

SEQ ID NO: 13299 - protein, 335 aa, Burkholderia thailandensis E264
MRLQGGAKFPTGGRPACCRRARERPRDARGQQIWSDARADGHSPDERRCADGHVRPVSPAARGVVRAARKRRRAVCLLCPETFFAPFFPRGAFHIMSFPLPSKSAPADAFSDLPLLDVEPVPPRIAAALAALREGRAVVLQDDHDRENEADLIVAAERLTDETMALLIRECSGIVCLCLTDEKVRALALPPMAQLNESKNGTAFTVSIEARAGVTTGVSAADRVTTIRAAIADDAQPHDIVRPGHVFPLRAAPGGVLARRGHTEGTVDLAILAGLKPAGVLCELMNPDGTMTRGADVERFAAQHGLPMLTIAELVEFRERLASLRERDACCEGVA

SEQ ID NO: 13300 - protein, 414 aa, Glycine max
NSATKSQITHTHTQIHTLVVWCVPFLYPFAFCVQLTHTHTKMTACQDWPEPVIRVQALAASGLATIPERFIKPKSQRPTNSNNYAPKTNFSQIGHHKNNTTNSNIPVIDMKHIYSGDEGKRAETLRLVSEACQEWGFFQVVNHGVSHELMKGAREVWREFFHQPLDVKEVYANTPLTYEGYGSRLGVKKGAILDWSDYFFLHYMPCSLRDQAKWPALPTSLRSIISEYGEQIVKLGGRILEIMSINLGLREDFLLNAFGGENDLGACLRVNFYPKCPQPDLTLGLSSHSDPGGMTILLPDENVSGLQVRRGEDWVTVKPVPNAFIINMGDQIQVLSNATYKSIEHRVIVNSDKDRVSLAFFYNPRSDIPIQPAKELVTKDRPALYPPMTFDEYRLYIRTRGPSGKAQVESLTSK

SEQ ID NO: 13301 - protein, 320 aa, Geobacter metallireducens GS-15
MKAIRVREFGEPEVMGLEDVAPLTPGPAEVVVRLHAVGVNPVDAYIRSGQYRPDLKLPYTPGLDGAGVISAVGSEVKHRHVGQRVYVAWSLSGTYAEEVLCKEFQTHPLPDGVSFAQGAAIGVPYGAAFRALFQRAHAVAGETVLIHGASGGVGIAAVQLARRAGMWVIGTAGTEKGEALVRAQGAHHVLNHRVEGYLDRLQEFPCGKGVDVIVEMLANVNLDRDLGVLAKGGRVVVVGSRGRVEIDPRTAMGKEAAILGMTLYNASDKELAGMHAAFVEGLANGTLRPVVSRELPLAAAAEAHHAVMESSTFGKIVLLP

SEQ ID NO: 13302 - protein, 335 aa, marine gamma proteobacterium HTCC2080
MTMRLVASCLALVFACSQTFAKEMPTDFQAVVDRAHAQFKDVKDGANADYIPILATVPSDMFGVVIVTRDGQVFSAGEMDYEFSIQSVSKPFTASLVMDQQGPAAVREKIGVEPTGLPFNSKMALELYAARSVNPLVNAGAIAAVSLVEADSEEDRWNQIHANLNAYAGRELPVLEEVYTSEYEESWSNRGIANLLYNYGRLYSDPEETLRVYTRQCSTGINTLDLGMMGATLANQGVNPVSGKRVLDAAHIPELLAIMATAGFYDESGEWMYSAGLPAKTGVGGGIVAVVPGKFAIATFSPPLNEAGNSVRGMQAIRYIAGELGVGLFGANKGE

SEQ ID NO: 13303 - protein, 181 aa, Saccharomyces cerevisiae
MGLYASKLFSNLFGNKEMRILMVGLDGAGKTTVLYKLKLGEVITTIPTIGFNVETVQYKNISFTVWDVGGQDRIRSLWRHYYRNTEGVIFVIDSNDRSRIGEAREVMQRMLNEDELRNAVWLVFANKQDLPEAMSAAEITEKLGLHSIRNRPWFIQSTCATSGEGLYEGLEWLSNNLKNQS

SEQ ID NO: 13304 - protein, 399 aa, Erythrobacter sp. NAP1
MDEQFYRMKRLPPYVIAEVNAMRHAARQAGQDIIDLGMGNPDQPPPQHVIDKLCEVAMKPDAHGYSQSKGIPGLRRAQANYYGRRFGVDLDPENEVVVTMGSKEGLGSLANAITAPGDVVLAPNPSYPIHTFGFIIAGATIRSIPTTPDEEYWRSLESAMNFTVPRPSVLVVSYPSNPTAETVDLAFYERLVAWAKENQVWVLSDLAYSELYYDGVPTPSIMQVDGAKDIAVEFTSMSKTYSMAGWRMGFAVGNKQLIAALTRVKSYLDYGAFTPIQAAACAALNGPQDIVESNRDLYRKRRDVMVEAFGRAGWDIPSPAASMFAWAPLPPALKEMGSLEFSKQLLTEAQVAVAPGVGYGEKGEGYVRIAMVENEQRLRQAARNIKRYLASAGVNTSAA

SEQ ID NO: 13305 - protein, 202 aa, Saccharomyces cerevisiae
MAEESTDFSQFEEERNNDQYKVSAKKTVDEYKNLDAEDESLAKWKESLGLSSDVLPLEFPGDKRKVVVQKIQLLVNTEPNPITFDLTNEKTIKELASKRYKIKENSIYKLKIVFKVQHEIITGLRYVQYIKKAGIAVDKIDDHLGSYAPNTKTKPFYEVELPESEAPSGFLARGNYSAVSKFIDDDKTNHLTLNWGVEIVKK

SEQ ID NO: 13306 - protein, 555 aa, Haemophilus influenzae R2866
MSKQIQIPDIGSDEVTVTEVMVNVGDTISVDQSIINVEGDKASMEVPAPEAGVVKEILVKVGDKVSTGTPMLVLEAAGAAPAADEPTAPVADAPTAPVVATAPTASAIVEVNVPDIGGDEVNVTEIMVAVGDTITEEQSLITVEGDKASMEVPAPFGGVVKEILVKSGDKVSTGSLIMRFEVLGAAPAESASASASTSAPQTAAPATTAQAPQATAPDTTAQAPQSNNNVSGLSQEQVEASTGYAHATPVIRRLAREFGVNLDKVKGTGRKGRIVKEDIEAYVKTAVKAYESGATAQATGNGVANGAGLGLLPWPKVDFSKFGEIEEVELSRINKISGANLHRNWVMIPHVTHFDKADITDLEAFRKEQNALAEKQKLGVKITPVVFIMKAVAKALEAYPRFNSSITEDAQRLILKKYINIGVAVDTPNGLVVPVFKNVNKKGIIELSRELMEVSKKAREGKLTASDMQGGCFTISSLGGIGTTHFAPIVNAPEVAILGVSKSSMEPVWNGKEFAPRLILPMSLSFDHRVIDGADGARFISYLGSVLADLRRLVM

SEQ ID NO: 13307 - protein, 386 aa, Thermobifida fusca YX
MSLPPLVEPADELTIDEVQRYSRHLIIPDVGMDGQKRLKNAKVLVVGAGGLGSPTLMYLAAAGVGTLGIIDFDVVDESNLQRQVIHGQSDIGKPKAESARETIEEINPFVKVVLHKERLDSSNALEIFADYDLILDGTDNFATRYLVNDAAVLLNKPYVWGSIFRFDGQVSVFWNEYGPNYRDLYPEPPPPGMVPSCAEGGVLGVLCATIGSVMANEAIKLITGIGDPLVGRLLIYDALEMTWRTVKIRKDPNAEPITELIDYEAFCGTIPEEAQEAARGSTITAKELKEKMDRGEDFFLVDVREKNEYEIVNIPGAVLIPKGEFLTGEAFAKLPQDKQIILHCKSGGRSAEALAAVKKAGFSDAVHVGGGILSWIETVDPSLPKY

SEQ ID NO: 13308 - protein, 474 aa, Haemophilus influenzae R2866
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRVLGGAIVGSNGGELLGEIGLAIEMGCDAEDIALTIHAHPTLHESVGLAAEVFEGSITDLPNAKAKKK

SEQ ID NO: 13309 - protein, 230 aa, Zea mays
MAAAEATRPLLVAISLAVAACCLAQLAVGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLQNLHWKKDGKQTCAIRTQSCKSQGPVDCSVGIQLAFSGTDKHESVLNSWYEVSNLRQYSLYGLYSNLKDTLSGQFNKIF

SEQ ID NO: 13310 - protein, 608 aa, Streptococcus pneumoniae TIGR4
MEFSKKTRELSIKKMQERTLDLLIIGGGITGAGVALQAAASGLETGLIEMQDFAEGTSSRSTKLVHGGLRYLKQFDVEVVSDTVSERAVVQQIAPHIPKSDPMLLPVYDEDGATFSLFRLKVAMDLYDLLAGVSNTPAANKVLSKDQVLERQPNLKKEGLVGGGVYLDFRNNDARLVIENIKRANQDGALIANHVKAEGFLFDESGKITGVVARDLLTDQVFEIKARLVINTTGPWSDKVRNLSNKGTQFSQMRPTKGVHLVVDSSKIKVSQPVYFDTGLGDGRMVFVLPRENKTYFGTTDTDYTGDLEHPKVTQEDVDYLLGIVNNRFPESNITIDDIESSWAGLRPLIAGNSASDYNGGNNGTISDESFDNLIATVESYLSKEKTREDVESAVSKLESSTSEKHLDPSAVSRGSSLDRDDNGLLTLAGGKITDYRKMAEGAMERVVDILKAEFDRSFKLINSKTYPVSGGELNPANVDSEIEAFAQLGVSRGLDSKEAHYLANLYGSNAPKVFALAHSLEQAPGLSLADTLSLHYAMRNELTLSPVDFLLRRTNHMLFMRDSLDSIVEPILDEMGRFYDWTEEEKATYRADVEAALANNDLAELKN

SEQ ID NO: 13311 - protein, 490 aa, Zinnia elegans
MSRKMLIDGDVGSISDEDYDFDLFVIGAGSGGVRASRFSAQYGAKVGICELPFHPVSSETVGGVGGTCVIRGCVPKKILVYGASFGPEIQDAKEYGWQVNENLDFDWKKLLHKKTEEIVRLNGVYKRLLSNAGVKLFEGEGRIVGPNEVEVIQLDGTKLSYTAKHILISTGSRAHRPDIPGQELGITSDEALSLDELPKRVVILGGGYIAVEFASIWRGMGSTVNLCFRKELPLRGFDDEMRALVARNLEGRGVILHPQTNLTKLVKTESGIKVTTDHGEELMADVVLFATGRVPNTKRLNLQAVGVEVDKTGAIKVDEYSRTNVPSIWAIGDVTNRINLTPVALMEGTMFAKTVFGNEPSKPDHSNVPCAVFCIPPLSVVGLSEEQAIQQGTGDILVFTSTFKPMKNTISGRQEKTLMKLIVSAENDKVIGASMCGPDAPEIMQGIAIAIKCGATKAQFDSTVGIHPSAAEEFVTMRSVTRRITASGKR

SEQ ID NO: 13312 - protein, 545 aa, Shewanella oneidensis MR-1
MDRITGKAFATRSEVYATHGMAATSQPLATQVAIDVLKQGGSAVDAAIAANAMLGLVEPTGSGVGGDLFAIVWSAKDNKLYGLNASGRSPKSLTLEKLKSLGLDYLPPLGPLPVSVPGAVDGWFELHDKFGKLPMADNLAPAIRYAHEGFPVSELIAYYLEGSGKKLAQFPGFKETYMPNGKMPAVGEIFKNPALANTYEKIAKGGRDAFYKGDIAKSIDKYLKAQGGYLSYEDLASHTSEWIEPVSVNYRGYDVWELPPNGQGIAALQILKTMEPFDVAAMGFNSPEYVHLFVEAKKLAFADRAKFYADMAFNKVPVKELISQQYNYERAKLIDLNKAAKSVDAGNPALQHGDTVYLTTADKDGNMVSLIQSNYRGMGSGMTPPDLGFVLQDRGQMFDLTEGRVNTYAPGKRPFHTIIPAFVTKDGKPWLSFGVMGGATQPQMHAQIIINLIDFKMNLQEAGDAPRILHSGSTEPTGEIMNDGGYVSLESGFPIETRRELIKKGHVLRDVLGDFGGYQAIGFNAETGVYRGASESRKDGYAAGY

SEQ ID NO: 13313 - protein, 568 aa, Zinnia elegans
MATSATTPKLTTTLSSSTLQTFIFRHKKSSILNRSSFLITNSPSSSSYHTPTFSLSKKTLGFLSDYKPKSRRFVTRAESSTNGAEPRSYDFDLFTIGAGSGGVRASRFAANFGASVAVCELPFATISSETTGGVGGTCVLRGCVPKKLLVYASKYSHEFEESLGFGWSYNSEPTHDWSTLMANKNAELQRLTGIYKNILNNAGVKLIEGRGKIVDPHTVDVDGKLYTARNILVSVGGRPFIPDIPGKEHVIDSDAALDLPSKPTKIAIVGGGYIALEFAGILNGLQSDVHVFIRQKQVLRGFDEEIRDFVAEQMSLKGIEFHTEETPQAVIKSADGSLSLKTNKGTIDGFSHVMFATGRKPNTKNLGLETVGVKLDKNGAILVDEYSRTSVPSIWAVGDVTDRMNLTPVALMEGGALAKTLFANEPTKPDFRAVPSAVFSQPPIGQVGLSEQQAIEEYGDVDVYTANFRPLKATLSGLPDRVFMKLLVSAKTNQVVGLHMCGEDSAEIVQGFAVAIKAGLTKAQFDSTVGVHPTSAEEFVTMRTPTRKIRNSSSGGKTDSEAKAAAGV

SEQ ID NO: 13314 - protein, 693 aa, Streptococcus pneumoniae TIGR4
MFASKSERKVHYSIRKFSVGVASVVVASLVMGSVVHATENEGATQVPTSSNRANESQAEQGEQPKKLDSERDKARKEVEEYVKKIVGESYAKSTKKRHTITVALVNELNNIKNEYLNKIVESTSESQLQILMMESRSKVDEAVSKFEKDSSSSSSSDSSTKPEASDTAKPNKPTEPGEKVAEAKKKVEEAEKKAKDQKEEDRRNYPTITYKTLELEIAESDVEVKKAELELVKVKANEPRDEQKIKQAEAEVESKQAEATRLKKIKTDREEAEEEAKRRADAKEQGKPKGRAKRGVPGELATPDKKENDAKSSDSSVGEETLPSPSLKPEKKVAEAEKKVEEAKKKAEDQKEEDRRNYPTNTYKTLELEIAESDVEVKKAELELVKEEAKEPRNEEKVKQAKAEVESKKAEATRLEKIKTDRKKAEEEAKRKAAEEDKVKEKPAEQPQPAPAPKAEKPAPAPKPENPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQYNGSWYYLNANGDMATGWVKDGDTWYYLEASGAMKASQWFKVSDKWYYVNGSGALAVNTTVDGYGVNANGEWVN

SEQ ID NO: 13315 - protein, 431 aa, Rhodococcus sp. RHA1
MTAVLTADVCVAPLAQVSGSDLRVPLVQGGDCAYVNFDYAASAPALAQVTDRIGALLPTYSSVHRGAGYASRVSTECYEKARDSVARFVGASEDQVVVFTRNTTDSLNLLAGCVPGSTVVLDIEHHANLLPWKNSRVVRAADALEETIRLLVAELCSKPTALLAVTGASNVTGEVLPIAALAEVAHRCGARILVDAAQLAPHRRIDVEEWGVDYLAFSGHKLYAPFGAGVLVGRRDWLDAAEPYLAGGGAVRNVTVESTQWAPAPARHEAGTPNVLGAAALAAACDALSELDFGTVAAHEAALTGRLLDGLGSVDGLEFLRLWSDAPDTVGIVTFTIDGFEPGEIAAYLSAEHGIGVRDGRFCAHPLLGRLGRPDGAVRVSVGLGSCSEDVDRLVDAVRTLVAGRRSWTYAKESGQWNPVPETRFSRDALV

SEQ ID NO: 13316 - protein, 302 aa, Chlamydomonas reinhardtii
MAMERPRRGKANYAAPTKLKEASSSSSDSDSDSEVEVIEDKQARKQFDEWHSRMRSNFSVLLYGFGSKRALLDDFARRLAGPLNRGDAAVLVYYGYNPRCTAKDEVRREAADRHVFVVIHNLDGPGLRGDVSLLSALASCPQVHLVASVDHAMSPLLWDSADAARFRWQYINATTFQPYIAETAGAQSVLMGAFKSGVVTAGAGTVLRSLVLGAQVFKVLAEYLLEDDQCEGVAFAHLYRMCRERFLVRDERVLRQHLVEFVDHQLVRYRSATDNSGELLSIPMERPDLQAVLDDLAAARAE

SEQ ID NO: 13317 - protein, 122 aa, Bacteroides fragilis YCH46
MNIFIAGISYNLSNADLGELFEEFGEVISAKIVMDRETGRSKGFGFVEMPNDEEGNAAIAALNEKEIDGKTLAVSVARPREEGPRRNSNYGGGNRGGYGNNRGGGYGGGNRGGGYGGGRDRY

SEQ ID NO: 13318 - protein, 468 aa, marine gamma proteobacterium HTCC2080
MSKTFPGPKTKAALRRGIPLFKNGQRFEKDEHKAGSRGFRPVRQIVIDKAAGDYVWDLDGRRYIDFQNGWATNPLGNCHPEILDVVESANRRYGFHFDHPLRYELAERLANIMPDKALPRTNYEVSGTEAAEAAVHLALTHTQRRYIVTFGASYHGNSLAGKLLSGLSGESAAYLEGWGGGVIRAPYPFSDHIPADMTSEQYVDFCLWYLEKQIPETIASADNIAAVLIEPGLAEGGNWIPSKAFIQGLRRICDRNDWLLISDEVLTGVGRTGRMWAIEHYDVVPDILVYGKNLSGGIAPLAGISARDDILGENSHFNSGSTFAGSPAGCAAAIKTLEIYERDGIVAHAKKLGDVAYEIMSGWEHHAVVGQIRCSGLLMGVSFKATKQLHPDAEDWWAARAVRGEMLERGVWAISDHEDTIRLYPALNMDEATLREGLAIMEEAIERVANGCAIEGDGSAYPSGVSGF

SEQ ID NO: 13319 - protein, 386 aa, Salmonella enterica subsp. enterica serovar Paratyphi B str.
MTSENPLLALRDKISALDEELLALLAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFTDIFHQVETGQADYAVVPIENTSSGAINDVYDLLQHTSLSIVGEMTVTIDHCVLVSGATDLNTIETVYSHPQPFQQCSKFLSRYPHWKIDYTESTSAAMEKVAQANSPRVAALGSEAGGMLHGLQVLERIAANQTQNITRFLVLARKAINVSDQVPAKTTLLIATGQQAGALVEALLVLRNHNLIMTKLESRPIHGNPWEEMFYLDIQANQESQVMQSALKELGEITRSMKVLGCYPSENVVPVEPA

SEQ ID NO: 13320 - protein, 212 aa, Oryza sativa Japonica Group
MGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 13321 - protein, 815 aa, Saccharomyces cerevisiae
MSETLPRSDDLEATWNFIEPGINQILGNEKNQASTSKRVYKILSPTMYMEVYTAIYNYCVNKSRSSGHFSTDSRTGQSTILVGSEIYEKLKNYLKNYILNFKQSNSETFLQFYVKRWKRFTIGAIFLNHAFDYMNRYWVQKERSDGKRHIFDVNTLCLMTWKEVMFDPSKDVLINELLDQVTLGREGQIIQRSNISTAIKSLVALGIDPQDLKKLNLNVYIQVFEKPFLKKTQEYYTQYTNDYLEKHSVTEYIFEAHEIIKREEKAMTIYWDDHTKKPLSMALNKVLITDHIEKLENEFVVLLDARDIEKITSLYALIRRDFTLIPRMASVFENYVKKTGENEISSLLAMHKHNIMKNENANPKKLALMTAHSLSPKDYIKKLLEVHDIFSKIFNESFPDDIPLAKALDNACGAFININEFALPAGSPKSATSKTSEMLAKYSDILLKKATKPEVASDMSDEDIITIFKYLTDKDAFETHYRRLFAKRLIHGTSTSAEDEENIIQRLQAANSMEYTGKITKMFQDIRLSKILEDDFAVALKNEPDYSKAKYPDLQPFVLAENMWPFSYQEVEFKLPKELVPSHEKLKESYSQKHNGRILKWLWPLCRGELKADIGKPGRMPFNFTVTLFQMAILLLYNDADVLTLENIQEGTSLTIQHIAAAMVPFIKFKLIQQVPPGLDALVKPETQFKLSRPYKALKTNINFASGVKNDILQSLSGGGHDNHGNKLGNKRLTEDERIEKELNTERQIFLEACIVRIMKAKRNLPHTTLVNECIAQSHQRFNAKVSMVKRAIDSLIQKGYLQRGDDGESYAYLA

SEQ ID NO: 13322 - protein, 848 aa, Arabidopsis thaliana [sequence omitted]

SEQ ID NO: 13323 - protein, 411 aa, Saccharomyces cerevisiae
MDATTPLLTVANSHPARNPKHTAWRAAVYDLQYILKASPLNFLLVFVPLGLIWGHFQLSHTLTFLFNFLAIIPLAAILANATEELADKAGNTIGGLLNATFGNAVELIVSIIALKKGQVRIVQASMLGSLLSNLLLVLGLCFIFGGYNRVQQTFNQTAAQTMSSLLAIACASLLIPAAFRATLPHGKEDHFIDGKILELSRGTSIVILIVYVLFLYFQLGSHHALFEQQEEETDEVMSTISRNPHHSLSVKSSLVILLGTTVIISFCADFLVGTIDNVVESTGLSKTFIGLIVIPIVGNAAEHVTSVLVAMKDKMDLALGVAIGSSLQVALFVTPFMVLVGWMIDVPMTLNFSTFETATLFIAVFLSNYLILDGESNWLEGVMSLAMYILIAMAFFYYPDEKTLDSIGNSL

SEQ ID NO: 13324 - protein, 415 aa, Campylobacter upsaliensis RM3195
MHYFCISFTHKNTDLSLRERLSLNDEKKKKEFLKLVLSKEDIVESLVISTCNRVEILAFVKDLKEVGKHIITSLALLCEVDKNDLEKRADFFEDSGAIHHLFSVASSLDSLVIGETQITGQIKEAFHFAKNLNFCAEHLEFALHHAFKCAAKVRNQTQISKNPISIASVAVAKAKELLNLNQIKAVVIGAGEMAQLTCKHLLQTGAKIIILNRDLSKAQKLSEELGCEFDRLENLKNYLNAYSLFFSATNAKNALITNDMLKSVEFKRYFFDIAVPRDIELSENDNIKVFAVDDLEEVVRKNLALRECEASIAYGIIGAMTHEFFKILSDLALTPTIKALRLKAKTCANQQLQIALSKGYLKKSDEEEARKLIHQVFKAFLHEPTLNLKHLQGKKSEVLIQSLNYLFNLGEYNEI

SEQ ID NO: 13325 - protein, 835 aa, Saccharomyces cerevisiae
MGEEHKPLLDASGVDPREEDKTATAILRRKKKDNMLLVDDAINDDNSVIAINSNTMDKLELFRGDTVLVKGKKRKDTVLIVLIDDELEDGACRINRVVRNNLRIRLGDLVTIHPCPDIKYATRISVLPIADTIEGITGNLFDVFLKPYFVEAYRPVRKGDHFVVRGGMRQVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLEALAAETHGYVGADIASLCSEAAMQQIREKMDLIDLDEDEIDAEVLDSLGVTMDNFRFALGNSNPSALRETVVESVNVTWDDVGGLDEIKEELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDENARLSILNAQLRKTPLEPGLELTAIAKATQGFSGADLLYIVQRAAKYAIKDSIEAHRQHEAEKEVKVEGEDVEMTDEGAKAEQEPEVDPVPYITKEHFAEAMKTAKRSVSDAELRRYEAYSQQMKASRGQFSNFNFNDAPLGTTATDNANSNNSAPSGAGAAFGSNAEEDDDLYS

SEQ ID NO: 13326 - protein, 312 aa, Saccharomyces cerevisiae
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 13327 - protein, 670 aa, Magnaporthe grisea 70-15
MASFIGTLFPTGKQERTERPGTPNRNSFINPASTPQGSPSKKTVPPGANELPNALEGMKLVPPVLDPSIKLGRPQSVVTPLSPGRNNVQATDESVFVDDSVLHKSTAAPGAHMMKQGQENTPPPLSSARAGGGLNIAHAHTDQQAAPSHNHAAVSRHEHYLRDRPTTPATRRFNTNRGLTPEELEILKKPSIKRLVNVTQLYFLDYYFDLLTYTGARQNRLAAFKSEYPPPPETDEETYAAMWHKYTGRERANLRKRRVRLRQGDFQILTQVGQGGYGQVFLAQKKDTREVCALKVMSKKLLFKLDEVRHVLTERDILTTAKSEWLVRLLYSFQDDKSIYLAMEYVPGGDFRTLLNNTGVLSNRHARFYIAEMFCSVDALHQLGYIHRDLKPENFLVDSTGHVKLTDFGLAAGVLAPGKIESMRLRLEKASETSVPFGKPMDQRTIAERREGYRSMRDKDVNYAKSIVGSPDYMAPEVLRGEEYDFTVDYWSLGCMLFEALTGFPPFAGATAEETWRNLKHWKEVLKRPVWEDPNYFLSNRTWGFITTCINSRSRRFANIRDIYAHQYFAEVDWETLRETKAPFVPELDSETDAGYFDDFSNEADMAKYKEVHEKQQALETMAERDDEMGKSLFVGFTFRHRKPQGEDSSSPRKPLTADTFQAETFGTML

SEQ ID NO: 13328 - protein, 450 aa, Glycine max
LREDDRRGNEQRAHLCLQCRNLIWTSSRAFHQCLELQMENTWILTFHLLLLLLHPNAAKGAIGVGVGVGGRGGIGVGIGIGGSVNTPGPSGSNLKSAFTALQAWKSAMTDDPLKILDTWVGPNVCSYRGVFCANSQDDNGIVTTAATESSIVAGIDLNHANLQGTLVKDLSLLSDITLFHLNSNRFSGSLPDTFRDLTSLQELDLSNNQLSGPFPMVTLSMPSLIYLDLRFNNFSGQLPDQLFNKKLDAIFLNNNNFGGEIPDSLGNSPASVINLANNKLSGSIPFSFGFMGSGLKEILFLNNQLTGCIPQGVGIFTEMQVFDVSFNSLMGHLPDTMSCLQDIEVLNLAHNKLSGELSDVVCSLRSLLNLTVAYNFFSGLSQECSRLFSVGFDFSDNCIPGRDMQRPQPDCSIIPGGSLNCLRIPTPKPLVCAALAATLSKHTNSRSFSP

SEQ ID NO: 13329 - protein, 370 aa, Marinobacter sp. ELB17
MIKSRAAVAFAANQPLEIVEVDVAPPQEGEVLVRIVATGVCHTDAYTLSGADPEGLFPTILGHEGGGIVEAVGPGVKNLEVGDHVIPLYTAECGECKFCTSGKTNLCGAVRATQGKGVMPDGTSRFSYKGEPIYHYMGCSTFSEYTVLPEISLAKIPKEAPLDKVCLLGCGVTTGIGAVLNTAKVEEGATVAIFGLGGIGLAAIIGAKMAKAGRIIAVDINPGKFDIAKQLGATDVVNPKDHDKPIQDVIIEMTDGGVDYSFECVGNVQLMRAALECCHKGWGESIIIGVAGAGQEVSTRPFQLVTGRVWKGSAFGGVKGRTELPGYVAKAESGDIPLDVFITHKMPLEDINKAFDLMHEGKSIRTVIHF

SEQ ID NO: 13330 - protein, 403 aa, Burkholderia vietnamiensis G4
MSLDHSPIPCPVVVPLDAILPEEPLLMMGAGPVPIPAAVAKANTIVINHLGATMAKIIEQVKEMARYVFQTRTKWVLGVAGPGSAAMEMAISNLAWRGTRVLSIRNGFFSARMAEMATRVGADVATLEVADRSVASLDEIADAIARERPEIVTIVQGETSNTVWNRDLREIAALAKAAGALVVVDAVCTLSTMPLEMDAWGIDAVITGGQKGLSSIPGVSLIAFSDAAWDRMKQRPEPNAHWCLDMALAENFWHNAGYHYTAPVSGVLALHEALRLVCAETLESRFARHLRCTLALQAGIEAMGLELYTPKECRLNSVVGIETPAGLTPGMVCGHISKQYQVEISGSFGLPIVRIGQMGEQCREHNLFRTLHAFGRTMVDLKVPVDLPAGVAALEQELSRRGM

SEQ ID NO: 13331 - protein, 334 aa, Coccidioides immitis RS
MADKDAPIYKQAGQDGRFRRQVASFRSTISRSPGADFPPAKDRYVLYVTYGCPWAHRANIVRSLKGLEPIIQLAVLDPRMSPEGWQFTGELGSAEKDPIYGFQYLKELYLKADPDYQARYTVPMLWDKQKETIVNNESSEIIRMLYTEFDDLLPEQLREANRPGGGLYPERLRKEIDDMNDWVYNSVNNGVYKTGFATTQEAYDENIYPLFASLDRLEKHLSERGHGPYLFGEHITEADIRLYPTIVRFDVAYYHTFRCNLKMIRHDYPHIDRWLRRLYWDESEKTNGGAFKKTTNFDAFKLGYLFSTNRRMQVPFSIVPAGPAPHILPPITDA

SEQ ID NO: 13332 - protein, 352 aa, Triticum aestivum
MQILTKVAFNQGTSTYVLVFYRHLIGTMFLLPIAFAIERKTAPRLSYKVCLKLFVHALYGMSASLNISCVGLNYASATSASAVLNLLPVLTFFLALLLGMESLQLKSFHGIVKVSGIVICAAGVTVLALYQGPELKSIVHHPIFRHPSRVDTHPSRSWILGILLQSLATVMFALWTVFQGPLLEEYPSMLLNTSLQIVFATVQSFFMALVMERDFSRWKLGLDVGLVAIIYCGVLVTTLANYLQIWVIGRCGPVFLAMTVPLTLVIPIILSLLIGEAVTLGSVISGALMVAGLYNVLWGKRIEQVALCKPGGSGENGSCLDLEEPESGAPVPATRDSIKPVPGSIERADTSS

SEQ ID NO: 13333 - protein, 286 aa, Streptococcus pyogenes str. Manfredo
MITLKSVREIEAMDRAGDFLAGIHIGLRDIIKPGVDMWEVEAYVRRRCKEDNVLPLQIGVDGHMMDYPYATCCGLNDEVAHAFPRHYILKEGDLLKVDMVLSEPLDKSIVDVAALDFDNVPEMKKWTGSYTGGLADSCWAYAVGTPSDEIKQLMDVTKEAMYRGIEKAVIGNRIGDIGAAVQEYAESFGYGVVRDLVGHGVGPTMHEEPMVPNYGTAGRGLRLKEGMVLTVEPMINTGTWEIDTDIKTGWAHKTLDGGLSCQYEHQFVITKDGPVILTSQGEERTY

SEQ ID NO: 13334 - protein, 163 aa, Rhodococcus sp. RHA1
MEFDVTIEIPKGQRNKYEVDHVTGRVKLDRYLYTAFGYPADYGFIENTLGEDGDPLDALVLLPESVFPGVIVEARPVGMFKMVDEAGGDDKVLCVPAGDPRWDHIQDIGDVPQFELDAIKHFFVHYKDLEPGKHVEAADWVGVAEAKAEVEASFKRLKDNGGH

SEQ ID NO: 13335 - protein, 227 aa, Zea mays
MKLEVMPKQRVLEAEQREEAMEMSGLDLWKHEKPPRICSLPPPLPAPPACDEAALVPPLNFAMVDDGIFRSGFPETANFRFLKSLNLRSIVYLCPEPYPETNTEFLEKNGIRLHQFGIEGRKMNGTSGMGLFLPAGEPFVNIPDDKIREALKVVLDPRNQPLLIHCKRGKHRTGCLVGCLRKLQKWCLSSVFDEYHRFAAAKARITDQRFMELFDVSSLKHLTPSHC

SEQ ID NO: 13336 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLRPMGIAWVFMVFSVICLLSFFFAFYMVPETKGKSLEEIEASLKKRFKKKKSTQNQVLNERTL

SEQ ID NO: 13337 - protein, 284 aa, Candidatus Kuenenia stuttgartiensis
MWDYSEKVKDHFLHPRNVGDIENPDAVGEVGSLACGDALKLMLKIDAGGVISDVKFKTFGCGSAIASASALTEMIKGKTIAEAEKVADSDIAEYLDGLPEQKMHCSVMGREALEAAIANYRGIKLEKAVDEGTIVCKCFGVTDNKIAHEVREHKLTTIDQVTNYCKAGGGCQSCHPQIQAIIDEIWHKEKEKEIIKKVQKPVKKLTNIQKMKLVQETIEREIRPALLADGGDIELIDIDGDRVMVSFRGSCSACPSSGVTLKSTVEAKLREFVTDTLIVEEVIS

SEQ ID NO: 13338 - protein, 320 aa, Bradyrhizobium sp. BTAi1
MPVQLDADAAAVYKAFQEAGRPAYETLTPQEARDYYLAARVVSNPEPPELADVKELSIPAPHGAIPARLYRPKTIRHNGGLAPALVFFHGGGWVIGNLDSHDVVCRALAHEGELIVVSIDYRLAPEHKFPAAVDDAVAATRWVADQAASLGIDDTRLSVGGDSAGGNLAAVVALSARDGQGPKLSGQVLIYPATDFSMNHPSHSEPETSVLLTHSVIRWFRDHYLNSAADIHDWRASPAKAETLAGLPPAYVLTAGADPLRDEGDDYARRLREAGVPVTHRTHPGQFHGFFTMGKLLDQANVAARDIGAWLKQLDRPSGI

SEQ ID NO: 13339 - protein, 508 aa, Burkholderia thailandensis E264
MTGSTHSNDSRVRALTHFIGGRALDGASDRYGDVFDPALGKVTARVPLASGAEVEAAVAAAAAAFPAWSETSPLKRARVMFKFKELLDRHHDELAELITREHGKVFSDAKGEVMRGIEVVEFACGIPNLLKTDFTDQIGGGIDNWNLRQPLGVVAGITPFNFPMMVPCWMFPVAIACGNTFVLKPSERDPSASIRLAELLKEAGLPDGVFNVVHGDKTAVDALIAHPDVAALSFVGSTPIAEYIHTEAARRGKRVQALGGAKNHLVVMPDANLDQAVDALVGAAYGSAGERCMAISVAVAVGGVADALVERLAERARTLKIGNGMQSDVDMGPLVTAAHRAKVSAYIDAGVAAGARLVVDGRKHVVDGCENGFFLGGTLFDDVTTDMSIYREEIFGPVLAVVRVPDFASAVELINAHEFANGVSCFTSDGGIARAFARKIQVGMVGINVPIPVPMAWHSFGGWKRSLFGDHHAYGEEGVRFYTRYKSVMQRWPDSIAKGAEFAMPVAK

SEQ ID NO: 13340 - protein, 388 aa, Bradyrhizobium sp. BTAi1
MFERLSRQPDDPLLALIGIFKADPRADKVDLGVGVYRDEAGHSPIFRAVKAAERLIWESQSSKAYVAPEGDQTYLDLLWTMVGGTASPVHAAGVQTPGGSGALRLAADLIRQAGTGKIWLGLPSWPNHAGIFAAAGLKIETYPYFDVPSQSLQLDSMIEALQRAEPGDAVLLHASCHNPTGAPLGAEDWARVTAVIAARGLVPLIDSAYQGFGAGFDGDVAGLRAMIAAIPEALIAVSCSKSFGLYRERTGALYAVAAAQAAADTARSNLVAIARTSYSMPPDHGSAIVKTILGTPDLYDDWRSELDSMRQRLATLRRAFADALGDRWSNSLAIGRQEGMFSLLPVTPADVMALREKHGVYMPTSGRINIAGLKLADVARVAGLFKAL

SEQ ID NO: 13341 - protein, 874 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPEAIVYRRMNDIPGDWGTAVNVQTMVFGNKGETSGTGVAFTRNPDTGEKGIYGRYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 13342 - protein, 552 aa, Oryza sativa
  misc_feature (291)..(291): Xaa can be any naturally occurring amino acid
MESLRIAASHRPPLLLPSPHQLRRRHIAAVSLSLPHTSLSLSSHHHHHHRLAPTPLRRRIPPLLASQTPNPEADSPAPAGTKLAPLLVSLAVGLAVRFLAPRPPEVSPQAWQLLSIFLSTIAGLVLGPLPVGAWAFLGLTAAVATHTLPFAAAFSAFTNEVIWLIVISFFFATGCGSAGLGDRIATYFVKWLGGSTLGLSYGLTISEAFISPAMPSTTARAGGVFLPIIKSLSLSAGSKPNHPSSRKLGSYLVMSQFQAAGNSSALFLTAAAQNLLCLKLAEELGIIVGQXHWVRMGSQAASLPAIASLLATPYLLYKIFPPETKDTPDAPALAAEKLERMGPVTKNEWVMIGTMLLAVSLWVFGDAIGVSSVVAAMLGLSILLLLGVLDWDDCLNEKSAWDTLAWFAVLVGMAGQLTNLGIVSWMSSCVAKLLESFSLSWPAAFCVLEASYFLIHYLFASQTGHVGALYSAFLAMHVAAGVPRVLSALALAFNTNLFGALTHYSSGQAAVYFGAGYLELPDVFRMGFVTALINILIWGVVGTFWWKLLGLY

SEQ ID NO: 13343 - protein, 251 aa, Arabidopsis thaliana
MATAVGSGSDVEVGFAKLQGEDFEYYMQSYSIILGRNSKKSTVDVDLSSLGGGMNISRNHARIFYDFTRRRFSLEVLGKNGCFVEGVLHLPGNPNVKLDSQDLLQIGDKEFYFLLPVWSILGGPLGPRHHVLGKATVVPYHNYHSGPGSGSGKNGVRSRELYEYDDEDDDEEEDIRGSGKKTWRDGHEGVYASGEKKREGRSKADREADDQQFLQLMHGSGWSVTDIKGVWKRMASQSSKKIPITRRLGYP

SEQ ID NO: 13344 - protein, 282 aa, Cryptococcus neoformans var. neoformans B-3501A
MISIPVSASTAPRLTPLIQLPKAQSRHRRHETALTSTCHFATLPPPPPNRSLMSDYDVTLVNNKMSEFFVKFKGPTETPFANGVWKIHVELPEQFPYKSPSIGFMNKIFHPNIDETSGSVCLDVINQTWSPMFELINIFEIFLPQLLRYPNPADPLNGEAASLLMRDPKAYAKKVESYVERFASAEDADQAGGDDESDEEYEPVPPKVKAKTNGVNGNVNGNGNGQPNGHANGNGNDNASGVNGVNGHGEEHEEDDEEDEDEKMSDMGEFSEDEEDIMGTMD

SEQ ID NO: 13345 - protein, 541 aa, Prochlorococcus marinus str. MIT 9301
MIRFEGVSKIYSTDVVLKNISWEIKKGEKVGLVGSNGAGKSTQFKILIGEEEQTSGTIIKEGNPKIAHLKQEFDCNLNFSVRQELESSFKDIQIVAIKLLEIEHKMKSLDIKKNSDELEILVNQLAKYQAKFEALGGYNMQSDVEKILPKLGFSMEDADKLVGNFSGGWQMKVALGKIILQKPDLLLLDEPTNHLDLETIFWLEEYLSSLKIAVMIISHDRYFLDKLCKKTIFVERGTCETYNGNYSFFVEQKSLNEESQNKAYQLQQKEIELQKRYIDRFRASATRSSQAKSREKQLKKISKIEAPIAKSKSPVFNFPECPRSGKLVLNIKNLSHSFEDKILFLDINLKISSGEKIAILGPNGCGKSTLLKIIMKKISPEIGDINLGKHNIITSYYEQNQAEALSLDERVIDLICSKSPEWSQKKVRTFLGGFGFQNESVFKYIKQLSGGEKARLALALMIINPSNFLLLDEPTNHLDLQSKENLELAIKNYKGSLLIISHDRYFISKVANRIIEIKDSKLFSYDGNYEYFLEKTQSQKI

SEQ ID NO: 13346 - protein, 632 aa, Magnaporthe grisea 70-15
MSSEAVQSWARQVQNLAQEKLCGSAPAQASNVTGFTDCVALLRPFDISDVPQYVWAVVAAVLGGLVFLKAFSGENDRPVPYTVPSPKTPEMVEILQKPSIKVSGSTAIQCYNPATGQFLGFVNPATPAAIDRAIEQAATAQKKWALTSFRERRKVLRSMLQYILDNQEEICRVAGMDSGKTMVDAQLGEILVTVEKLQWTIAHGEKALRPERRPTNLLMMYKRNSVHYEPLGVIAALVSWNYPFHNLLGPIISAIFAGNGILVKVSENTAWSSSYFASIARGALFAHGYDPSLIQTVACWPQVAGHITSHKGISHITFIGSQAVAHKVAESAAKVLTPVCAELGGKDAFIVLDSAAKDLNRIVEMMLRGTFQSAGQNCIGIERIIATPAVYDRIVLALAERVRGLRVGPGPLDADVGAMVSDASFDRLEHLVADAVRCGARLLAGGKRLIHPQHPSGHYFTPTLVVDVTPDMALAREECFGPIMTLMRAPANTAKAVLDVANAPDFGLGGSVFGRDSDPVLKEVVRGLRTGMVAVNDFATYYAVQLPFGGVGGSGYGRFAGEEGLRGISNAKSICEDRAGWLGVRTAIPPPMRYPVRDQDRSWRFAKGVVELGYGLTLGAKVRGLVGLAKNS

SEQ ID NO: 13347 - protein, 360 aa, Triticum aestivum
MGSTAADMAASADEEACMYALQLVSSSILPMTLKNAIELGLLETLVAAGGKLLTPAEVAAKLPSTANPAAADMVDRMLRLLASYNVVSCTMEEGKDGRLSRRYRAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 13348 - protein, 742 aa, Oryza sativa Japonica Group
MMGTAHHNQTAGSALGVGVGDANDAVPGAGGGGYSDPDGGPISGVQRPPQVCWERFIQKKTIKVLLVDSDDSTRQVVSALLRHCMYEVIPAENGQQAWTYLEDMQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARAANAPNCSSKVPEGKDKNRDNIMPSLELSLKRSRSTGDGANAIQEEQRNVLRRSDLSAFTRYHTPVASNQGGTGFMGSCSLHDNSSEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVNAERPNMEIANGTINKSGPGGGNGSGSGSGNDMYLKRFTQREHRVAAVIKFRQKRKERNFGKKVRYQSRKRLAEQRPRVRGQFVRQAVQDQQQQGGGREAAADR

SEQ ID NO: 13349 - protein, 120 aa, Rhodococcus sp. RHA1
MSDRIELRGLKVRGNHGVFEHEKRDGQDFYVDITVWMDLAPAAASDDLDDTLDYGGLAERAAAIVAGPPRDLIETVAAEIADGVMTDPRVRSTEVVLHKPSAPIPLTFADVAVVAHRSRP

SEQ ID NO: 13350 - protein, 387 aa, Zymomonas mobilis
MMKRTDNIALIVAAGQVNVQVKALQKQYRKTAGKANLAHAIDNLLAHPEIDTVQVVIADGHQTLYQEAVGDRDLPQPVIGGVFRRDSVINGLKAAHDRGYKRVLIHDAARPFLPKTVIDRLLDALKSSKAAIPVLPVVDTLVNQEVEAVDRNLFHRVQTPQAFDLETVIAAHQAWTGSDEPTDDAQVVRAFGKKIALVTGDRLLEKLTYPADFSVAEAQMTEKMISVCGSGFDVHCFEAGDHIMLGGIKIPHDHGLAGHSDADVALHALTDALLGAIADGDIGTHFPPSDPQWKGANSTQFLEYAVALAKKAGAIIDHADVTVICEAPKVGPYRPAMRKILPRFWGFLNKGSASKQRQLKSLVLQAAKKGSLPKRLPVFACRIFCAN

SEQ ID NO: 13351 - protein, 470 aa, Sulfolobus solfataricus P2
MMSQEVIEVRSPSNLNVIGTVKRMHKDEVRGEIEEAYKGFEIISKMPLYKRTAILRKVSEILEREQERLAKLLAMEAGKPIRDSRVEVLRASRLFRHAAEEVGMVLEGKNYRVDAYEYPPGNENRIVVSTREPIGVVTAILPFNFPINSFAHKVAPALAVGNSVVVKPSINTPLAAIEMKKILVEAGLPDSAVRVVTGYSSEIGDEIITHPLVGLITLTGSTQTGLKIASKAVSLGKRIIMELGGSDPIIILEDANIERASSIAVRARFEYAGQNCNAGKRIIVREEIYDKFVKAFNDKARALKVGDPLDETTDVGPVINKESVENLNSVLADAKAKGGKVEILNKGPESGSFFPLTMVTNPSLDMLVLKSEVFGPIVPIVSVKSDEEAIRIANSTEYGLQSAIFTNDVNRALKLSRELKFGAVIINDSTRLRWDSLAFGGFKKSSIGREGVRETMLEMTENKLIAITLL

SEQ ID NO: 13352 - protein, 746 aa, Magnetospirillum magnetotacticum MS-1
MYSNVVLGVEHHAFEEALEHYKEQKGLNLDTELKADDWKHLIGVYKKIVRDEHGSDFPQKPEDQLWGAIGAVFDSWMIPRAKKYRELNNIPESWGTAVNVQAMVFGNMGDTSATGVAFTRNPSTGESALYGEFLINAQGEDVVAGIRTPQDITEKARIEAKSDKPSMEKAMPESFAELTRIYGILEKHYRDMQDMEFTIERGKLWMLQTRNGKRTAKAALRIAVELAGEGLISKEEAIKRIEPGALDQLLHPTIDPNAERKVIATGLPASPGAAVGEIVFNSEAAEAARKAERRCILVRIETSPEDIHGMHAAEGILTTRGGMTSHAAVVARGMGKPCVSGVGSIRIDYKAQTLTVGGVTLKAGDVITIDGSTGQVIQGEVKMLQPELSGDFAALMEWADAVRTMKVRTNADTPADARAARKFGAEGIGLCRTEHMFFDGDRIVAVREMILADDTEGRRAALAKILPYQRQDFLELFTIMSGLPVTIRLLDPPLHEFLPHTDEEIREVMEATGIAEDKIRNRIRELSEHNPMLGFRGCRLAIAFPEIAEMQARAIFEAAVQAAKDTNAPVTPEVMVPLVFTRMEFDIVKARIDAMAKAVSEETGAQIDYQVGTMIELPRAALKAGEIAETAEFFSFGTNDLTQTALGISRDDAATFLGPYTQKGILPVDPFVSIDQEGVGELVKIGAERGRKTREKLKLGICGEHGGDPASIGFCQEVGLDYVSCSPFRVPIARLAAAQAALGKDA

SEQ ID NO: 13353 - protein, 480 aa, marine gamma proteobacterium HTCC2080
MSEQHALYIDGNWVNTPEAIANRNPSDTDDVIGHYAQANTEQVKEAIDAANRAVAQWGQSPLETRYQVLMAIGDELIQRSAELGELLAREEGKTRAEGVGEVYRSGQFFHYYAAEVHRQIDDRAESVRPGIEIETRREPVGVVVVISPWNFPMATAVWKIAPALAFGNSVILKPANLVPASAWALTEIIARQAALPSGAFNLLMGSGSQVGNTLINSDQIHAVSFTGSLPVGRQVASATAANLVKCQLEMGSKNALIVAADANLEVAVNAAFVGAYSGTGQKCTASSRLIVDAKVYDEFVARLGEKLSATRVGHALEDGVDMGPIASEEQLEANLAWIQRGVAEGAQLTQGGERLSLDKPGYYMSPALFVDTDNAMAINREELFAPIASVIKAKDYEHALEILNDTEFGLTAGIITQSLALAMDFKKRAVSGCVMVNLPTAGTDYHVPFGGRKNSSFGPREQGQYAREFYTTVKTTYIQA

SEQ ID NO: 13354 - protein, 369 aa, Pelotomaculum thermopropionicum
MFEYMGKELFAKYGLPVPKGRMAPNPDEAAKIAAEIGGPCVVKSQVLIGKRGKAGGIKFPNSPEEAKKAAEEVFAMTIQGLPVEAVLVEEKLKIDKELYMSITVDGAAKMPVLIASAYGGMDIEEQPEEYIIKKHIDPEMGMQAFIARDVVRQMGISLNSAHGKQLVSIIQTLYKIFKEQDAELVEINPLVFSDDKVIAADAKVTIDDDALFRHKDLPYVEDRTATEKAAKDLGLSYVELDGDIAVMANGAGITMTTLDTLQYYGGRPANFLDCGGGTGREVTAKALELLLTKNPKVIFVNIFGGITRCDDVANAIADVKKDKGIPMPIVVRLVGTNQDIGREILKGVGIEAFDFMNEAAQKAIELTKA

SEQ ID NO: 13355 - protein, 301 aa, Erythrobacter sp. NAP1
MKSFPAPALHIVDALRSAAAADPVRAIAFQGSPGANSHRAAIEARPDALPLPCFGFEDALEAVKDGRAGQAIIPIENSQHGRVADIHFLLPESGLSIVGEYFMPIHHALMAPGPRTDGDRIEAVYSHPQALGQSRKYLHERGITPLSYIDTAGAAAHVAEIGDRTIGAIAPAIAAEHYGLEIIENNVEDAHDNMTRFVILADRPTFITHDESKPAMTTFIFEVKNIPAALYKVLGGFATNGVNMTKLESYQIGASFSATMFYADIIGAPGDPAVDRALEECAFHSKELRLLGTYEQARKRG

SEQ ID NO: 13356 - protein, 308 aa, Geobacter metallireducens GS-15
MEHTPFSLSGSIGSTPLVEIRKLNPNPKVRILAKLEGNNVGGSVKDRPALYMLAKAEAAGELSPERTILEPTSGNTGIAIAMLGAAKGYRVKLVMPACVSLERRAVLEAYGAELVLSPAEEATDGAIRLAHRILDEEPDRYYMPNQYANPNNPLAHYETTGPEIYRGTDGTVDFFVAGMGTGGTLMGVSRYFRETKPSVRIVGVEPRLGHKVQGLKNMQEAIVPAIYNPAALDLKLTVQDEPAFDTARDLAVREGLFVGMSSGAAMAGAIRVAKDAPAGSTIVVLLPDRGDRYLSTVLFRSVCGKCPP

SEQ ID NO: 13357 - protein, 163 aa, Yarrowia lipolytica CLIB122
MSALRMSLRVARVARVARVGVRFNSTAAPVDPKITAIVDQIAQLNLLETSSLVTELKSRLNIPDISFPAAGAAPAAAPAAAAEEAAPEPVEEKTIFNIKLESYDAKAKPKVIKEIKTLLGLSLVDAKKIVDAAPKMVKESVPKEDADKIKKVLEDLGAKITLE

SEQ ID NO: 13358 - protein, 123 aa, Glycine max
MAEVEEGQVIGVHTVDEWKLQLQNAKDSKKLIVVDFTASWCGPCRFMAPVLAEIAKKTPELIFLKVDVDEVRPVAEEYSIEAMPTFLFLKDGEIVDKVVGASKDDLQATIAKHASAVAAASSS

SEQ ID NO: 13359 - protein, 342 aa, Symbiobacterium thermophilum IAM 14863
MDMAILPAGVWGTALAVPASAAGRRVRLWRRTPGWAESWDRGHPVLPGLKLPENVVACDSAQAAVSDADLVILSPAGAGLRPVCRLVRPHLRPDAVIVCATKSIEPETHLLVHQVVEEELPGHRGRIVALSGPNFAHEVAAGLPTGAVAACPDLSLADWVQQALMTDRFRVYTNPDLVGVELAGALKNVIALGAGISDGLGMGDNARAALITRGLVEMARLGRAMGANPLTFAGLAGMGDLVLSCTGDSSRNRRAGLAIGRGQSAEAFLAETGLTVEGITTARAGWQLAQRLGVRMPITEAIYQVLYEGLPPLTAMERLMARPRAHELEEVAGADLKPPFDP

SEQ ID NO: 13360 - protein, 87 aa, Triticum aestivum
MAMRALYNEIRPIKVRNVPGSLKPRLPWENVKKSPAQAVGRSIEKYIEPSSVDPLFPVCLGGMAFAYLVGLPQERPPLEPLEKPGGP

SEQ ID NO: 13361 - protein, 332 aa, Glycine max
  misc_feature (67)..(67): Xaa can be any naturally occurring amino acid
MASLFNNANGVLGKSEKLIIDTDPGIDDSMAIFMAFQSPDVEVLGLTTIFGNTTTEVSTRNALLLDXCEIAGRENIPVAQGSPEPLKGGTPRVADFVHGKDGLGNTFLPPPKGEKIEKSASEFLVEKVSEYPGEVSVLALGPLTNVALAIKRDSAFASKVKRIVILGGAFFALGNVNPAAEANIHGDPEAADIVFTSGADVVVVGINITTQVQFTDADLLDLKESKGKYAPFLSDICKFYRDFHVKSDRVHGIFLHDPVSFVAVVRPDLFTYKKGVVRVETQGICVGHTLLDQGLKKWNTSNPWTGYSPVAVAWTVNVKGVLDYIRELLMKP

SEQ ID NO: 13362 - protein, 389 aa, Haemophilus somnus 129PT
MNLHEYQSKKLFADYGLPVTKGYVCENVEQALSAIEKLSGSQWIAKCQIHAGGRGKAGGVKVVKSAQEVRSFFTKFLGQRLVTVQTNEQGQPIHQIYLEPCAEIQKELYLSAIIDRSSQRIVFMASSEGGMDIEEVAEKTPHLLHRVTIDPLVGAMPYQGRELAFKLGLSGKQIQQFSQIFCQLAKLFVEKDLSLLEINPLVILKNDELFCLDAKVVVDDNALYRHPDLFSMRDLTQEDPREAEAEKWNLNYVALDGNIGCMVNGAGLAMGTMDIIKLHGGRPANFLDVGGGATKERVMEAFKIILTDSAVKAVLVNIFGGIVRCDLIAKGIVSAINEIGVSVPVIVRLEGTNADLGCEILAQSNLNLIAVNSLTEAAEQAVNAAKESE

SEQ ID NO: 13363 - protein, 407 aa, Haemophilus somnus 129PT
MSNFDIITPDLPESVADATVVTWHKNVGDAVKCDEVLVEIETDKIVLEIPALSDGVLETILQPEGSTVVSKQLLGKVSASAGIGEVTKSTVQNVEKTPADRHSANLNTDASSDVLSPAVRRLLAEHELNADEIKGTGVGGRITREDIALVVKQKAQQTETAQASQSIATGLKIDHRNEKRVPMTRLRKRIAERLLEAKNTTAMLTTFNEVDMQPIMNLRKRYAEKFEKQHGARLGFMSFYIKAVVEALKRYPEINASIDGDDIVYHNYFDISIAVSTPRGLVTPVVRNCDKLSMADIEKEIKLLAEKGRDGKLTVEDLTGGNFTITNGGVFGSLMSTPIINPPQSAILGMHAIKDRPVAVNGEVVIRPMMYLALSYDHRLIDGRESVGFLVTVKDLLEDPTRLLLEI

SEQ ID NO: 13364 - protein, 444 aa, Arabidopsis thaliana
MPTFSAAALGRSLNSGTSLSSKFPSTLQSKPSILNDESKQPKEKTFTRPQMSPSLYATTKEIPHPNSPSSYPPSPYIINHKARGPVLFNRDSEVDGPSHPITSGEEKISGNVDVEATASLSKSTSLSFPITEAIAVDHTNGVHTQGIHERPVWDCSPPLGTFLNEKSGRDISNGGIGSNNATSNLEWQSYLLEPVRIKADKELEPENFYNPGELVSFTSNTEVEDFERAESSHSLATHVGEFYDACDELSTDSGMQSSANNIESEVREMRLGLLMEIERRRQAEATLEQMQVHWRRLRDQLADVGMFLPLDPTRSQYSMNLADELRCQLEVTRFVSDTLGSDLAKTEVEMEMEAELEAKNFEITRLSDRLHYYETVNQEMSQRNQEAIEVARRDGQKRKRRQRWIWGSIAATITLGSGVLAWSYLPPGMLSSDEAQPQLSPKDS

SEQ ID NO: 13365 - protein, 354 aa, Streptomyces coelicolor A3(2)
MTGARPAPEEHDDTPVRGPVEGAAGPAAGHWWPPRGPVVCVGETMAAMAPAPPDSLDDTESLRLSVAGAESNVAVYLADLGLPVSWLSALGDDAFGRRVRAAVARAGVDVSGVRTDPARPTGLLLKEPGAAGTRVHYYRRGSAASALGPDVLDDERFGGAALLHLTGVTPALSPSCRALVERALRTPPARRTHAVSFDVNHRPALWPPDTAAAVLRDLADRADIAFVGLDEAQDLWGGGLTATDVRRLLSGPRVLVVKDGGRSATAFTGQGACTVPALATEVVEPVGAGDAFAAGFLAGLWRGTDLTRALRLGHITAASALKVVGDHGPLPDEDTVGAMLSLTEQDWCRAPVVS

SEQ ID NO: 13366 - protein, 213 aa, Triticum aestivum
GKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 13367 - protein, 470 aa, Arabidopsis thaliana
MFSLRNLPSLAPFVSAYASLTGYVMMIKPFLEMTIPPPLQNYMISYLNSFLHSTPSTLTLIIDDHIKNGMYNELYGAAQVYISTKVNHNAERLRISRDRSEKNVNIHFSVGEVVSDIYQGIEVKWRFCVDSNKSNMVHYFGEHFKLNPDRECVELSFEKKHTELVLNSYIPYVESKAKVINNERKILKMYSYCCMYLKWQSVNLEHPSTFDTMAMNEELKRSVMGDLDRFIRRKDFYKRVGKPWKRGYLLYGPPGTGKTSLVAAIANYLKFDIYDLQLASVREDADLRRLLLGTTNSSILLVEDIDCAVDLHTRLQPKTQDDTKGSSMLTLSGLLTCIDGLWSSCGDERIVIFTTTHKERLDPALLRPGRMDMHIHMGHCCFDVFKTLASNYLGLSHDDPHHLYPEIERLIKGEVLTPAQVAEELMKNEDPDVALEGLVKVLKRKRLELEKYDGETGRGGLRKPELQFFL

SEQ ID NO: 13368 - protein, 315 aa, Erythrobacter sp. NAP1
MSEFGHDTTADEVLEGKDLSGKTVFITGGNSGLGQETGRAMAAKGAHVILAGRDQGKLDEAVSAIRSEVPDANLETITCDLASLDSVHAAGAEANERFDKIDLLINNAGVMACPKMHTDDGFEMQLGTNHLGHFALTKHLMPLVEAGTDKRIVNLSSRGHHIAPVDFDDPNFESTDYVPFLSYGRSKTANVLFTVGLEKRFGDKGIHSYAVHPGGIQTNLGRHMSEEESAALVERVTENDPGFSWKTIPQGAATQTWAATADELEGKGGLYCEDCNVAEVDDASPNSGVRTYALDPVAADKLWAMSEEMTGVTFA

SEQ ID NO: 13369 - protein, 328 aa, Dichelobacter nodosus VCS1703A
MHSATAFAPANIALAKYWGKRDAQLNLPTNGSLSISLAHLGTTTTISAGERDQLYCDHRLLPPDTAFVQKVWHFIDFCQPKRPPLVIHTQNNIPTAAGLASSASGFAALTLALNDFFQWSLSREQLSQIARRGSGSACRSLWQGFVYWQKGEKADGSDCYARPIASDWQDLRLGIITIDAAAKKISSRQAMNHTAASSPLFSSWTQAAEADLKVIYQAVLDRDFLTLAQTAEANALMMHASLLAARPAIFYWQPQTLAMLQCIWQARAEGLAVYATLDAGANVKLLYRAQDEAEIASMFPQAQLINPFQTVTSSARHTGEDAQKPSLK

SEQ ID NO: 13370 - protein, 575 aa, Marinobacter sp. ELB17
MNLSRYLPVLQWSTQYNRQQAGSDLVAALIVTVMLIPQSLAYALLAGLPAQIGLYASILPLVVYALFGTSRTLSVGPVAVASLMTAAALAPLAQAGSAEYIVGAVVLALMSGLMLVLMGVLRLGFLANFLSHPVISGFITASGIVIAASQLKHVFGITGSGHNLFDIGRSLWASANNINPATLAVGVSTLVFLVLARTRLKLGLLALGVAPQLADVVTKTAPILAVVLTTLAAWFWQLQLQGVKLVGHVPSGLPQLTWPQADWALWQQLAVSALLISVVGFVESVSVGQTLAAKRRQRIDPDQELIGLGAANLGSGISGGMPVTGGFSRSVVNFDAGAETPAAGIYTAVGIAVATLFLTPAIAWLPQATLAATIIVAVSTLIDMPALRRTLHYSRADFGAMLTTIVLTLGHSVEAGIIAGVALSLGLFLYRTSRPHCAVVGRVPGSEHFRNVLRHKVDVCPTVTFLRVDESLYFANARFLEETVLDIVNREPQLTDLVLVCPAVNLVDASALESLEAINERLKDAGVRLHMSDVKGPVMDRLKRTEFCQHLSGGVFLSAHEGWKALVTGAKNDDS

SEQ ID NO: 13371 - protein, 486 aa, Pseudomonas putida
MKEIKHFISGAFVGSASGKLFDNVSPANGQVIGRVHEAGRAEVDAAVKAARAALKGPWGKMTVAERAEILHRVADGITARFDEFLEAECLDTGKPKSLASHIDIPRGAANFKVFADLLKNVANDAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLADDSAVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 13372 - protein, 176 aa, Campylobacter upsaliensis RM3195
MNLPNLLAILRMILAPLLFFVLTFPFENVHQSWINYFATLLFSLAALSDFFDGFIARKWGQTTKLGAILDPLADKMLILAAFLGLLLLDRANEWVIYLILVREFFITGFRVVMVSENLDISASFAGKLKTGFQMTAIIFLMLDWIFGDILLYIALALTLYSGFEYVYHYIKHRKKR

SEQ ID NO: 13373 - protein, 421 aa, Symbiobacterium thermophilum IAM 14863
MGLVVQKFGGSSVATAEKYRRVARRIAWKKRQGNDVVVVVSAPGDMTDDLIERARSITDRPSAREMDVLLATGEQISIALLTMALHELGVDAVSLTGPQAGFQTDDHHRAARIVNIDTARIRRELAAGRVVIVAGFQGMDDHGDITTLGRGGSDASAIALAAYLSADQCQIFTDVDGVYSADPRIVPTARRLDEISYDEVLELAAAGAQVMQLRSVELAKQYGVEFEVLSSLAPLPDEGGEERGTKVVAKLSPNNHRIVSGVAVDSKVAHITLLGLPDRPGVAYRAFKALGDARINLDMIVQSAGTGCGNGPTADISFTCARDDLETALEVCNRLLPEFPGARVVYDTDVAKVSIVGSGVASNYGVAARMFEALAEKDINIELITGSEIKISCLVRASRAMEAVRAVHDKFELGDVAPIVQ

SEQ ID NO: 13374 - protein, 428 aa, Thermobifida fusca YX
MSHKPHLRPSPLAASHRTLSPSTWMGTRTDSLRGFYVTSDRSSRLDDDPAFALHRGGKLEVRSTVEVNDQKSLSLAYTPGVARVCTAIADTPELADTYTWKNNVVAVVTDGTAVLGLGDIGPEASLPVMEGKSLLFKQFAGIDSVPIALACTDVDEIVETVVRMAPSFGGINLEDISAPRCFEIEQRLRERLDIPVFHDDQHGTAIVALAAIRNAARVTGRELSDLRAVVSGAGASGIAVSRMLIRGGIGDIAVADSKGLIYEGRPGLNKYKAELAAISNKAGLQGSIESALAGADVFVGLSAGEVPEEVVATMADNAIICAMANPNPEVHPDVARKYAAVVATGRSDFPNQINNVLAFPGVFRGALDVRATQITENMKLAAATALADLVGDDLAPDYIIPKPFDERVVPAVAAAVADQARKDGVARA

SEQ ID NO: 13375 - protein, 384 aa, Enterococcus faecalis V583
MDRKNIATRYQQPTENLLMDIATLAKKTPNLIDLSIGDPDLITDERIIEQAANDAKNGHTKYTASDGSEAFIEAVIQFYQSHYQLSFQPNQVRATVGALHGMYLALQVILNPGDEVIIHEPYFSPYKDQVLLADGVPVFLPTYEEDGFQIDVALLKEKITPKTKAIILNSPNNPTGAVFSEETFREIAQVAIEHNLYILSDEVYEAFCFQETFTPMATFAPENTITFGSFSKAFAMTGWRIGYMIAPDYINEVAKLINEGVTYSAPTLSQQAGIYALQHFDEFVDPIVEVFQTRLEYVAQRVAKIPFLSLHPVKGSIYAFINIQKTGLTSVPFVEKLLKETQVLVIPGKAFGETTGDEYIRLAATQNLDLLKEAFDRIERMTFE

SEQ ID NO: 13376 - protein, 514 aa, Cucumis sativus
MGHPLDHSDAHHRPPSNGVIKVLPPDSDPSLPPPLPKQLPTSSAPPALGRVLARPFSDVRSFYSFRGELGRGQFGVTYLVTHKETKQDFACKSIATRKLIDQDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 13377 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKFLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDEA

SEQ ID NO: 13378 - protein, 360 aa, Streptomyces peucetius
GSPNSTAEPTVAARPQQIDALRTLIRLGSLHTPMVVRTAATLRLVDHILAGARTVKALAARTDTRPEALLRLIRHLVAIGLLEEDAPGEFVPTEVGELLADDHPAAQRAWHDLTQAVARADISFTRLPDAIRTGRPTYESIYGKPFYEDLAGRPDLRASFDSLLACDQDVAFDAPAAAYDWTNVRHVLDVGGGKGGFAAAIARRAPHVSATVLEMAGTVDTARSYLKDEGLSDRVDVVEGDFFEPLPRKADAIILSFVLLNWPDHDAVRILTRCAEALEPGGRILIHERDDLHENSFNEQFTELDLRMLVFLGGALRTREKWDGLAASAGLVVEEVRQLPSPTIPYDLSLLVLAPAATGA

SEQ ID NO: 13379 - protein, 309 aa, Shewanella sp. MR-7
MVNINRFFPLFALVGAGTAYLMPAWFSGLKTSIVPLLVVIMLSMGLTLDVRDFANAFKQKRAVITGLILQFTLMPLSALAISLLLGLNRELTIGMVLVGSVAGGTASNVICYLAKGDVALSITMTALSTLAGVVLTPLIIELLIGEMVAIPLMDMLVSLVKIVLIPVTVGVVLNHFFKPQVAKLAPALPIISIVAIVLAISIIVALNAGQFSQVGPVILLAVFLHNGVGLALGYTCCRLLGFNHTVCKTISIEVGLQNSGLATALCIKFFSPLSAVPSAIFSIWHNLSGALLAGYWANLEQKKQSEEVE

SEQ ID NO: 13380 - protein, 548 aa, Pseudomonas sp. BW13
MITLSISGMTCASCTHHVQEALLAVAGVSSAMVSYDEANAVIETDTDIQKTLLDAVATLGYKAKVVALGNNSRLTKDEDTEELHVAIIGSGSAAFACAIKAAEAAKVTLIEGADVIGGCCVNVGCVPSKILIRVAQLAEQRHNPFGGLENHSPQLSRSLLLAQQTARVEELRAAKYQNILDANPALSLIKGWARFKDANTLIVSQNDGTQQQVHADKVLIATGSTPTIPPIEGLSGTPYWTSNEALFAEEMPQHLVVIGSSVVALEIAQAYRRLGSEVTVLARHTLLYREEPLLGEQLSGCFEKEGIRVLNHTQASSVSYDGQQFTLEILSSEAGAGTLHCDKLLISTGRHANTGKLNLDAVGVKTEQNGVIIVNERMETSVPGVYAAGDCANMPQFVYVAAAAGSRARINMTGGETKLDLSAMPAVIFTDPQVATVGLTEDQAKAQYIETDSRVLSMENVPRALANFDTDGFIKLVVEKVSGRLIGPQILAHEGGELIQSAALAIRNRMTVTELSEQLFPYLTMVEGLKLCAQTFNKDVKELSCCAG

SEQ ID NO: 13381 - protein, 493 aa, Cucurbita maxima
MEFHQIDERNQALLSKIAVDDGHGENSPYFDGWKAYDNDPFHPEDNPLGVIQMGLAENQLSFDMIVDWIRKHPEASICTPKGLERFKSIANFQDYHGLPEFRNGIASFMGKVRGGRVQFDPSRIVMGGGATGASETVIFCLADPGDAFLVPSPYYAAFDRDLKWRTRAQIIRVHCNSSNNFQVTKAALEIAYKKAQEANIKVKGVIITNPSNPLGTTYDRDTLKTLVTFVNQHDIHLICDEIYSATVFKAPTFISIAQIVEEMEHCKKELIHILYSLSKDMGLPGFRVGIIYSYNDVVVRRARQMSSFGLVSSQTQHLLAAMLSDEDFVDKFLAENSKRLAERHARFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRRRENKLRLSFSFSGRRYDEGNVLNSPHTMSPHSPLVIAKN

SEQ ID NO: 13382 - protein, 1299 aa, Ceratodon purpureus
SSTTSAKSKHSVRVAQTTADAALEAVYEMSGDSGDSFDYSKSVGQSAESVPAGAVTAYLQRMQRGGLIQNFGCMVAVEEPNFCVIAYSENASEFLDLIPQAVPSMGEMDVLGIGTDIRTLFTPSSSAALEKAAATQDISLLNPITVHCRRSGKPLYAIAHRIDIGIVIDFEAVKMIDVPVSAAAGALQSHKLAARAITRLQALPGGDIELLCDTIVEEVRELTGYDRVMAFKFHEDEHGEVVAEIRRMDLEPYMGLHYPATDIPQASRFLLMKNRVRLIADCYASPVKLIQDLDIRQPVSLAGSTLRAPHGCHAQYMGNMGSIASLVMAVIINDNEEYSRGAIQRGRKLWGLVVCQHTSPRTVPFPLRSVCEFLMQVFGMQLNLHVELGAQLREKHILRTQTLLCDMLLRDAPIGIVSQTPNIMDLVKCDGAALYYGKRVWLLGTTPTENQIKEIADWLLEHHNDSTGLSTDSLADANYPGAHLLGDAVCGMAAAKITAKDFLFWFRSHTATEVKWGGAKHDPDEKDDGRKMHPRSSFKAFLEVVNKRSPPWEDVEMDAIHSLQLILRGSFRDIADSDTKTMIHARLNDLKLQGVEERNALANEMSRVLETAAAPILAVDSRGMINAWNAKIAQVTGLPVEEAMHCSLTKDLVLDESVVVVERLLSLALQGEEEQNVEIKLKTFGTQTTERAVILIVNACCSRDASDTVVGVFFVGQDVTEQRMFMDRFTRIQGGEKTTVQDPHPLMRPSFDGDEFGRTFKRNSALGGLKDHATGSVERLDLYLRRAEECMEVMETIPSPKFNNKQCQYLAGKLKAVLQSASLFLRISHHEHHELGASIDMGRHVEIFKLLLALAKEIESFIQGCCKDEWIKAAMTLTNVSEYVSSMGFNLELCKIAFCKSCAASGSLTLDQIEVICKDEAEVVKRNATIDVDTLFAKVIYDLTEKTLSSDQNDLAIYLLQRLKRAKPILPSFSSRPSWWNFYDDWSFSEKFFQWIQITGSLGSGSSATVEKAVWLGTPVAKKTFYGRDNEDFKREVEILAELCHPNITSMFCSPLYRRKCSIIMELMDGDLLALMQRRLDGNEDHDSPPFSTLEVVDIILQTGEGMNYLHEKGIIHRDLKSMNILVKSVKVTKSEIGYVHVKVADFGLSKTKDSSTRYSNQTWNRGTNRWMAPEVINLGYESTEGEISFDGKVPKYPLKSDVYSFGMVCYEVLTGDVPFPEEKNPNNVKRMVLEGVRPDLPAHCPIELKALITDCWNQDPLKRPSFAVICQKLKYLKYLLMTGFSSYQDSYPSTEELS

SEQ ID NO: 13383 - protein, 493 aa, Cucurbita pepo
MGFHQIDERNQALLSKIALDDGHGENSPYFDGWKAYDNDPFHPENNPLGVIQMGLAENQLSFDMIVDWIRKHPEASICTPEGLERFKSIANFQDYHGLPEFRNAIANFMGKVRGGRVKFDPSRIVMGGGATGASETVIFCLADPGDAFLVPSPYYAGFDRDLKWRTRAQIIRVHCNGSNNFQVTKAALEIAYKKAQEANMKVKGVIITNPSNPLGTTYDRDTLKTLVTFVNQHDIHLICDEIYSATVFKAPTFTSIAEIVEQMEHCKKELIHILYSLSKDMGLPGFRVGIIYSYNDVVVRRARQMSSFGLVSSQTQHLLAAMLSDEDFVDKFLAENSKRVGERHARFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRHRDNKLRLSFSFSGRRYDEGNVLNSPHTMSPHSPLVIAKN

SEQ ID NO: 13384 - protein, 399 aa, Haemophilus somnus 129PT
MIFDPTLFRQQFPFFHQKNGITYLDSAATTLKPQVLLDATQHFYASAGSVHRSQYDAKQTALFEQARKQVQKLINAESEETVIWTSGTTQSINIVAYGLMAQLSPNDEIIISEAEHHANFVTWQQIAKKCGATLIILPLQDNLLIDQQILQKSLNKKTKLVALNVISNVTGTQQPLTQLIPIIREKSSALILLDCAQAINHQTIDLQRLDADFIVFSAHKIYGPTGLGVLSGKRSALERLQPSFFGGKMVEQVSKQETVFASLPYRLESGTPNIAGVIGFGAVLNWLEQWNITQGEQFAVQLAEKTKERLKNYPLCRLFNSPHPSTFVCFTFTTIATSDIATLLAEQHIALRSGEHCATPYLQRLGQKSTLRLSFAPYNNQEDIELFFSALDKSLELLA

SEQ ID NO: 13385 - protein, 188 aa, Glycine max
  misc_feature (128)..(128): Xaa can be any naturally occurring amino acid
GISYVLLLNIVCKCSNKVISLPVSSSFCRQAWQKLGAMPPEDAMQKYIDIVTEIYPTWLDGSSLRNKSGDSGGHGSEAKGPMGPVFSTFVYEEEYGSDSQMEAIHGFAREGDMANLLKCIENGVSMNXRDNDGQTPLHYAVTCEREAIAEYLVKHNADIYSKDNDGSSPRDICESNWPCMQHVGEEVN

SEQ ID NO: 13386 - protein, 80 aa, Glycine max
  misc_feature (25)..(25): Xaa can be any naturally occurring amino acid
  misc_feature (53)..(53): Xaa can be any naturally occurring amino acid
  misc_feature (71)..(71): Xaa can be any naturally occurring amino acid
WKVAAPSGFVLSPVSSGWLAFCIAXVISVVPLMWVRSKVLFLHSGGLLGLYAXVDLLASFVGSWQRMDVNXSVPRQDGIG

SEQ ID NO: 13387 - protein, 601 aa, Dichelobacter nodosus VCS1703A
MTNLNILYLVFSMLLFISVIGSTLSARSGIPLLVLFLVIGMLAGEEGIIGIRFNQFFFANLLGQAALAVILLDGGLRTSLTNIRIAYKPALPLATWGVIATAVISGLFITWILAKYGYIEKGNWRYGMLMASIVGSTDAAAVFSLLRNGGVRLNARVQSTLEVESGANDPMAILLVTAFISLNLHPEEQNLLSFSTLLITQFALGILIGLTSGYLLARLLQRLHLPEGMYAILIFSAGILTFSMTNLLGGSGFLAVFIAGIVIGNHHVRATEHVLRVMDGMAWLSQAVLFVMLGLLITPSQVVKILPLVAVISLFLIFIARPLAVISVLIFCRFNPREIGFISWVGLRGAVPITLAIIPIMENVPNARFLFDLTFGVVIISLVLQGMTLPFAAELFKVKIPPSAHPSNEHEIWVGDRASIRIYEFNVKKGAFGINQHPDAISRRLGEEEIRLFALVRQDKVEAVTPQTKIRVGDRLWYAVNGDHAHALAVVLNDTYVTRQQRNEFFGEWVISSQVVIADLSLLEEVDLPEEERKLTASELFHRRLGENIVVGDHIELGDRWFLTVRETDQHGQISAIGLKLDTQAHQKSSEPLPAVNNSAA

SEQ ID NO: 13388 - protein, 500 aa, Atriplex prostrata
MAFPMPVRQLFIDGERREPLLKNRIPIINPSTEEIIGDIPAATAEDVEVAVVAARKAFKRNKGRDWAATSGAHRAKHLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 13389 - protein, 383 aa, Synechococcus sp. WH 8102
MPHPSSRQAHLVLADGTVLTGDAFGHRGSVVGEVVFNTGMTGYQEVLTDPSYAGQLVTFTYPELGNTGVNGDDQEADHPHARGVIARQLAPCASNWRCSESLDNWMERHGLVGICGVDTRALVRRLRDGGAINGVISSDGRSPADLLAEVRHAPSMEGLNLASQVSTTEPYEWSSPCRVGFDQRLKQHPDLPYRVVAIDFGIKRAILDRLVAHGCAVTVLPSDADLDTVMSHQPEGVFLSNGPGDPAAVDSGIDLARSLLERANLPLFGICLGHQILGLALGGKTFKLGYGHRGLNHPCGTSGQVEITSQNHGFAISADSLPEPMVEVTHLNLNDRTVAAFQHRHQPVFGIQYHPEASPGPHDADHHFGRFVALMADRRDVGG

SEQ ID NO: 13390 - protein, 914 aa, Magnaporthe grisea
MDGHSNFTQPSDTSHASHTIPSSSSSQRRRLTKKPPPSTSARHHHSSLSIDSRVDAQSLVGKRSSTSLRRAPSAPPARTPTSTHASNSSSPRNPSSSTRLNNHSPIIPAASEFAASSLSPSARDRDSDPARNDHGHQLQNNNNYYYSAFTNAHHHNQYSAASHRRSNSYGHPHGPQSSNSLTFNHSEDFIGAPFDGSAILNRIEATKASPTLGSGAFPHISNPIPVGAAAPAQYSRGSPALEQSFTFPSAAMSEKSQQVRGMEAQLPTSKRYSDETKEPKPGVLRKKSGFSGFMSGLVGTPKKQKISAPENPVHVTHVGYDRATGQFTGLPKEWQRLISESGITEKERRENPETLVNVIKFYKETTEKPAEDQVLEKFHDARPGLPSAPSAGSMISPGLAPHHYNPMSPMISPPASPRFPQVGHEGNFENPRSPPPVPKNKDVTLMPSRPAPRPPVSLPTRTAPHAPYAAKDSGIDMPPQHDDLTPTTYQPPKESQPILPEEHRSRSNSRVNGNTAYPASQQSPAVQAAYQQQLMQQQQEQALAQAQASMSGSMSRAPSKRQPQAQQPTPPQSQHQYSRPTDANGAQQTQRPQQPQIGPVPQSRPRHRSRQSNGLDVVAALKRICSEGDPREIYRSFTKIGQGASGGVYTGHERGSNRLVAIKQMNLEQQPKKDLIINEILVMKDSSHPNIVNFIDSYLCGGELWVVMEFMEGGSLTDVVTFNIMTEGQIASVCRETLLGLQHLHSKGVIHRDIKSDNILLSMEGNIKLTDFGFCATINEAQNKRTTMVGTPYWMAPEVVTRKEYGRKVDIWSLGIMAIEMIEGEPPYLTESPLRALWLIATNGTPQIKDEGNMSPVFRDFLYFALKVDPDKRASAHDLLRHEFMNLCVDLSHLSPLVRAAREARAQEKARKGQ

SEQ ID NO: 13391 - protein, 157 aa, Dehalococcoides sp. VS
MRVGNGYDVHRLAPGQKLVLGGVEVPFECGLIGWSDADVLTHAIMDSLLGAAALGDIGLYFPPGDPKFKGISSLKLLEQVTALLAEKGFGIINVDSVIVAEEPKLRGHVDTMRKHLAKAMGIDPGRVGIKASTSEQLGFVGREEGMAAWAVALVDEK

SEQ ID NO: 13392 - protein, 402 aa, Zea mays
MGAADKWLLPLVSVSFVSLLLFLSALSGFSASSALFARLPPPSYVRRGAAAPPSFAYLLAGGRGDGRKLLRLLLAVYHPRNRYLLHLSADAPASERAELAAAVARAAPAVRAFSNVDVVGRPTAGTPMGSSGLAATLRAAAAMLRLDAEWDWFITLNAADYPLLTQDDLIHVFSSVPRHLNFIDHTSDIGWKESQRVQPIIVDAGVYLAGRNQFFQATEKRDTPDSFKFFTGSPWVILNRRFVEYCIFGWENLPRTLLMYFTNVMLPLEGYFHSVACNSDFRNFTVNNYLRYMIWDNPPQMEPHFLNVTHYDELVGTGVPFARKFKENEPLLDKIDDQVLRRWHQRPVPGAWCTGRRRWFSDPCSQWSNVNIVRPGPQAEKFRTYINQIMEESKSGNNSCKQ

SEQ ID NO: 13393 - protein, 244 aa, Campylobacter upsaliensis RM3195
MSSIYILANGAMASALAYGLRDFYEIYIVGRETQKLEYLKKEGFKTLLYNEFDLENKNVILAFKPYALNEMSQILKGEARILISVLANTSLKELECIRAQNIARIMPNIAAKYKASTTPFILKNELFKEEIIQILTSFGNAYELSSEKQMPSAMALSGCAPAFLSLVAEALANGGVYRGLDKELSLKLTQGLFESFSTLLAHEHPALIKESVCSPAGVSIKGVKVLEERAIRAAFMEAVYISSK

SEQ ID NO: 13394 - protein, 150 aa, Symbiobacterium thermophilum IAM 14863
MERSFVMVKPDGVQRGLIGEVISRLERRGLKLVAAKLMRVSRELAEEHYAQLKDKPFFPSLIEFITSGPVMAMVWEGPNAISIIRKTMGATNPANAEPGTIRADFACDVSYNVVHGSDGPESAEREIRLWFGEVEPSYSRSVDRWIFPEG

SEQ ID NO: 13395 - protein, 391 aa, Thermobifida fusca YX
MSEPLVARMAAFGETIFAEMTRLAEHTGAINLGQGFPDTDGPPFLLAEAARYLTEGVNQYPPGYGREELRTAIAADRQERYGLAYDPATEVYITVGATAGIAASILALVEPGDEVVLFEPMYDSYSAVIALAHGVRRPVTLRPSPDNGRYTFDPDELAAAITPRTRAIIVNTPHNPTGTVFTADELAWIARLCRENDLVAVTDEVYEHLTFDGTPHLPLAALPGMAERTLSVSSAGKTFSVTGWKIGWVTGPEPLVRAVATVNQYLTFTANGAQQLAVATALRHGMDWVSEQRDALHAKRDRLVAGLAAAGFQVHPPQGTYFVMADIRPLGYDDGLTFVRTLARRAGVVAIPAQVFYADERHGRHLVRFAFCKRDDVLDEAAARLRAWGDR

SEQ ID NO: 13396 - protein, 383 aa, Dehalococcoides sp. VS
MDELIYLDNAASTPIDPRVVTAMMPYFTRHYGNPSAIHPMGRRADEALETAREQVAALINCQPEEVIFTSGGTESDNLAISGAAMAGRGRHIITSEIEHHAVLEACHALEKKGFKVTYLPVDSFGQVSPKDVEAAITPQTALVSIMAANNVIGTLQPVAEIGAVCRRQGVIFHTDAVQMAGHLPLDVKQDNIDLLSLSAHKFNGPKGVGILYAKGDVPLAPLILGGGQESGLRSGTENVPGIAGLGLAAGIAKLEMAEEAGRVSSLRKKLAEAILGFVSGSRLNGHPQKRLPGNLNISFEGVEGEYLSKELAKQGICVSTGSACSSASHEAPYVLLATGLERDLANCSIRLSLGKMTTPEHIQKTADTLSAVVSQIRRQTPVW

SEQ ID NO: 13397 - protein, 231 aa, Opitutaceae bacterium TAV2
MSTPEQVSQTENQAPAAPAETAAPAAAPSPAPRSERGDRGNRGPGGDRRGSGNRRGGPRRDDRQDEPDSGLVEKVVFINRCAKVVKGGRRFSFSALAVVGDKNGKVGIGYGKANEVPDAIKKGTENARKRMVSVTLKGDTIPHEVFGTHDGGKVLLRPAVTGTGLIAGGAVRAVLEAAGVKNVLTKSMGSKNHIAVVNATLDGLRQLRGADKIKATRKNAANTEAPAGPAA

SEQ ID NO: 13398 - protein, 578 aa, Oryza sativa Japonica Group
MAWHFTAAFMIATCLMLFPRSEQSSQGEVLQQLRKQLEYPRQLDVWNNPNSDPCYTQPTSVVTVACEGNAITELKIIGDRITKPPKFSGYPVSNITLSEAFVLDSFVTTLARLPALHVVILVSLGLWGPLPDKIHRLSSLQVLDLSSNFLYGSIPPKLSAMPKLHTLTLDGNFFNGTMPDWFNLYSNLTVLRLQRNRLKGPIPASIGKATMLSELALAGNSIAGEVPQLGSLNKLEMLDLRDNELDGELPELPTALVTILLSKNSLKGEIPEQFGQLNRLQHLDLSFNFLVGKPPEKLFALPSISYLNLAANMLSGSFSTSLTCSSTLGFVDLSTNQLTGDLPVCLNVNVNNRVVKFDGNCFSDDPEHQHETKYCQQPHKGRGSNKDVGLVVTVVGVVFIVLVLSLILMASNRRSCQRVLAEQQLLQKQMQDNSTSGMSTELLVNARYISQAVKLGTQIMPMYRAFSLEELKEATKSFERSAFLGEGSIGKLYKGKLENGTLIAIRCLALHQRYSIRNLKLRLDLLAKLRHPNLVCLLGHCIDGEVDESSVKRVFLVYEYVPSGTFPSYLSGKELKIK

SEQ ID NO: 13399 - protein, 389 aa, Coccidioides immitis RS
MAKTLEARFEQLSVNDENTPPSGHTGSEKPKPGLPKALPISGLSTASQASLNAGRANLLKFALQNNEGRLHLNTASPPYKKENGSSRPPEESSAASNLYGQPAVAKNWHLGMFEIGKPLGKGKFGRVYLARERSSGFVCALKVLHKHELVKGGVEKQLRREIEIQSNLRHPNILRLFGHFHDSKRVFLILEFAGNGELYRHLRKENRFPEWKAAQYIAQMAAALKYLHKKHVMHRDIKPENILVGIHGEIKISDFGWSVHAPNNRRKTMCGTLDYLPPEMLIPGSQDNYYDEKVDLWSLGVLTYEFLVGEAPFEDTPFLTRRRIARGDMTIPSFVSSEARDLIKRLLVLDPSKRIPLDEVQKHPWIIKHCIKGERASQRSSRKEAKGDN

SEQ ID NO: 13400 - protein, 331 aa, Enterococcus faecalis V583
MLSGKARAHTNIALIKYWGKANEEYILPMNSSLSLTLDAFYTETTVIFDAHYSEDVFILDGILQNEKQTKKVKEFLNLVRQQADCTWFAKVESQNFVPTAAGLASSASGLAALAGACNVALGLNLSAKDLSRLARRGSGSACRSIFGGFAQWNKGHSDETSFAENIPANNWENELAMLFILINDGEKDVSSRDGMKRTVETSSFYQGWLDNVEKDLSQVHEAIKTKDFPRLGEIIEANGLRMHGTTLGAVPPFTYWSPGSLQAMALVRQARAKGIPCYFTMDAGPNVKVLVEKKNLEALKTFLSEHFSKEQLVPAFAGPGIELFETKGMDK

SEQ ID NO: 13401 - protein, 586 aa, Mycobacterium avium 104
MHTRGRRTPGAAVQSSAVSDAAHVGDIVGAFGRIRRDGGGADGAAGGRWRRLRTLAVITGPGLIVMVGDNDAGGVATYAQAGQNYGMGLLWTLVLLIPVLYVNQEMVLRLGAVARVGHARLIFERFGRFWGAFSVGDLLILNALTIVTEFIGVALALGFLGCPKIVAVPAAAALLFAVVAGGSFRRWERLMFLLIAVNVLIFPMVLLVHPAPKTTVAGLIPQFPGGLNSTVLLLVVAIVGTTVAPWQLFFQQSNVVDKRITARWIPYGRADLVIGIVVVMVGATALMAVTAFGLAGTAAAGHFTDAGAVAAGLSAHLGRTVGVLFAIILLDASLIGANAVGLATSYAVGDAMGKRHSLHWKITEAPLFYGGYAVLLAVSAAVSFSPDHILGLVTQGVQALAGVLLPSATVFLVLLCNDRAVLGPWVNTVRQNIAAWTIVWCLVLLSLALTATTFFPDLSTGTIEAGLAAGAVLGVVAGAVMIVVGRRQRDLAEAEAIVRTLGGGLDPEQVDELDDASSLTRAERRAVRRQDRENWQTPSLALLDRPAMSPMRRAGLFTLRGYLVVAVVFVIIKLVQAGVVGPAASL

SEQ ID NO: 13402 - protein, 408 aa, Mycobacterium avium 104
MAAIRADFPILKRIMRSGNQLAYLDSGATSQRPLQVLDAEREFLLTSNGAVHRGAHQLMEESTDAYEQGRADIAAFVGADPDELVFTKNATEALNLVSYVVGDNRFERAVGPGDVIVTTELEHHANLVPWQELARRTGASLRWYGVTDDGRIDLDSLQLDERVKVVAFSHHSNVTGAVAPVAELVGRARAVGALTVLDACQSVPHQPVDFHALDVDFAAFSGHKMLGPNGIGVLYGRREVLSQLPPFLTGGSMIETVTMESSSYAPVPQRFEAGTPMASQVVGLAAAARYLGALGMDAVQAHEERLVAAAIEGLSGIDAVRIVGPTSTENRGSPVSFVVDGVHAHDVGQVLDDEGVAVRVGHHCALPLHRRFGLAATARASFAVYNTAEEVDRLVAGVRRALDFFGGA

SEQ ID NO: 13403 - protein, 488 aa, Photorhabdus luminescens
MTIINHWINGKNVSSKTYFETTNPATGEVLAEVAAGGQEEIDQAVAAAKEAFPKWADLPMKERARLMRRLGELIDENVPEIAAMETKDTGLPIHQTQNVLIPRASHNFNFFAEICQQMNGHTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTVTGRQIMKNAGLKKYSMELGGKSPVLIFEDADIERALDASLFTIFSINGERCTAGSRIFIQQSIYPEFIKRFAERANRLRVGDPQDPNTQIGALISKPHWEKVSGYIRLGIEEGATLLAGGPDKPIDLPAHLKEGNFLRPTVLADVDNRMRVAQEEIFGPVACLLPFKDEAEGLRLANDVEYGLASYIWTQDVSKVLRLARNIEAGMVFVNTQNVRDLRQPFGGVKASGTGREGGEYSFEVFAEMKNVCISMGDHHIPRWGI

SEQ ID NO: 13404 - protein, 116 aa, Zea mays
MSTTVSRASLDQKLALAKRCSREATLAGAKAAAVATIASAIPTLASVRMLPWAKANINPTGQALIVSTVAGMAYFIAADKKILSLARRHSFDQAPEHLKNTSFQGTGRPHPAFFRP

SEQ ID NO: 13405 - protein, 490 aa, Photorhabdus luminescens
MTNDVNTELLRQQAYINGQWVDADNQATFKVTNPANGQVIAHVSNMGAAETERAIAAAQQALPAWRAMTAKQRSQILQRWFQLMMANQQALAELLSREQGKSQAEAMGEIAYGASFIEWFAEEGKRTYGETIPSPMPGRRIVTIKQPIGVVAAITPWNFPNAMITRKVGPALAAGCTVILKPASETPLSALALAALAEQAGIPAGVFNVVTGVDAKTIGGVLTQSPIVRKLSFTGSTRIGKLLMAQSADTVKKLSLELGGNAPFIVFDDANIDAAVQGALIAKFRNSGQTCVCANRILVQETIYDAFAERLAQAVNKLQVGPASDAKSQQGPLINQAAVDKVEEHINDAVSRGARILAGGKPHALGGLFFEPTVLADVNESMLISQEETFGPVAPLFKFRDEAEAIHLANDTEFGLAAYFYSRDIGRIYRVAEALESGMVGINEGLISNEVAPFGGIKQSGLGREGSRYGIEDYLEVKYLCFGGIEDTGV

SEQ ID NO: 13406 - protein, 569 aa, Pseudomonas sp. ED23-33
MQELNEVGLSVAGMTCPSCTRHVEDALLAVPGVTRAAVDYPSNKAQVTGNRLDVSALVAAVGALGYGATPTDEFESKERSVEQPGLLGKAAQWLSGERAVEKPAGQLHVAIIGTGGAAVAAALKAAENGARVTLIERGTIGGTCVNVGCVPSKIMIRAAHIAHLRRESPFDVGLSATPPVVLRDRLLAQQQARVDELRHAKYESILESNPSINLVRGSARFKDGQTLIVEAAEGDTREVAFDRCLIATGASAAIPPLPGLAGTPYWTSTEALVSEAIPKRLAVIGASVVALELAQAFARLGSEVTVLARRTLFASDDPAIGEAVTAAFRAEGITVLTQTQASAVTYCDRQFILTTAQGELKVDQLLVATGRTPNTASLNLELAGVTFDSQHRILIDQGMRTSASNIYAAGDCTDQPQYVYVAAAAGTRAGINMTGGDVKLDLDAMPAVVFTDPQVATVGYSEAEAQRIGLQTESRTLTLDNVPRALANFDTRGFIKLVAEAGSGRILVVQAVTPEAGEIIQTAAIAIRARMTVQDLANQLFPYLTMVEGLKLVAQTFSKDVTQLSCCAG

SEQ ID NO: 13407 - protein, 322 aa, Prochlorococcus marinus str. MIT 9301
MEIANDITSLVGNTPLVRLNRIRNHFNCYPEIIAKLESFNPSASVKDRIAYSMLCKAEEDGLIKPDKTTLIEATSGNTGIALAMVAAAKGYKLILTMPDTMSIERRAMLRAYGAELQLTPGKEGMKGALDLANELSSTIANSYQFNQFENFANPDIHERTTAQEIWSQSNNNLDGLVTGVGTGGTITGCARFLKKVNPNCKIYAVEPQKSAVISGEKAGSHSIQGIGAGFVPKVLDTKLIDEIIKIDDDEAFYYGRLLARLEGLLSGISSGAALAATIKIGERKELTNKRLIVILPSFGERYLSTAMFESNTSIQARKDGYL

SEQ ID NO: 13408 - protein, 357 aa, Zea mays
  misc_feature (18)..(18): Xaa can be any naturally occurring amino acid
MNSHAAGTSNGGPGDAAXGAQRRNTRMPKCKGRRDNTCWDSKFTQQELPAYKPILTPKWVVSVFLIVGVIFVPIGVVSLLAARDVVEIIDRYDEACVPVNMTENKLAYIQNETISKECIRNLTVTKYMKQPIFVYYELDNFYQNHRRYVKSRNDAQLRDASKANQTSACEPEKTTANGQPIVPCGLIAWSLFNDTYNFTRGNENLTVDKKDISWKSDREHKFGKDVYPSNFQNGALKGGATLNPKIPLSEQEDLIVWMRTAALPTFRKLYGRLYFDLKENDTITVRLNNNYNTYSFGGKKKLVLSTATWLGGKNDFLGFAYLIVGGLCIFLAFAFTLLYFVKPRKLGDHNYLSWNRR

SEQ ID NO: 13409 - protein, 106 aa, Debaryomyces hansenii CBS767
MSAGIPVKLLNEAQGHIISLELTTGDTYRGKLLENEDNMNLSLYDVTITKGRTGNTSYMNQVFVRGSMIRFVMVPEILKNAPMFFMKPGDKPKPPVRGPPPKRVKH

SEQ ID NO: 13410 - protein, 843 aa, Arabidopsis thaliana
MERHFVFIATYLLIFHLVQAQNQTGFISVDCGLSLLESPYDAPQTGLTYTSDADLVASGKTGRLAKEFEPLVDKPTLTLRYFPEGVRNCYNLNVTSDTNYLIKATFVYGNYDGLNVGPNFNLYLGPNLWTTVCLVKTGISIPFINMLELRPMKKNMYVTQSGSLKYLFRGYISNSSTRIRFPDDVYDRKWYPLFDDSWTQVTTNLKVNTSITYELPQSVMAKAATPIKANDTLNITWTVEPPTTQFYSYVHIAEIQALRANETREFNVTLNGEYTFGPFSPIPLKTASIVDLSPGQCDGGRCILQVVKTLKSTLPPLLNAIEAFTVIDFPQMETNENDVAGIKNVQGTYGLSRISWQGDPCVPKQLLWDGLNCKNSDISTPPIITSLDLSSSGLTGIITQAIKNLTHLQILDLSDNNLTGEVPEFLADIKSLLVINLSGNNLSGSVPPSLLQKKGMKLNVEGNPHILCTTGSCVKKKEDGHKKKSVIVPVVASIASIAVLIGALVLFLILRKKRSPKVEGPPPSYMQASDGRLPRSSEPAIVTKNRRFSYSQVVIMTNNFQRILGKGGFGMVYHGFVNGTEQVAVKILSHSSSQGYKQFKAEVELLLRVHHKNLVGLVGYCDEGDNLALIYEYMANGDLKEHMSGLEYLHNGCKPPMVHRDVKTTNILLNEHFEAKLADFGLSRSFLIEGETHVSTVVAGTPGYLDPEYHRTNWLTEKSDVYSFGILLLEIITNRHVIDQSREKPHIGEWVGVMLTKGDIQSIMDPSLNEDYDSGSVWKAVELAMSCLNHSSARRPTMSQVVIELNECLASENARGGASRDMESKSSIEVSLTFGTEVSPNAR

SEQ ID NO: 13411 - protein, 159 aa, Physcomitrella patens subsp. patens
MSSPSKRREMDVMKLVCPYQEGTWKIRVELPDAYPYKSPSIGFVNRIFHPNVDEMSGSVCLDVINQTWSPMFDLINVFEVFLPQLLLYPNPTDPLNGEAAALMMRDREHYEQKVKEYCERYAKAEDIGRRPEEESSDEELSDEEDCMSSDEEMAGHADP

SEQ ID NO: 13412 - protein, 487 aa, Pseudomonas putida
MRETKEQPIWYGKVFSSNWVEARGGVANVVDPSNGDILGITGVANGEDVDAAVNAAKRAQKEWAAIPFSERAAIVRKAAEKLKEREHEFADWNVRECGAIRPKGLWEAGIAYEQMHQAAGLAYLSNGTLFPSAVPGRMNLCQRVPVGVVGVIAPWNFPLFLAMRSVAPALALGNAVILKPDLQTAVTGGALIAEIFSDAGMPDGVLHVLPGGADVGESMVANSGINMISFTGSTQVGRLIGEKCGRMLKKVALELGGNNVHIVLPDADLDGAVSCAAWGTFLHQGQVCMAAGRHLVHRDVAQQYAEKLALRAKNLVVGDPNSDRVHLGPLINDKQVVRVHALVESAQSAGAKVLAGGTYQDRYYQATVIMDVKPEMEVFKSEIFGPVAPITVFDSIEEAIELANCSEYGLAASIHTRALATGLDIAKRLNTGMVHINDQPINCEPHVPFGGMGASGSGGRFGGPASIEEFTQSQWISMVEKPANYPF

SEQ ID NO: 13413 - protein, 458 aa, Yarrowia lipolytica CLIB122
MNYPAEPEFQQAYDELYNSIHDSTLFDKHPEFEKVIPVVSVPERIIQFRVVWEDDQGKLQVNRGYRVQFNSALGPYKGGLRFHPSVNLSILKFLGYEQIFKNALTGLNIGGGKGGADFDPKGKSDAEIRRFCYAFMGELHRHIGADTDVPAGDIGVGGREVGFLFGAYKKYKNTWEGVLTGKGLTWGGSLIRPEATGFGLVYYVEKMIEYATSGKESFKGKRVAISGSGNVAQYAALKVIELGGNVVSMSDSKGALVLVSDFTEGFTPAEIEQIADIKLQHKELASLYPSATLPETKFKYIEDARPWCHVGKVDVALPCATQNEVSGEEAKSLVAAGCKFIAEGSNMGCESDAIEVFEAERMARPNGIWYGPGKAANAGGVAVSGLEMAQNSQRISWTKEEVDQKLKDIMVDCFNTCVETASTYSSEKVDGLPSLVKGANIAGFLKVSAAMKDHGDFW

SEQ ID NO: 13414 - protein, 368 aa, Pseudomonas putida
MEMEIKAAIVRQKNGPFLLEHVALNEPAEDQVLVRLVATGLCHTDLVCRDQHYPVPLPMVFGHEGAGVVERVGSAVKKVQPGDHVVLTFYTCGSCDACLSGDPTSCANSFGPNFMGRSVTGECTIHDHQGAEVGASFFGQSSFATYALSYERNTVKVTKDVPLELLGPLGCGIQTGAGSVLNALNPPAGSSIAIFGAGAVGLSAVMAAVVAGCTKIIVVDVKENRLKLADELGATHVINAASSDPVEKIKEICAGGVPYVLETSGLPSVLQQAILSSAIGGEIGIVGAPPMGATIPVDINFLLFNRKLRGIVEGQSISDIFIPRLVELYRQGKFPFDKLLKFYSFDEINQAAEDSENGITLKPVLRIS

SEQ ID NO: 13415 - protein, 147 aa, Glycine max
  misc_feature (101)..(101): Xaa can be any naturally occurring amino acid
PPPGWPEFPPPSPQATAQIGGFLSKKPYAPPLWATHLSPMPCHTFSLGHFPTPNHKWNLPNLPEGTEVWIKRDDLSGMQLSGNKVRKLEYLMPNAEAQGAXDCLITVGGITDLPLLGPQPLGAEVSQIWDCVPGYYGVLPRLPCGDI

SEQ ID NO: 13416 - protein, 342 aa, Campylobacter upsaliensis RM3195
MNFINIEQAIKDLKEGKMLVMVDAEDRENEGDIIFPAQFSTKEKVNFAIKEARGVLCVALDETLAKKFELPLMVPKNTSSHETAFTITVDAKKATTGVSAYERDMTIKIFADDTACANDFIRPGHINPLIAKKGGVLERTGHTEGSVDLCHLAGLKGACVICEIVKDNGDMARREDLLEFCEKFKLNMITVSDLIEYRLKNESLITLKKQQASFLAGFKAQKFIFEDHNQIQHIAFCFNQPRKSENIKFHISGSDFELLTSNKFSQLLEQIQFLSQNGGIIIFMQGEKSNAAQFKNYGIGAQILRFFKVEEVHLMSQNCDKDFIALKGFGLDIKTCQFKNLL

SEQ ID NO: 13417 - protein, 464 aa, Glycine max
MANTLYNGATCRIPLRDESLAFSRHVSRSLSFLPITRAGKQSYAFAVKASSHSDFDVDLSLSPRVNAVKPSKTVAISDHATALVQAGVPVIRLAAGEPDFDTPAPIAEAGINAIREGYTRYTPNAGTMELRQAICHKLKEENGITYTPDQVVVSNGAKQSIAQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAAVAALGLGHAGGEAVSTMVKAFRERRDFLVKSFREIDGVKISEPQGAFYLFLDFSFYYGREAEGFGKIEDSESLCRYLLDVGQVALVPGSAFGDDTCIRISYAESLTTLQAAVERVKRALIPLSSAALV

SEQ ID NO: 13418 - protein, 136 aa, Mycobacterium avium 104
MTERTLVLIKPDGVQRQLVGEIIGRIERKGLTLVALELRHVSQDLAAQHYAEHEGKPFFASLLEFITSGPVVAAIVEGPRAIAAFRQLAGGTDPVEKAIPGTIRGDFGLETQFNLVHGSDSVESAKREIALWFPDA

SEQ ID NO: 13419 - protein, 523 aa, Coccidioides immitis RS
MAQSSTRSPPTVMESVTEQIGNTPLVRLHKIPRSLGIEATVYAKLEFFNAGGSVKDRIALRMIEEAERKGRIKPGDTLIEPTSGNTGIGLALVAAVKGYKTIITLPEKMSAEKVAVLRALNATIIRTPTEAAYDSPESHIGVAKRLEKELPNAHILDQYGNEDNPLAHEFGTAEEVWTQTDGKITAIVAGAGTGGTITGLSRGLRKHNPKVTVIAADPQGSILALPESLNEEHKNEPYKVEGIGYDFIPDVLDRQAIDKWYKTGDKESFKYARQLIAEEGLLVGGSSGSAIAALAQASKDFKFQKDDVVVVILPDSIRSYLTKFADDDWLAANDLLPAAPVSVPPSPEIQPKGSRDQFAGVKVKALRLKPVSTVPSDSACEAAIEIMREKGFDQLPVLAPTGRRLVGLITLGNILSWIARGRATGKTPVSEVMFDFSKLSEVITDSRDLTKLEQNAVHRRGKEDRKFIEITLDTPLSTLNRFFEWNSAAVVTERDEQGNMKPVAVATKVDLLTWLLNQTKVNA

SEQ ID NO: 13420 - protein, 492 aa, Campylobacter upsaliensis RM3195
MKQKCILIITDGIGYNPNTAFNAFNAAKKPTYDKLFKEVPNSLLKTSGLAVGLPEGQMGNSEVGHMCIGSGRIIYQNLVKINQAIEKNMLKNNANLKALLQKCKRVHIIGLYSDGGVHSLHTHFNALLTICKDEGKEVFAHAISDGRDVSPKSGLKLIRDLESFCEAKKIHFASLAGRFYAMDRDKRWERVEAYYKALLGEAKGVKKMSAYVEENYQKNIFDEFIEPVISEEFEGLNEEDGLIFINFRNDRMKQLVELLSAENFTPLKQKKRFEKLLTMSVYDDKFNIPVLFEKEELQNTLTEVISNAGLSQLHTAETEKYAHVTFFFNGGKEDLLENETRVLIPSPKIKTYDEKPQMSAFEVCEVVKEGIKKGEDFIVVNFANGDMVGHTGDFNAAVSAVEAVDTCLGEIIKEARRQNYAFIITSDHGNCEAMQDEKGNLLTNHTTFNVFVFIEAQICKQIKPNMGLSNVAASVLKILNLEIPKEMNEALF

SEQ ID NO: 13421 - protein, 247 aa, Campylobacter upsaliensis RM3195
MQFSGKNVLITGASKGIGAEIARVLAKFGLKVWINYRSKPELADALKEEIEKDGGVAALIKFDASKEEDFINGVKLIVESDEELSYLVNNAGITNDKLALRMSLEDFNFVVDTNLNSAFLGCKEALKVMSKKRFGAVVNIASIVGEMGNMGQVNYSASKGGMIAMTKSFAKEGASRNLRFNCVTPGFILSDMTENLSEEVKKNYEENIPLKRFAKPCEVANCVAFLLSDYASYVTGDVLKINGGLYM

SEQ ID NO: 13422 - protein, 989 aa, Coccidioides immitis RS
MSEKNQHSILPLHHAKGRALFRVETAGESGRTGFDPLLFLKVCWKSTTPVSMYVNVLWPFVPPAIVLHFARPDLHLWIFILNYIAMVPSANILGFAGGELARKMPKVLGVLAETLLSGTVEIVLFMVLISNDHNNNLIPVIQAAILGSILANLLLCLGFCFFMGGLRRDEQTFHEVISETGSGLMLVAGFGLMIPSAFYSALAGSTSSEGAFTADVLLRNTRTISRATSVILLVAFFLFLWFNLQSHHGIYDEVLEFDEAQDEDRVEEQRRAKLTFTECVFAILVSLTCVSLHAVFLVQEIPPIVERGVSDNFMGLILVPLVEKAAEHLTAIDEAWDNQINFALYHCLAPSIQTALFNAPLVVVVGWGLGKQMDLNFEIFMIVLLVLSIIVVGNFLRDRKSNYLEGGLLVLVYMIISVTTCYLYYAQCPMSKTPLGLFAVRNQQAWHEACCLQLAFIPVFPTSPPDPYEEGQYNKMEEEVVAILKSRDIPFKYEDIRTALEDPGTRDWVRKHLGDDTLLSREELTLYSKIEASAGLDAIVQGSEFSGTRPVLDDEIKTATESLKASTSATESQTEALRLQCRELKSQIREAEQVEQQCSKSASRLSTGHTAERQQTDLAIEDLIHDFEEKLQAAQKTLSTDQNNLISTTSSLLREHDVVLRNMEKVAANSQSVEESSLLKKRVSDLCALLARYIAEEISCRLDRVFLETVESAKDSEDDDPHVLEKLESVDAEINSLYPEISILSDMAARQQFHSPILRVLEEWQERSQLGVEEQLQHVLETIIQLTESTDSITEKLKTRQAHQSALNSLASTYQDEVSRHKLQKAKPENKRLSKYSSRLSQAYASPRESMEMKAGSAENELTRSLETMLRRYGISFSSLRNAKSTEAVNDILNEKASHMLEMLENIYATAASPLIPNLGSADKAAQLLSSAMHCDSDFQPSLVDRDQQQRIANLEVQIGAVQKGIESLNTDILHQSDLARENFMERWG

SEQ ID NO: 13423 - protein, 144 aa, Oryza sativa Japonica Group
MASVWCLSASASAAAPVAAAAAAPGPLGASVASVSLARAAVPSRRRRRWDALVVCAAPDEEKITRRSPLDFPIEWEKPKPGRRPDIFPKFSPMKTPLPHPLPADDPLDDDEEEEEEEPQPQEEPQEDDPDKEEPEEDDPDKPTE

SEQ ID NO: 13424 - protein, 516 aa, Vitis vinifera
MAAAPLGLLNLEESPLWGSRTVDCFQQLEHIGEGTYGQVYMAREIKTGEILNYVTGEGGLATSSCKQFPITAIREIKILKKLHHENVLKLKEIVTSPGREKDEQGHPDGNKYRGGIYMVFDYMDHDLAGLSDRPGLRFSIPQVKCYMKQLLTGLHYCHVNQVLHRDIKGANLLINNEGILKLADFGLARSFSSDHNGNLTNRVITLWYRPPELLLGATKYGPAVDMWSVGCIFAELLYGKPILNGNNEPEQLKKIFELCGSPDENNWPGVSKIPWYNNFKPAKPLERRVREVFRTFDRHALDLVDRMLTLDPSKRISAKDALDAEYFWNDPLPCDPKSLPKYESSHDFQTKKKRQQQRKNEEQAKRQKLQHPQQHARLPPIQHSGRAHPQHWHGPNHPTNNSQPTVPAGPSHHQYGRPHGLPGGPNRYPSSGNPNGGYNPNHGGQVGGYSSAPYPPQGRGQPYGSGVPTTGPRGATSGYGVGPPNYSQSSQYGGAAAGRGPNPMGVNRNQQYGWQQ

SEQ ID NO: 13425 - protein, 304 aa, Shewanella oneidensis MR-1
MSERYLENGIRQLVSEFIAAGCPSVREQSLEERRQGYIASTVLAGEPEAVFEVKSVSLEGIELTLFKPSADNNLPVVIYYHGGCFVSGGIATHNQQLRKIANDSGALVVAVSYRLAPEHVYPAAHDDAFNAANLVQQHCHQWGGDNTNITLMGDSAGGHLALVTCLRLKAKGEWLPKKQVLIYPMLDATAKSQSYIDNGDKYIITRDTLLTGFDMYLDWHPRTDVEASPLRSHDLAGLPETHIITAEFDPLLDEGEQLFRHLLAAGVDAHCRRYLGVIHGFFQLAGVSQSARDAMAQVTHIIRA

SEQ ID NO: 13426 - protein, 255 aa, Streptomyces exfoliatus
MNDLSGKTVIITGGARGLGAEAARQAVAAGARVVLADVLDEEGAATARELGDAARYQHLDVTIEEDWQRVVAYAREEFGSVDGLVNNAGISTGMFLETESVERFRKVVDINLTGVFIGMKTVIPAMKDAGGGSIVNISSAAGLMGLALTSSYGASKWGVRGLSKLAAVELGTDRIRVNSVHPGMTYTPMTAETGIRQGEGNYPNTPMGRVGNEPGEIAGAVVKLLSDTSSYVTGAELAVDGGWTTGPTVKYVMGQ

SEQ ID NO: 13427 - protein, 277 aa, Corynebacterium sp. SHS752001
MPNIPTISLNDGRPFAEPGLGTYNLRGDEGVAAMVAAIDSGYRLLDTAVNYENESEVGRAVRASSVDRDELIVASKIPGRQHGRAEAVDSIRGSLDRLGLDVIDLQLIHWPNPSVGRWLDTWRGMIDAREAGLVRSIGVSNFTEPMLKTLIDETGVTPAVNQVELHPYFPQAALRAFHDEHGIRTESWSPLARRSELLTEQLLQELAVVYGVTPTQVVLRWHVQLGSTPIPKSADPDRQRENADVFGFALTADQVDAISGLERGRLWDGDPDTHEEM

SEQ ID NO: 13428 - protein, 763 aa, Oryza sativa
MSFSAISSSSSVSPHLPLFRKRPLHFSHLVIPPPPPLFASVHLACGGREPTDLVPLPPRTRQRRAPPKLGLPGGSSAGWVSRRPSPDSAAAPAAMATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLTYFLEQIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKPEKKEIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLNYKKGQNDV

SEQ ID NO: 13429 - protein, 141 aa, Arabidopsis thaliana
  misc_feature (42)..(42): Xaa can be any naturally occurring amino acid
PSVRGKEEEITRRGKCASYMHSSAVVVTSPTQATMVAPFTGXKSSAAFPVTRMTNKDIASIAIIGGRVSRTKGRPPNEKNKEETVSYLPDLSDAELTKEVDYLVRNKWIPCVEYELEHGSVSREHGNTPGYYEGRNWTMGK

SEQ ID NO: 13430 - protein, 303 aa, Shewanella oneidensis MR-1
MSHILVIGSANADHVMNFEYLPVPGQTLKSRSYRLEHGGKGANQAVACARLCLPDSRVDFICHLGQDSIGNEMRDSWLKDGIQAEGITLVDNVSTGTAMIFVADNGENAIGIAAGANAHLTPLELEKHYALFANAQYLLIQLETPTETVSNALQMAKRLGITTVLNPAPAATQELDYLKWVDIITPNETEAEALTGIEVKHEEDAKLAAQWLHQQGITTVVITLGSKGAFISSPGFTGLIPALTVQAIDTVAAGDTFNGALVVGLSEGMSIAAAVSFANAASAITVTREGAQRAIPYRSEVSR

SEQ ID NO: 13431 - protein, 331 aa, Dichelobacter nodosus VCS1703A
MNTHAHYLQKILTASVYDVAVETPLQLASGLSAQLKNNIWLKREDLQPVFSFKIRGAYNMMASLSADLLAKGVITASAGNHAQGVALSSQKLGCKATIVMPETTPKIKVNAVKARGGNVVLAGQSFTDAYEHAMTLAKTSGMTYIPPFDHPMVIAGQGTIGMEIIRQHNKPIDAIFVPVGGGGLVAGVVAYIKNVRPEIKVIGVETEDAASMKAALEHGSPVTLPEVGIFADGTAVKRVGDETFQICRDLLDEVILVTTDDVCVALKDIYDNIRSITEPSGALGLAGLKAYIKREQCTEKTLIAVNSGANMDFHRLRFVSEQIQKNEEKAQ

SEQ ID NO: 13432 - protein, 144 aa, Synechococcus sp. WH 8102
MNPSRCRILAVGKVRRSWIQDGIELYRKRLPGLEIIEIRDSTPDKEADSIRASLRPNEHVIALMEEGDAVGSIPFARRLDQLGNQRLAFVIGGADGLTNELKGRAHWQLSLSPMTFPHELARLMLIEQLFRAQAILQGSPYHRA

SEQ ID NO: 13433 - protein, 186 aa, Bacteroides fragilis YCH46
MQPLTWQETKKRLKSDLLRQRTSTNTKDICYALLFNTSFKICFWWRISQYFNNWKILNTITKIIYRHYQFKTGVQISPYADIDGGLAIAHFSCIVISDCKIGKHFTIMQGSTIGSYRGSIKGGSPSIGDNVVICAGAKVIGNIKLGNNAMVGANAVVVKDIPDNAVVAGVPARIINMNGIERTSYH

SEQ ID NO: 13434 - protein, 92 aa, Oryza sativa Japonica Group
MGYLQEARENHVKKKVEEALRSKMKQKALKECDFYCSKYAECARGRTFSVVWQCRKQAKELNDCLHQFTNDAVLEEMKKAYMVEQESKEKNQ

SEQ ID NO: 13435 - protein, 261 aa, Oryza alta
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINATIQAFECVHDGWGVAVLVGVPHKDAEFKTHPMNFLNERTLKGTFFGNYKPRTDLPNVVELYMKK

SEQ ID NO: 13436 - protein, 486 aa, Pseudomonas putida
MKEIKHFINGEYVESASGKLFDNVNPANGQVIAKIHEAGEAEVDAAVKAARAALKGPWGRMTVAERTEILHRVAAGISARFDEFLEAECLDTGKPKSLASHIDIPRGAANFSVFADLVKNVPTEAFEMATPDGTGALNYGVRRPKGVIGVISPWNLPLLLMTWKVGPALACGNTVVVKPSEETPTTTALLGEVMNAAGVPAGVYNVVHGFGGNSAGAFLTAHPDVDAYTFTGETGTGETIMRAAAKGVRQVSLELGGKNAGIVFADCDLDKAIEGTLRSAFANCGQVCLGTERVYVERSIFDEFVARLKAGAEALVIGPPDDASSNFGPLVSLKHREKVLSYYQQAVDDGATVVTGGGVPEMPAHLAGGAWVQPTIWTGLADNSVVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 13437 - protein, 261 aa, Oryza alta
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 13438 - protein, 353 aa, Campylobacter upsaliensis RM3195
MPNLEELRLKIDTIDDALLKLLNERMNYVKCIGELKQSLGTAIYRPERERAIINRLKSQNLGPLDQNAIEAIYGELFAVSRNLELPQAVAYFGPEGTYTHQAARMRFGAMSRYIPLATIEDVFKELANKEAKFGVVPIENNTEGAVGVTLDCLGAYEGLKIFGEIYMDIHHSFVGINENIKEVERIYSHPQGYNQCRKFLESHGLNAVEFVPAKSTANAAHLASQDKKSAAICSKIAAKIYNVPLLFDKIEDNAANRTRFLILSDMITPKMEHCKTSILAHTAHKPGGLSALLENFKKENINLTRLESRPVKAKEFLHSFYIDFEGHIEDENVKRALKGNEDIVWLGSYLKEC

SEQ ID NO: 13439 - protein, 380 aa, Bacillus subtilis
IGTGSRHETPEINGISHFLEHMFFKGTSTKSAREIAESFDRIGGQVNAFTSKEYTCYYAKVLDEHANYALDVLADMFFHSTFDENELKKEKNVVYEEIKMYEDAPDDIVHDLLSKATYGNHSLGYPILGTEETLASFNGDSLRQYMHDYYTPDRVVISVAGNISDSFIKDVEKWFGSYEAKGKATGLEKPEFHTEKLTRKKETEQAHLCLGFKGLEVGHERIYDLIVLNNVLGGSMSSRLLEDVREDKGLAYSVYSYHSSYEDSGMLTIYGGTGANQLQQLSETIQETLATLKRDGITSKELENSKEQMKGSLMLSLESTNSKMSRNGKNQLLLGKHKTLDEIINELNAVNLERVNGLARQLFTEDYALALISPSGNMPS

SEQ ID NO: 13440 - protein, 336 aa, Leuconostoc mesenteroides subsp. mesenteroides ATCC 8293
MTKIAVLGGGSWGTALANVAAENNNDVRLWTRTATQADEINSQHTNQKYLPDAKLSSELMATSNMALAVMDAEIVLTVVPTKVVREVARQLADVLNKQDHQVILAHATKGLEQVTYKRVSEMLAEEVPAKYRSTLAMISGPSHAEDVIKHDLTSVSIASENEEAAKLLQQVFANSSFRPYTNHDLLGSELAAALKNIIAIGSGALIGLGYGANAQAALLTRGLSEMRALGQAMGAQPETFLGLAGIGDLIVTGMSPNSRNYRAGKQLGEGKSLQEIQDDMGMVIEGVSTTKAVYEFSQHHHVEMPITAGIYRILYENEPLRDVISDLMSRPLRSED

SEQ ID NO: 13441 - protein, 375 aa, Neisseria meningitidis Z2491
MLECTANHRSGEIMSQTIDELLLPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDNCFKQVETRQADYLVAPVENSTEGSVGRTLDLLAVTALQACGEVVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 13442 - protein, 291 aa, Leuconostoc mesenteroides subsp. mesenteroides ATCC 8293
MKPVRKAIIPAAGLGTRFLPATKALAKEMLPIVDTPTIEYIVREAIESGIEDIVIVDGKSKRSIEDHFDSNPELENNLREKGKDELLKLVEETTDINMYFIRQSHPKGLGDAVLTAKAFIGDEPFVVLLGDDLMQDEVPLTKQLIQRYEETGESTLAVMKVPHDQVSEYGVIDPAAQVDKGGLYRVKSFVEKPKPEDAPSDLAIIGRYLLTPEIFEELENTKPGKGNEIQLTDAIDSLNNRQHVYAHEFKGSRYDIGSKIGFLETNIEFGLKHPQTKDALRAYIKELASKL

SEQ ID NO: 13443 - protein, 444 aa, Streptomyces avermitilis MA-4680
MSALPQERRVVTAIPGPKSQELQARRTAVVAAGVGSVLPVFTTRAGGGIIEDVDGNRLIDFGSGIAVTSVGASAEAVVRRASAQLQDFTHTCFMVTPYEGYVAVAEALAELTPGDHAKKSALFNSGAEAVENAVKIARAYTKRQAVVVFDHGYHGRTNLTMALTAKNMPYKNGFGPFAPEVYRVPVAYGYRWLTGPENAGAEASAQAIDMINKQIGADNVAAIIIEPVLGEGGFIEPAKGFLPAISKFAKDNGIVFVADEIQSGFCRTGQWFACEDEGIVPDLITTAKGIAGGLPLAAVTGRAEIMDAAHAGGLGGTYGGNPVACAGALGAIETMKELDLNAKAKNIEAVMKARLGAMAEKFDIIGDVRGRGGMIAIELVKDRDTKEPNPEAAGALAKACHQEGLLVLTCGTYGNVLRFLPPLVIGEDLLNEGLDIIEQAFSRI

SEQ ID NO: 13444 - protein, 309 aa, Bacillus clausii KSM-K16
MLCRSNDELELLISQARAFAGQGEVAQYIPALAAAHKHELSVALYYPDGKGFMAGDTEENFTLQSISKVLSLALALIDQGEECVFTRVGKEPTGDPFNSIAKLETNKPSKPLNPMINAGALAVTHMIKGNTAGERFERLLDFIRCLTGNETITYNKEIAKSEFETAHLNRALVYFMKEHGVIDEDVEELMDLYTKQCAIEMNCIDLARVGCVLAMDGCDPDTGKQLLPIDVARICKTFMVTCGMYNASGEFAINVGIPAKSGVSGGIMGAVPKKCGIGICGPSLDEKGNSIAGIKLLEMMAKRYSLSMF

SEQ ID NO: 13445 - protein, 248 aa, Brassica napus
  misc_feature (13)..(13): Xaa can be any naturally occurring amino acid
  misc_feature (18)..(18): Xaa can be any naturally occurring amino acid
  misc_feature (23)..(23): Xaa can be any naturally occurring amino acid
  misc_feature (26)..(27): Xaa can be any naturally occurring amino acid
  misc_feature (57)..(57): Xaa can be any naturally occurring amino acid
  misc_feature (142)..(142): Xaa can be any naturally occurring amino acid
IVTMCTIGYGDIXPLTPXTKILXVVXXLFGFGFLDILLSGVVQYVLDLQESMILTGXQMGSSRGSHRFSAKDYIIDFEKGRMRIRMKVFLALCVVVLCVGVGALVLHFVEGLDLVDSVYLSVMSVTTVGYGDRAFKTLEGRXFAAAWLLVSTLAVARAFIYLAEARIDRRHRRAVKFALNREITVEDLLAADTYQHGFISKSEYIVLKLKEMGKVSDKDINQVVNQFDKLDPNNLGKITLPDLLGGPL

SEQ ID NO: 13446 - protein, 425 aa, Bradyrhizobium sp. BTAi1
MGANEELLARRHQAVVRGVSYATPLFADRALNSEVWDVEGKRYVDFAGGIAVLNTGHCHPHVVAAIRAQLDRFTHTCFQVLQYEPYVRLTERLNAIAPISGPAKSILLTTGAEATENAIKIARAATGRSGIIAFTGAFHGRTALANAMTGKVMPYKKHFGPPLPGIWHAPFPIAGSGVSVEDTLSYINFIFKADIDASQVAAIIIEPVQGEGGFHQAPPELMSGLRRLCDTHGIVLIADEVQTGFGRTGKMFAMEHYDVQPDVICVAKSLAGGMPLSGVIGRAAIMDAAEPGGLGGTYGGNPLACAAALAVLDVFEQDKLLDRANAIGARLRAAISKFSRANTLVPISEPRGPGAMIAFDILKQRGSHEPDAEMTKRVTRVAYENGLILLSCGVTASTIRILVPLTASDEIVDEGLAILEKCLAA

SEQ ID NO: 13447 - protein, 404 aa, Bacillus subtilis
MKIIVQKFGGTSVKDDKGRKLALGHIKEAISEGYKVVVVVSAMGRKGDPYATDSLLGLLYGDQSAISPREQDLLLSCGETISSVVFTSMLLDNGVKAAALTGAQAGFLTNDQHTNAKIIEMKPERLFSVLANHDAVVVAGFQGATEKGDTTTIGRGGSDTSAAALGAAVDAEYIDIFTDVEGVMTADPRVVENAKPLPVVTYTEICNLAYQGAKVISPRAVEIAMQAKVPIRVRSTYSNDKGTLVTSHHSSKVGSDVFERLITGIAHVKDVTQFKVPAKIGQYNVQTEVFKAMANAGISVDFFNITPSEIVYTVAGNKTETAQRILMDMGYDPMVTRNCAKVSAVGAGIMGVPGVTSKIVSALSEKEIPILQSADSHTTIWVLVHEADMVPAVNALHEVFELSK

SEQ ID NO: 13448 - protein, 601 aa, Thermomyces lanuginosus
MANVASPTANGNGGKKRRKGDLKPIVTGEGFSLAESGGSSLNPGASVASPLSHQKPVYESPSRSLSSSSEDDLEAAADEEDSEDYCKGGYHPVQIGETYNNGRYVVIRKLGWGHFSTVWLSRDTVTGKHVALKVVRSAAHYTETAIDEIKLLNRIVQAKPDHPGRKHVVSLLDSFEHKGPNGVHVCMVFEVLGENLLGLIKRWNHRGIPMPLVKQITKQVLLGLDYLHRECGIIHTDLKPENVLIEVGDVEQIVKTYVKEEPKKEEKDNRNGRRRRRTLITGSQPLPSPLNASFGHTDKYGSHNSLNHMVNDGGGKDSLNVPEDERQQREKTADLLEREVSGISLDKKTEPQKQQTDIISVKIADLGNACWVGHHFTNDIQTRQYRSPEVILGAKWGASTDVWSMACMVFELITGDYLFDPQSGTKYGKDDDHIAQIIELLGHFPRSLCLSGKWSQGNLQPQRRTPKHPSAAPLGAPGRAAGRNTISLSRRASRSATFCCQCCIWFRRNGPMPAVWPVMSGSRIHQAWTALIWEFRRGLGARASKAGHARSNGGDFMILCFVALYSGWMDGIYCVLDKLDVDLISFMMTYRELCRRGLPMI

SEQ ID NO: 13449 - protein, 165 aa, Zea mays
  misc_feature (13)..(13): Xaa can be any naturally occurring amino acid
LCSKLQEQPEGYXILRNQISSIPIGTWSQHTGRASTRQLRTSGLSAPLITCLDFLLEDRISSIPIVDDNGSLLDVYSLSDIMALAKNDVYACIELEQLTVENALELQYQVNGRRQCHTCLSTSTLLEVLDQLSVPGVRRLVVIEPMTRFVQGIISLRDAITFLLG

SEQ ID NO: 13450 - protein, 386 aa, Coprinopsis cinerea okayama7#130
MSTAASPTAASTSSSTVAATPQAPDPKDTVLDTPPAPKTVLFLSPQVASYFIAGGCAGAASRTVVSPLERLKIIQQVQPRGSDAQYKGVWRSLVRMWREEGFRGFMRGNGINCIRIVPYSAVQFTTYEQLKKLFTAHGVKELDTPKRLAAGALAGITSVCSTYPLDLVRSRLSIATASINFTAPKPLPAGASAATSSIPSTSSPSLSSAYHTSSSARSAAPTSASAAVAGALKYSKRDLTMWGMTLKVMREEGGVRALYRGLVTTAMGVAPYVGINFAAYEFLRGVITPPGKSSVARKLSCGALAGSISQTLTYPFDVLRRKMQVTGMQGGNIKYNGALDALRSILKVEGVQGLYRGLWPNLLKVAPSIATSFFTYELVKEFLIPP

SEQ ID NO: 13451 - protein, 170 aa, Musa acuminata
RVYKGVLPSSKSEVAVERVSHGSRQGMREFIAKIVSLGRLRHRNLVQLLGYCRRQGKLLLVYDYMPNGSLEKFLHDQAMPTLDWATRFRIIKGVASGLLYLHEDWEQVVIHRDIKASNVLLDNELIGRLGDFGLARLYDHGTDPQTTHVVGTMGYLAPELARTGKATTIT

SEQ ID NO: 13452 - protein, 232 aa, Neisseria lactamica
DQGAGVTYLESSASQIGHKESIKDTARVLGRMYDAIEYRGFGQETVEELAKYAGVPVFNGLTNEFHPTQMLADALTMREHGGKPLNQTSFAYVGDARYNMGNSLLILGAKLGMDVRIGAPEGLWASEGIIAAANAVAEETGAKITLTANPQEAVKGVGFIHTDVWVSMGEPKEVWQERIDLLKDYRVTSELMAASGNPKVKFMHCLPAFHNRETKIGEWIYETFGLNGVEVT

SEQ ID NO: 13453 - protein, 170 aa, Musa acuminata
RVYKGVLPSSRSEVAVKRVSHGSRQGMREFIAEIVSLGRLRHRNLVQLLGYCRRQGELLLVYDYMPNGSLEKFLHDQAMPTLDWATRFRIIKGVASGLLYLHEDWEQVVIHRDIKASNVLLDNELIGRLGDFGLARLYDHGTDPQTTHVGGTMGYLAPELARTGKATTIT

SEQ ID NO: 13454 - protein, 232 aa, Neisseria lactamica
DQGAGVTYLESSASQIGHKESIKDTARVLGRMYDAIEYRGFGQETVEELAKYAGVPVFNGLTNEFHPTQMLADALTMREHGGKPLNQTSFAYVGDARYNMGNSLLILGAKLGMDVRIGAPEGLWPSEGIIAAANRVAEETGAKITLTANPQEAVKGVGFIHTDVWVSMGEPKEIWQERIDLLKDYRVTSELMAASGNPQVKFMHCLPAFHNRETKIGEWIYETFGLNGVEVT

SEQ ID NO: 13455 - protein, 232 aa, Neisseria polysaccharea
DQGAGVTYLEPSASQIGHKESIKDTARVLGRMYDAIEYRGFGQEIVEELAKYAGVPVFNGLTNEFHPTQMLADALTMREHSSKPLNQTAFAYVGDARYNMGNSLLILGAKLGMDVRIGAPESLWPSEGIITAAHAVAKETGAKITLTENAHEAVKNVDFIHTDVWVSMGEPKEVWQERIDLLKDYRVTPELMAASGNPQVKFMHCLPAFHNRETKVGEWIYETFGLNGVEVT

SEQ ID NO: 13456 - protein, 293 aa, Coprinopsis cinerea okayama7#130
MRPAFLSLCFAVLSQAWLGFASPVPVGELEARQSGIDSTTYGNLERFAKHSSAAYQLLGCPRPVGTTLVKYIDRSGTQGYISRDDSRKEIIVSFRGSMSVTDALVDLAIIMVPLKSTGITNVGDAHVHTGFQFAYNVVADDVISTVRNQYNSRSGYTIVVTGHSLGGAVASMAAISLKAALPNAPLKLYTYGQPRVGNAAFASLVESRVGVNNIFRTVHTYDGVPTVLFKALGYRHFATEYWNFQDPPNAANTRKCNGGDDPKCSDSIPSTFINPAHVYYFGEVMGLNPLLCL

SEQ ID NO: 13457 - protein, 91 aa, Zea mays
  misc_feature (18)..(18): Xaa can be any naturally occurring amino acid
GFYLKALILVYLERPFAXKQLAYLASKPFFHGLLDYIISGPVVAIVWEGKSVVTTGRKIIGATNPLASEPGTIRGDFAVHIVRNVIHCSDT

SEQ ID NO: 13458 - protein, 447 aa, Tropheryma whipplei str. Twist
MLLCVSANHKKTSFTVLEQLARVSPDFASELVEAEDIDGAAILSTCNRFEVYIDAIQKGDQDDVCKTGLLVQNRIGELCNISPSTIIEQTSFLAGCEVSRHLFSVATGLESMIIGETEIAGQVKRALTYAQKCRTTSPELERLFQRASAVNRHIRQSTKINEVGQSLVSLSLDLASSRIGDWSGVRAIIVGTGKYASKALALLKERGVVDISVYSPSGHVNNICNTEGVRNIFNLQTALSGCDLVVGCSSVDKPVITKQDIETAQASGSRTSRVRPVGRPSTDLTAIEASNRSRHVLIDLGLPRNFDPAISDLPTADLIDLDMLRVHAPFDNLAAEKMAHELAIESSSQFVNDCKQHEATPVIVSFRNYLESLTQTSLRRTDNCKHAQHALKHFVNSLIHIPLTRCKQLAANGESHKFAESMEILFDVKTDCTEGTQYQSSCGKSFD

SEQ ID NO: 13459 - protein, 472 aa, Bacillus clausii KSM-K16
MNHALFINNECVATDDMIEVENPATKEVIGTVANGGKQEALAAVDAAAAALPEWRAKTAAERGAYLQKWYELIQREEEEIAKLMTLEQGKPFAEALGEVRYANSFLSWYAEEGKRVYGETVPAAATNKRIFVQKQAIGVIAAITPWNFPAAMLTRKLGPALAAGCTAVMKPSELTPFTAYRIVELAKVAGIPKGVVNMITGDAQQIGETWMADERVRKVSFTGSTRVGKLLMRQAADTVKKLSLELGGHAPFIVTAQADIQKAVDGLIASKYRNGGQTCVCANRIYVHESIKAPFVEAFAAEMKKLKVGNGMEPDSHIGPLINEAAVAKVQKHIEDAQAKGGEVIFGQEADATNGYFQTPALIANATDDMLCMKEETFGPLAPIATYTSTEDVIERANHSPYGLAAYVYSNDLSEAVTIAERLEYGIVGLNDGLPSVAQAPFGGMKESGLGREGGHWGIEEYVEVKYISLQL

SEQ ID NO: 13460 - protein, 496 aa, Neotyphodium uncinatum
MDLTQFNTAGIVWPTVAAIAISYILLSSFLSWYRLRHIPGPFLASISSLWNVLNIVTGRTSPVLEKLPGKYGPLVRTGPNYVLTDDAEILRHVNGARSTYPRNGWYEGFKVDEHDHMGSHIDTSVHDAIKSKVIGGYNGKDGIDLEGAIGSQVKTLVSEIRRRHLGQPVDFSRLMRQMALDAITAVAFGEALGFLTAEDGDVFGYVSAVDKMLTYLTLASDLPVVRSVVRSRRMAPAVRCVLAYTGIGRMLNHTRRVVAERYAADDPGKGDMTASFIRKGLTQIECEGESHLQLIAGADTAVTVLRSTLLYIMTTPRVYTRLKAEIKAAVDAGEVVEVITMAQAQRLPYLQAVVLEGFRMRPAVVYGHFKSVPAGGDTLPNGVRLPAGTAIAPNYIALTRRADVYGADVDLFRPERFLDAEPAKRHEMERAMDLNFGLGRWQCAGRNIALMEMNKVFFELLRHFDLQILYPGKAWDEYTGVVYSQHNMWVQITESS

SEQ ID NO: 13461 - protein, 507 aa, Streptomyces avermitilis MA-4680
MHNPGHRFQAQDRFADGAQYIAGRFAKGTSGRRHAVVDPATGEEVYRYELAGTADVDAAVAAARAAFPGWAATTPGDRSDALHRFAAVLADRAEEFARAESLQCGKPLKLTREFDVPGTIDNTSFFAGAARHLQGQSAGEYSGDHTSYIRREPIGVVGSIAPWNYPLQMAAWKVLPAIAAGNTIVLKPAEITPLTSLLFAEAATRAGIPDGVVNIVTGAGRDAGEHLVAHPDVAMTSFTGSTAVGRRVAEIATSTVKRLHLELGGKAPFVVFDDADLDAAVHGAVAGSLINTGQDCTAATRAYVQRPLYEEFVARTAALMETVRLGDPFAHGTDLGPLVSHAQRDRVAGFVDRARAYARVVTGGEIPEELKDGAYYRPTLIADAAQDSEIVQSEIFGPVLVVLPFDSDDEGIRLANDTPYGLAASAWSRDVYRANRATREIKAGCVWVNDHIPIISEMPHGGYKASGFGKDMSAYSFEEYTQIKHVMFDNTAIVRKDWHRTIFGDRP

SEQ ID NO: 13462 - protein, 507 aa, Arabidopsis thaliana; identical to SEQ ID NO: 837

SEQ ID NO: 13463 - protein, 144 aa, Brassica napus
PGVRFCVVGGVDRGRGGLSPLQTAEVYDPTTDVWSEVPSMPFTKAQVLPNAFLADLLKPIATGMTCYYGRLCVPQSLYSWPFFVDVGGEVYDPETELWGEMPSGMGEGWPASQGGTKLSVVLDGELYAFVSSSSMDNGKIKVYD

SEQ ID NO: 13464 - protein, 437 aa, Mycobacterium avium 104
MFGTGYLGATHAVGMAELGHDVLGVDIDPGKVAKLAGGDIPFYEPGLRKLLNENLAAGRLRFTTDYDMAAGFADVHFLGVGTPQKKGEYGADLRHVYAVIDELVPRLTTSAVLVGKSTVPVGTAAELNQRAAALAPRGVNVEIAWNPEFLREGYAVQDTLRPDRIVLGIKQDSPRAEAAVRELYGPLLDAGVPFLVTDLQTAELVKVSANAFLATKISFINAISEVCEAAGADVSLLADALGYDPRIGRQFLNAGLGFGGGCLPKDIRAFMARAGELGADQALTFLREVDSINMRRRTRMVELASAACGGSLLGANVAVLGAAFKPESDDVRDSPALNVAGQLQLNGAAVNVYDPKALDNAQRLFPTLNYAVSVEEACERADAVLVLTEWRQFVEMDPDDLADRVRARVVVDGRNCLDVTRWQRAGWRVYRLGAPRP

SEQ ID NO: 13465 - protein, 162 aa, Desulfotalea psychrophila LSv54
MMKHTISVLLQNQPGVLSRVTGLFSGRGFNIESLCVAETLDPKISCLTVVSKGDAAIIEQITKQLHKLIDVIKVTDISEHEYVEREMVLIRVNAEVHTRAEVLRIVDIFRGKVVDVSAKSYAIEVTGNTSKIHAVTDLLRPLGIKEIVRTGTIAMARVNKNK

SEQ ID NO: 13466 - protein, 232 aa, Neisseria polysaccharea
DQGAGATYLEPSASQIGHKESIKDTARVLGRMYDAIEYRGFGQEIVEELAKYAGVPVFNGLTNEFHPTQMLADALTMREHSSKPLNQTAFAYVGDARYNMGNSLLILGAKLGMDVRIGAPESLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVT

SEQ ID NO: 13467 - protein, 223 aa, Cryptococcus neoformans var. neoformans B-3501A
MFANSLRQGLRTASRSSARAFSTIPARAPRTNVVGALALGTAVAGYALYETTRSPVMLEGARTIAGEKGTVTERSFVMIKPDGVSRQLVGKIVSRFEERGYKLVAIKSLTPSDALAKEHYADLSARPFYPSLVKYITSGTPVVAMVWEGKDVIRQGRRIVGATNPLDADAGSVRGQYAVSVGRNLIHASDAFESATKEIGLWFAPEELSEYEPIAWPWVMADN

SEQ ID NO: 13468 - protein, 339 aa, Photorhabdus luminescens
MTIKVAINGFGRIGRSILRALYESGRRAEIAVIAVNELADAEGIAHLLKYDSSHGRFAWDVRLNNDLLQVGDDNIRLFHQPDISTLPWQELGVDIVLDCSGIYGSRADGQAHLASGAKKVLFAHPGGNDLDATVVYGVNQHLLTAEDRIVSNASCTTNCIIPVIKLLDDEFEIESGTVTTIHASMNDQPVIDAYHKDLRRTRAASQSIIPVDTKLAAGITRIFPKFCDRFEAISVRVPTINVTAIDLSVTVKSSVTVKKINELMQKSAATSFRGIVDYTELPLVSTDFNHDPHSAIVDGTQTRVSGQHLIKTLVWCDNEWGFANRMLDTTLAMAATGFK

SEQ ID NO: 13469 - protein, 232 aa, Neisseria polysaccharea
DQGAGATYLEPSASQIGHKESIKDTARVLGRMYDAIEYRGFGQEIIEELAKYAGVPVFNGLTNEFHPTQMLADALTMREHSSKPLNQTAFAYVGDARYNMGNSLLILGAKLGMDVRIGAPQSLWPSEGIITAAHAVAKETGAKITLTENAHEAVKNVDFIHTDVWVSMGEPKEVWQERIDLLKDYRVTPELMAASGNPQVKFMHCLPAFHNRETKVGEWIYETFGLNGVEVT

SEQ ID NO: 13470 - protein, 357 aa, Oryza sativa
MAGARAVGSLPVPNVQALAETCNGPDEHIPERYIRPEASSEEVISNYHGDMAIPIIDLKKLLSPQSSEEECVKLRSACQYWGFFLLINHGVPDEVIANLKRDIVDFFSQPLDAKKEYTQLPNSLEGYGQALVFSEDQKLDWADMLYLHVHPSDSRDLRFWPTSPASFRRSLDAYSSETKSLALCLFEFMAKAVGAKPEALLGLFEEQPRGLRMAYYPPCRQADKVMGLSPHSDAGGLTLLLQVNDVQGLQIKKDGKWFSVDAPNGALIANIGDTLEILSNGKFRSVEHRAVINPNKERISAALFHYPSENMVISPLPEFVKDGKVKYRSISYLDFMKQIFTQQLDGKNRVEVLKLDQ

SEQ ID NO: 13471 - protein, 490 aa, Escherichia coli
  misc_feature (202)..(202): Xaa can be any naturally occurring amino acid
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVXNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSLLTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 13472 - protein, 490 aa, Bacillus subtilis
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGTTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAAQVCSAGSRLLVEDAIHDQFLAELVKRAKRIKLGNGFHAETESGPLISAEHRAKVEKYVEIGIEEGAKLETGGKRPEDPALQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 13473 - protein, 402 aa, Zea mays
MPLTRVAADAFGVLTIGLLALLAALGLFCIFQSVYFRCQIRRGPSFLPLGYFNGPWVTRVALVLITIWWGVGEVARLSFLKQKLFSSLTWQRNICDAYILSNLGFAEPGIFFAFAFLLHGSLQKKELGTLNQRWNWKSMAYTLVFCVPVFSVQAVLVFVVGPRLVRDSNHDLGRRKIAKYFVRTHTPVGDTSVCTYPLLGTIFLGLVDAFLMSYVSYVGSRALSLVINKSLRRRVYLLMLSVLCFLPTRVLLLGFSVLPRPGDAAFEGIVFLSFLTMLSCTAVGILLLVYYPVADSLALRDMGQRDTAAEMVPYDDYYCYEGASLVANRSFRELERNSDTSTKPGSISFRTMIREDQLQQDGAADEIGFSSRSGAHIGSPSPAGSSPSAAMPMLPVKEIPRY

SEQ ID NO: 13474 - protein, 799 aa, Physcomitrella patens subsp. patens
MGKKSKSVEVAAPVVAKSEKNSGKRALEEAIAAPVSKKTKPEKKVVPPPKKVESSSEEDSESEEEEAPKPVVKAAPKAAAKAAPAKKAPVESSSEEESSDEEDLKPAAKLTFKAPAKKEESSSEEEDDDSSDEEMVPVKAAPAKNGKTSVKAAVEESSEEEDSDDESEEEVKPAAKSAKAPAKKEESSSEESDEDSDMEDVEPAKVVAKAPAKKVETSSEEESDDDDDDSEDEKPAAKNGAVVKAAKKADDNSSEEDDSDDDDSEEEAKPQNTEVAAKPVAKEESSEEEESEEEDEKEEVKTPAKTPAKTPTTSSTGGSKTIFVKNLAWKVTQDTLYEFFADAGTVADVRISQDDDGRSRGFGHVEFETPEGAQNALLKSGQNVEGREIWCDLARERGAATPGGGKDWSQTPNGGTRGGRSGGGQTAYVRGFDKFQDEETIRSGLTKLFSDCGTVLNVRIPTDRESGQIKGFAYVEFGSKDEVNKAFELDGSDFNGRSLVVNEASSGGPSGGGGGGGSFSGGRGGRGGRGGRGGDRGGFGGRSGGRGDRGGRSGGRGGRGGSLIRRRGFFISPFSEDASGGKRMNYPVLGLENFFSIQTEVESLAAFFSYLHELSRVAINTRKRISRFEKTYFKVANVDVEVKLFFILAEWRRRTNWNLHMPQACGKNSSSISGHIVSLSLVRLSENPWLGDGAVVLVFVDSSTSMVSTAAAEYSIQDNREKQLQRECTTQTIIVGAEIDAHSYGRNRSCEDCDESYGNVPACSTVFSCRSAPRKIFIIKILFVGTNFSERKAGSASED

SEQ ID NO: 13475 - protein, 296 aa, Tropheryma whipplei str. Twist
MLRSLPQSKPLDDLIGRTIAVIGLGTMGAAIAEGIARARKAMNEEIPRGQFYCTKREYKFERNSVITSESVVLYIQDDPDANITVTQRSDLIIIAVRPEHIKHVLNSISPALDRKKLIVSLAKDVNLSNLAAMLPSGTAIVRCATNLPITVRHGFTGLSCNKHVLPSDVKAVYTLFELLGRCTMLSEEHLTIVSAITGFYPVYMLYMLTKIKEATEKLGLPRDISQAAVETAWIGYAQVVLKHKTTAKGLLRLIPRGPRSAVVKCLDRTDLGSVTYKVLLASIEQDSELLDGIIDQ

SEQ ID NO: 13476 - protein, 369 aa, Chorispora bungeana
MNAGGQFTDFPAVQTHGGQFISYDIFGSLFEITSKYRPPIIPIGRGAYGIVCSVLDSETNELVAMKKIANAFDNHMDAKRTLREIKLLRHLDHENIIAIRDVVPPPLRRQFSDVYIATELMDTDLHQIIRSNQSLSEEHCQYFLYQLLRGLKYIHSANVIHRDLKPSNLLLNANCDLKICDFGLARPTSENEFMTEYVVTRWYRAPELLLNSSEYTAAIDVWSVGCIFMELMNRKPLFPGKDHVHQMRLLTELLGTPTESDLGFTHNEDAKRYIRQLPSFPRQPLAKLFSHVNPLAIDLVDRMLTFDPNRRITVEEALNHQYLAKLHDPNDEPICQKPFSFEFEQQPMDVEQIKEMIYKEAIALNPTYG

SEQ ID NO: 13477 - protein, 261 aa, Oryza latifolia
GVTDLAPGDHVLPVFTGECKECPHCKSAESNMCDLLRINTDRGVMIGDGKSRFSINGKPIYHFVGTSTFSKYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 13478 - protein, 347 aa, Streptomyces avermitilis MA-4680
MERAGPAEPRNVPSPGPRDECVSIRNLVARLRADYPSADAVTVEVTVRTAYDVFGVANLAAGLFQGFPVSTSGSRTAVAERAGARSQLTGVVGAALIVLMLVLAPGLFRNLPQPALAAVVITASLSLADIPGAVRLWRQRRTEFLLCIAAFAGVALLGVLEGIAIAVALSVLNVFRRAWWPYNTVLGRVQGLEGYHDVRSYPQAGQLPGLVIYRFDAPLIFANAKAFRDEIRRLADADPRPSWIVIAAEPMTDVDTTAADVLEELDETLNANHVHLVFAELKDPVRRKIERYGLTRTIDPRHFFPTVEAAVAAFRLRTGAEWTPLTTAEQPARPKPDTAAPPPADER

SEQ ID NO: 13479 - protein, 229 aa, Desulfotalea psychrophila LSv54
MICQNIAQVKERIAQAAKKAGRAPEDIQLVAVSKRLPAETVLQAIACGQQQFGENYIQEVQEKKELIGDKARFHFIGNLQSNKAKMAATYCSMVETVDRLKIAKALNKHSLELDKTLDILVQVNIGQDQNKSGTDKAEAAELIRQINKLPALRIRGLMTIPPLHKEPEDSRPHFRNLRTLAEKLVSENILQCDGRVELSMGMSSDYHIAIEEGATIVRVGTAIFGTRVN

SEQ ID NO: 13480 - protein, 210 aa, Arabidopsis thaliana
MAIQKILFASLLICSLIQSIHGAEKLRLFKELDKGALDVTTKPSREGPGVVLDAGKDTLNITWTLSSIGSKREAEFKIIKVKLCYAPPSQVDRPWRKTHDELFKDKTCPHKIIAKPYDKTLQSTTWTLERDIPTGTYFVRAYAVDAIGHEVAYGQSTDDAKKTNLFSVQAISGRHASLDIASICFSVFSVVALVVFFVNEKRKAKIEQSK

SEQ ID NO: 13481 - protein, 436 aa, Dioscorea quinquelobata
QKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDELMSNFFAQPDALAYGKVADQLLNEKVPDHLIPHKTFPGNRPSLSLLLPSLNAYNVGQLLAIYEHRIAVEGFVWGINSFDHWG

SEQ ID NO: 13482 - protein, 184 aa, Glycine max
MASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 13483 - protein, 262 aa, Streptococcus pyogenes str. Manfredo
METKYAFARQIIKEAGLFIKSKMSEQLDIQVKTQFDDLVTNVDQETQQLLMDRIHQTYPCDAILAEENDVRHPINQGNVWVIDPIDGTVNFIVQGSQFAVMIAYYEQGIGQFGLIYDVMADQLLAGGGDFEVTLNGDKLPAYQEKPLERSLIGCNAGMFARNDRNLAHLIAKTLGVRVYGGAGICMVKVMKQELLAYFSFIQPWDYAAAKVLGDKLGYVLLTIDGYEPDFQTRQKIMFVPKCQLTRIASFLTKDSAVILEDQ

SEQ ID NO: 13484 - protein, 222 aa, Zea mays
MTMKLDAPARQKSQDAEQNGRTAAAGVLGIDEPWSQPKLRLTGHAQADADALVPPLNFAMVDDGIFRSGLPDAGSFRFLLSLNLRSVVYLCPEPYPEENARFLQQNGIQLHQFGIEGSKSGSTVPDAMVVQEPFVYIPEETIREALKVILDARNQPVLIHCKRGKHRTGCVVGCLRKLQKWCLSSVFDEYLHFAAAKARSTDQRFMELFDASSLTHLAASQY

SEQ ID NO: 13485 - protein, 261 aa, Oryza latifolia
GVTDLALGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMNK

SEQ ID NO: 13486 - protein, 520 aa, Arabidopsis thaliana
MKKKQQKQEFVAETSEMNNNNECSGQDQQKRYVWPWVGLVANVPTEVEPSGRRVGKSGSTLRDEFTLKGFNPTRVKPIWNTKGHTGFALVEFAKDFKGFESAMQFEKSFDLDRHGKRDWKKGHRLRDDKLYGWLAREDDYNRSDTVGKNVKKKRDLKSISQIVEEDQRKLYHLFENMCQTIEKNKQRKQQLEQKVDETLESLEFHNLMLNNSYQEELEAKREKLDERARLIEQRAIKNEEEMEKTRLEREMIQKAMCEQNEANEEAMKLAEKHQASTSLKEKEKLHKRIMEMEAKLNETQELELEIEKLKGTTNVMKHMVGCDGDKDIVEKIAKTQIELDARETALHEKMMTLARKERATNDEYQDARKEMIKVWKANEELMKQEKIRVKIMGELNPAPFLPAVMNKHKAMMLCSVWAAEIGDVQWTPFRVDESDGTPKRVVDENDEKLRMLKNQYGEEVYSEVVRAKLEMEEHNASGSYETEELWNYEENRKATIEEITDVMLKIRSKLAAMKNKRKRP

SEQ ID NO: 13487 - protein, 408 aa, Candidatus Kuenenia stuttgartiensis
MQFNSIQEVIEDLRNGKMTILIDDESRENEGDLILAAEKVTPEAINFILTHARGILCLAINAKRAEELDFYPMVSNNTSSFQTPFTVSVDAAREISTGVSSKDRATTILTAIDDNATAEDFVRPGHIFPLKAHNGGVLVRAGHTEGAVDLTRIAGLKNAAVICEIMREDGNMAKLPDLKKFAEKNNLKICTIADIIKYRHEQERLIEKRVTAKLPTIYGEFILHLYRSFVDEYLHLALCLEVGSKDINTPSPMQNEPILVRVHDECLTSDVFGSLRCDCGEQLHNALKIIKENGKGVLLYMRQEGRGIGLENKLHAYHLQDKGLDTVEANEKLGLPVDKRDYGIGAQILRDLGITKMRLLSNNPKKFAALAGYGLEIVERVPIVVEPNAENQKYLRTKKEKLGHMIET

SEQ ID NO: 13488 - protein, 332 aa, Oryza sativa Japonica Group
MPLAEGEFALPDEVLAVMPRDPYEQLDLARRITALAVAGRVTGLEREAARLRESAADKDRENGELRERVALLDRALQETNSRLRAALEDNIKLSKERDSLAQTSKKLARDLQKLESFKRHLMQSLRDDSPSKMSGTNLSLIFSLNIADGDSITHTTTNLLSTSLDVGSTVQEGTVSKPPIQKYALSSHITPRLTPEATPKIMSTSASPRRMSTTATPKLMSGTTSPSKTRIEGYMSMTPWYPSSKQSSAANSPPRGRPNPGRTPRIDGKEFFRQARSRLSYEQFGAFLANIKELNAHKQSREDTLKKAEEIFGPDNKDLYLSFQGLLNRSLP

SEQ ID NO: 13489 - protein, 261 aa, Oryza latifolia
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMNK

SEQ ID NO: 13490 - protein, 373 aa, Candidatus Kuenenia stuttgartiensis
MNEKKAILVLEDGTCFNGCSLGAAGETIGELVFNTSMMGYQEILTDPSYAGQLVALTYPLIGNYGINEEDIESYRLFLEGFIVKECSPFSSNWRSKIDLSEYLTKNGIVGIQGIDTRALTCQIRDFGSQQGIISTIDFDRTRLQEKAKSAPGLTGRDLVAKVTCEKPYDWVNKKGTPHLSRKYKVIVYDCGVKYSILRKLAHAGCSVHVVPAKTSFETVLEMNPDGIVLSNGPGDPSVVSYMIENIKGLLGKRPIFGICLGHQLLALALGLKTSKLKFGHHGGNQPVMDLSTKKVEITAQNHCFAVEIPSQGMLHKSTYGDVEITHLNLNDKSVEGLKCHSVPAFSVQYHPEASPGPHDADYLFDRFLQTMKS

SEQ ID NO: 13491 - protein, 51 aa, Prunus persica
LIQGLADVEAAVCLCTAIKANILGINLNIPISLSLLLNVCGNKVPKDFQCA

SEQ ID NO: 13492 - protein, 261 aa, Oryza latifolia
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVSPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 13493 - protein, 479 aa, Streptomyces avermitilis MA-4680
MSTELRRLRNHIDGEFRDAADGRTTEVVNPATGEAYATAPLSGQADVDAAMAAAAAAFPAWRDQTPAERQKALLKIADAFEERAEELIAAEVENTGKPIGLTRSEEIPPMVDQIRFFAGAARMLEGRSAGEYMEGMTSIIRREPIGVCAQVAPWNYPMMMAVWKFAPALAAGNTVVLKPSDTTPASTVLIADIIGSILPKGVFNVICGDRDTGRAMVEHPTPAMASITGSVRAGMSVAESAAKDVKRVHLELGGKAPVVVFEDTDIPKAVEDISVAGFFNAGQDCTAATRVLVQESIHDEFVAALAKAAADTKTGQPDDEDVLYGPLNNPNQLKQVAGFVERLPAHAKVEAGGHQVGEKGYFYAPTVVSGLKQDDEIIQNEVFGPVITVQSFTDEAQAIEWANGVDYALASSVWTKDHGRAMRLSKSLDFGCVWINTHIPLVAEMPHGGFKKSGYGKDLSAYGFDDYTRIKHVMTSLDS

SEQ ID NO: 13494 - protein, 320 aa, Physcomitrella patens subsp. patens
MGLMETLVKHPDEIRPLVKLKVDAMRAQRAIPKDPYLAFCYRMLMRVSRSFSIVIQQLRTELRDAVCVFYLVLRGLDTIEDDMAIPIDIKVPILKSFHEHIYDPSWKFVCGEKDYKELMNKFECVSNAFLNLDEGYQRVIAEMTNRMGVGMAKFIETEVCAMFGICEIPAPRMFWPHEIWGKFGTRLEDFKLEENSENAVRCLNAMITNALTHATDCLKYIEANKDESNLRFCAIPQIMAIGTLAECYNNINVFRGVVKIRRGITAKVMQTKTISDVYGTFFDFSRKIAEKIGENDDSASATRKHIEDIQEYCESHLLET

SEQ ID NO: 13495 - protein, 459 aa, Streptomyces avermitilis MA-4680
MGNPIAVSKDLSRTAYDHLWMHFTRMSSYENAPVPTIVRGEGTYIYDDKGKRYLDGLSGLFVVQAGHGRTELAETAFKQAQELAFFPVWSYAHPKAVELAERLANYAPGDLNKVFFTTGGGEAVETAWKLAKQYFKLQGKPTKYKVISRAVAYHGTPQGALSITGLPALKAPFEPLVPGAHKVPNTNIYRAPLFGDDPEAFGRWAADQIEQQILFEGPETVAAVFLEPVQNAGGCFPPPPGYFQRVREICDQYDVLLVSDEVICAFGRLGTMFACDKFGYVPDMITCAKGMTSGYSPIGACIVSDRIAEPFYKGDNTFLHGYTFGGHPVSAAVGVANLDLFEREGLNQHVLDNESAFLTTLQKLHDLPIVGDVRGNGFFYGIELVKDKATKETFTDEESERVLYGFVSKKLFEYGLYCRADDRGDPVIQLSPPLISNQSTFDEIESIIRQVLTEAWTKL

SEQ ID NO: 13496 - protein, 229 aa, Leuconostoc mesenteroides subsp. mesenteroides ATCC 8293
MNKQKKHAGEFAATLIEDGMVVGLGTGSTIAYFLEALAKRIQDEKMTIIGVTTSTKTARCAEELGIPIRDIDLVPMIDLTIDGADEVDQHLNGIKGGGAAFLMEKIVARYSRRVIWIIDEQKLHSKLGQFPLPVEVVAFGSGKLIAELKERHLHPKLRLDNHQQPLVTDLGHYIVDLDLEQIDQPFELGRYLDGQIGIVEHGLFLNVADQVIIGQDEGYRIMNNLQKEM

SEQ ID NO: 13497 - protein, 75 aa, Desulfotalea psychrophila LSv54
MALDEKMVDIIVEQLSVEKEKVVAKASFVDDLGADSLDLVELIMAMEEGYDIEIPDEDAEKIATVQDAIDYVSNK

SEQ ID NO: 13498 - protein, 253 aa, Thermus thermophilus HB8
MFLEKFRLDGKAALVTGGSRGLGLEAALALKEAGARVAVVARRASFFEEARKALGEDALYLEGDVRDEARLEAIAEEVEERLGPLTVLVNAAGVSWGAPSLEMPVEKVREVLEVNLVGAFLASRVAARRMKERGYGKIIHIASVAGLKGEYPEVLDAVGYSASKGGLIALTRDLAVKWGRWGIRVNALAPGFFPTRMTEKVLPRAEAFLKATLPLGRPGAPGELGGAVLFLASPASDYVTGAVLPVDGGATAL

SEQ ID NO: 13499 - protein, 506 aa, Mycobacterium avium 104
MTTQIPHFIDGQRTAGQSTRTAEVFDPSTGAVQAQVPMAGRADIDAAVASAIEAQKGWAATNPQRRARVLMRFIELVNQHNDELAELLSREHGKTLADAKGDIQRGIEVIEFCVGIPHLLKGEYSEGAGPGIDVYSLRQPLGVVAGITPFNFPAMIPLWKAGPALACGNAFVLKPSERDPSVPVRLAELFVEAGLPPGVFQVVHGDKEAVDAILNHPDIQAVGFVGSSDIAQYIYAGAAATGKRSQCFGGAKNHMIVMPDADLDQAVDALIGAGYGSAGERCMAISVAVPVGDKTADRLRARLVERINNLRVGHSLDPKADYGPLVTGAAVARVRDYIDQGVAAGAEIVVDGRERRSDDLTFGDANLEGGFFIGPTLFDHVTPDMSIYTDEIFGPVLCIVRAQNYEEALRLPSEHEYGNGVAVFTRDGDAARDFVSRVQVGMVGVNVPIPVPVAYHTFGGWKRSGFGDLNQHGPASIQFYTKVKTVTSRWPSGIKDGAEFVIPTMD

SEQ ID NO: 13500 - protein, 636 aa, Zea mays
MLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMAAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELGLATRLPPPSDLVKYAENCMYTPVYRNYR

SEQ ID NO: 13501 - protein, 166 aa, Tetrathiobacter kashmirensis
MTISIGDRVPEGTLTEFVESADNGQSGPQAFKVSELVKGKKIVLFAVPGAFTPTCTTKHVVDFIRDAEQIKAKGVDEIWCVAVNDAFVMGAWGRDTGATGIIRLLADGSATWTTEMGLELDLVARGLGVRSRRYSAILEDGVVKQLNVEEGGEYKISGTQTILSQL

SEQ ID NO: 13502 - protein, 175 aa, Triticum aestivum
MPPPVMASSATSVAPFQGLKSPAGLPVSRRSNGVSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 13503 - protein, 193 aa, Nicotiana plumbaginifolia
MFLWDWFYGVLSSLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDEALSTVPFLILGNKIDIPYAASEDELRYHLGLTGVTTGKGKANLADSSVRPLEVFMCSIVRKMGYGDGFKWVSQYIK

SEQ ID NO: 13504 - protein, 415 aa, Panax quinquefolius
MGSLGAILKHPDDFYPLLKLKIAARHAEKQIPSEPHWAFCYSMLHKVSRSFGLVIQQLGPQLRDAVCIFYLVLRALDTVEDDTSISTEVKVPILMAFHRHIYDNDWHFSCGTKEYKVLMDEFHHVSNAFLDLGSGYKEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLEDLKYEENSGKAVQCLNDMVTNALLHVEDCLKYMSDLRDPAIFRFCAIPQIVSIGTLALCYNNIQVFRGVVKMRRGLTAKVIDRTNTMSDVYGAFFDFSCMLKSKVDNNDPNATKTLSRLEAIQKICKNSGALTTKRKSYIIENESGYNSTLIVILFIILAILYAYLSSNLPNSL

SEQ ID NO: 13505 - protein, 279 aa, Streptococcus pyogenes MGAS8232
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDHLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 13506 - protein, 194 aa, Nicotiana plumbaginifolia
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYQMGLTGITTGKGKVNLAESNVRPLEVFMCSIVRQNGIMAKGFKWVSQYIK

SEQ ID NO: 13507 - protein, 93 aa, Triticum aestivum
MASGQQERSQLDRKAREGETVVPGGTGGKSLEAQQNLAEGRSRGGQTRREQMGEEGYSEMGRKGGLSTNDESGGERAAREGIDIDESKFKTKS

SEQ ID NO: 13508 - protein, 431 aa, Physcomitrella patens subsp. patens
MLSNNNLTGPIPAGLKDLTDLTTLRLFNNKLTGSIPSWLALLPNLTELDLRNNDLSGRVPEALLTNSALAFRFEGNSRLCVNATSCPGDKSNVGVVVGVVVGTVAVAIIVALVVVYFFWSARKKRAPLEKIPLQGGENPRGSKFTYAQVMFATKNNHKMLGKGGFGPVYYGKLQDGQEVAVKVSSKVSAQGSREFINEIDLLTKVHHKNLVTLVGYCNDGNNLMLMYEYMPLGSLQDHLYGTLCCFLRDKLFLDWPTRIHIALQAAQGLEYLHRGCSPAIFHRDVKSNNILLGHKMVAKVADFGLSKSTNSNEAVSHVSTMVKGTMGYLDPDYFNTNQLTEKSDVYSFGIVLLELICGRAPLVPDLPEQERRLDQWARPYLSNENIQMIVDPSFGDKYHLESVWRVAELAMQSVEPRGIHRPKMREVVQEL

SEQ ID NO: 13509 - protein, 1314 aa, Debaryomyces hansenii CBS767
MSSHQRQDSIASLSSTATGNIHPQKIGPWKLGKTLGRGATGRVLLATHQSTGQKAAVKVVSKSELNDDEINKKSADEAGLPYGIEREIIIMKLLTHPNVLRLYDVWETSKALYLVLEYVEGGELFDLLVERGPLQEVEAIKYFRQIILGTAYCHALGICHRDLKPENLLLDSGLNVKLADFGMAALESNGKLLETSCGSPHYAAPEIVSGLKYHGAASDIWSCGVILFALLTGRLPFDDENIRNLLLKVQAGSFEMPCELSPEAVDLIDKMLTVDPMKRIPTERILSHPLLTKYPIPNEDLISVKSLPHPETAYKSLGSEKNIDKQILQNLSILWHDRSQGDIVDCLLKTGSNPEKTFYALLMRYRHNQEESAGSSPTRSNSQNFNNKIGNKDNNRKKRMSQVSASTSRNRPVLFQYKNGIKSSIGNGNGRLSSTSSVSNSPRKSPVRRSSNRYSFAQSPRKFGGTSDETTLHSSSVPRNIYNEIVSAQRNGQGVMPPPLPSKDNMDSKSNPIVDEVSNQDLLSSAKISPTKNKRGSVIRNSISKNRLSRRKSRTSFTPGLKRNSITTKLLSTYAKLAGETDWEFMDKQTKRTSATFATLCDKIFNQEQYDAEDEKLIDEEEKQAKEYERLMEIERKKHEAELRARKELAKQRKREKRKSLLSSRKLSILVKDDANNSEQDITVTDSDALSQPKRQSRNQAMRSISEGHGKESDDLTKEDLENLKRRSVTQPTPRRRKTPVLTRRPVSRLDPLWTAYENEEIERAQDALEAEYRDADFKTKKKINRESMVSVMDDKEVDNEPHVDDDATDEVQDEEAVKAKSRGYELPEPDMERSDLSDEYMSEIRKSRLLNSQLNINAIANGEKEVKSEKRQDKEPKTLIGDVRIPTVTRKSRCFTNSNKRLSVLSMYSTKQSYRDLNSILGDENDENNDVEGQLPQLRTSFADRLDRAGLADAEEEDDEPLDEGSIMDFDQHLANKRSSYYAGDKSRRQSRYSTTKRNSQAPTVDVPAIPKKSNKERDREDDTFVTKDDDVHRRKSAYSAKGANNNDDEDMIFENIKLPNEDRRQSASTAKSNKKKSFQPSAESMLIPNVDNIPEDAKTRKPDPRSQPYEKVRKPKVSNGELKSTGPEGQVKNPLEDTTNEPRENQKRKGSIFRKLSWGSKKTMDNSAAQLPSPADSRAPSVEEKPKSKSGFFRWFSSSSNQPGIESEIRRFKAILPKQEMSSALFALLNSWSNFGLKNLRNDTVGYNITGEISKNNAFNLKNCKFRIKVNPREFNQKSEIVCARVKGSKVTTDTLFKEIEKVLQKEGVMDI

SEQ ID NO: 13510 - protein, 261 aa, Oryza alta
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGVRIAGASRIIGIDLNANRFEEARKFGCTEFVNPKDHDKPVQQVLAEMTNGGVDRSVECTGNINAMIQAFECVHDGWGVAVLVGVPHKDAEFMTHPMNFLNERTLKGTFFGNYKPRTDLPNVVELYMKK

SEQ ID NO: 13511 - protein, 411 aa, Schizosaccharomyces pombe 972h-
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSSKRFLKASIFVHQLVRQRYSVNRTDDDDLQSEPSSSLTNDGH

SEQ ID NO: 13512 - protein, 196 aa, Oryza sativa
MRGPSTTTMATFKQSFLKNLLSSLKSSSKNKAAMSTLSERKRAIKSSADIAMATARTGIAGAARWPHAILASSSSSSSSSSSSSSSSSSSMPRTTFPCKMMQGKVRRRCKSIVRRRTPLMSSSSEVARRLVKKRDKVLRRMIPGGELIADEISLLHEAMDYVVHLHAQVDVLRRVSRAAVARRSSASSSSSGGPDC

SEQ ID NO: 13513 - protein, 392 aa, Triticum aestivum
MNPMGYRPYDSSGTDDDLPSSQNRGLRGRSFSGNGRASAGPFPYARPHNDLESQVHLVEQEAYTGVLRAFKVQSDALSWEKESLISELRKELRVSDEEHRELLNKVNEDGAIRGMRELRQGGGTPSGLHRGSRVLHDGEPGPTAKRQRPSHLMPSHSSGLQSPVMSSHSVPSSSKWGPSSASRGKRAKSTTPLALPSMDPTSLISRKVFTRWPDDNNFYEATITRYNPATGEHALVYDMGKTTESWESVRLCDMRPEDIRWERDDQGISNRDGWGPSGPLLNRNQSNNGRGRLSQNEHPNKYGPPQNGINRNIGEIDVPNTQSVVIEVERVLSNPNMHEIEKAKKLLTDQEQSLLDAIASLDDASDSESEDKAMEARMGSGGDHTGRNGIAC

SEQ ID NO: 13514 - protein, 561 aa, Mycobacterium avium 104
MTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALAAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNSLGVTDHLAFRVQTYGELDDALTAAARHQDRMVLVEVVLPRLEIPRLLVELVRPTSPDGSPRR

SEQ ID NO: 13515 - protein, 333 aa, Oryza sativa Japonica Group
MELFERARTVRLRGHHDKYLYAEEDESRVSQDRSASSPNARWSVEPVPHAPGVLRLRSHYGRYLSASNEPFLLGVTGRKVLQALPHRLDSSVEWVPVRDGAHARLRTRYGNYLRANGGLPPWRNSVTHDVPHRHAGWILWTVEVVEVLPESLVPAPIASDDDPAAPHYKTPSRGPSPVPTPALAPASPPRHRPASPPSYLARPPPPPPGYIEPPQGYIEPPPPEPTLARIESTESFSLPLHKVDGRAIHYHIGDDNGDIGDDQEGHSFTFNGTSLEELLERLQEETGLNDVIICSRSPINGKLMPLRLQLPPNNAAMHIVLVRESSKVAKSFP

SEQ ID NO: 13516 - protein, 319 aa, Symbiobacterium thermophilum IAM 14863
MDEKRLELATFAGGCFWCMVSPFEEQPGIYKVVSGYTGGHKENPTYEEVCSGTTGHFEAVQITFDPDVFPYERLLDLFWQQIDPTDPDGQFYDRGPQYRTAIFYHNEEQRRLAEKSKAELEASGRFDKPIATLILPAGPFYPAEEYHQGYHRKNPFHYQRYRAASGRDDFIRKHWRDPERDAELRRRLTPIQYEVTQLGATERPFTGEYWNHFEEGIYVDVVSGEPLFSSRDKFDAGCGWPSFTRPLVPENIVERLDLSHGMVRTEVRSRGADSHLGHVFPDGPAPTGLRYCINSAALRFIPKEDLEKEGYGEFRKLFE

SEQ ID NO: 13517 - protein, 415 aa, Panax quinquefolius
MGSLGAILKHPDDFYPLLKLKIAARHAEKQIPSEPHWAFCYSMLHKVSRSFGLVIQQLGPQLRDAVCIFYLVLRAFDTVEDDTSISTEVKVPIVMAFHCHIYDNDWHFSCGTKEYKVLMDEFHHVSNAFLDLGSGYKEAIEDITMRMGAGMAKFLCKEVETIDDYDEYCHYVAGLVGLGLSKLFHASGAEDFATDSLSNSMGLFLQKTNIIRDYLEDINEIPKSRMFWPCQIWSKYVDKLEDLKYEENSGKAVQCLNDMVTNALLHVEDCLKYMSDLRDPAIFRFCAIPQIMAIGTLALCYNNIQVFRGVVKMRRGLTAKVIDRTNTMSDVYGAFFDFSCMLKSKVDNNDPNATKTLSRLEAIQKICKNSGALTTKRKSYIIENESGYNSTLIVILFIILAILYAYLSSNLPNSL

SEQ ID NO: 13518 - protein, 595 aa, Staphylococcus epidermidis RP62A
MSLELPVMLTIVLFLALGIFSQWLASRIKWPSIVVMAIVGLLVGPIFGLANPKEALGPEAFSSIVSLAVAIILFEGSSNLDFRELKGISKAVIRIITIGAGIAWILGAIALHVTMNFPLSISFVIGGLFLITGPTVIQPLLKQAKVKRNVDSVLRWESIILDPIGPIIALTAFYVFQIFEEGIGFVVIILFILKLLAAILIGFGAAFLFNWLIGQDKIPQSLMPPIQLVFILLTFSICDEILSESGLLAVTIFGLMMARKKRHDLIFKESDHFIDNASSILVSTVFILITSSLTKDVLLNVLSWQLILFSLVMIVLVRPISVLLSTLGTEITKKERVVVALMAPRGIVVLTVAQFFSSLFMDDKIPMAQYITPVTFGLVFITVVIYGFGFTPLSKLFGVASTEPPGVIIVGESEFSFHLGINLRDHGIPVMMFNLFENTSEKAHEAGFEVFKGNLLSSNDRIYSDLLRYNKCILMTQSFIFNSLAFNELVPEFGLNNVDMMPVSFNDEQARNNLNGPIRNHILFDENHTPRWFNQFITQHNIVEVPAEDYEKITENDMLIYHINEDKEVTFKRSNRDIPEHETGVYGILKNAYLT

SEQ ID NO: 13519 - protein, 1404 aa, Oryza sativa
MEDKKQQQQQQREEAEAEEEAPVVPSSLRAAATCRSLSSLSSSLRWDHRGDDDEEEAELRWAAIERLPTLDRMRTSVLSSEAVDVRRLGAAQRRVLVERLVADIQRDNLRLLRKQRRRMERVGVRQPTVEVRWRNVRVEADCQVVSGKPLPTLLNTVLATARGLSRRPHARIPILNDVTGILKPSRLTLLLGPPGCGKTTLLLALAGKLDKNLKVTGEVEYNGANLNTFVPEKTSAYISQYDLHVPEMTVRETLDFSARFQGVGTRAEIMKEVIRREKEAGITPDPDIDTYMKAISVEGLERSMQTDYIMKIMGLDICADIIVGDIMRRGISGGEKKRLTTGEMIVGPSRALFMDEISTGLDSSTTFQIVSCLQQVAHISESTILVSLLQPAPETYDLFDDIILMAEGKIVYHGSKSCIMNFFESCGFKCPERKGAADFLQEVLSKKDQQQYWSRTEETYNFVTIDHFCEKFKASQVGQNLVEELANPFDKSEVYNNALSLNIYSLTKWDLLKACFAREILLMRRNAFIYITKVVQLGLLAVITGTVFLRTHMGVDRAHADYYMGSLFYALILLLVNGFPELAIAVSRLPVFYKQRDYYFYPAWAYAIPSFILKIPLSLVESITWTSISYYLIGYTPEASRFFCQLLILFLVHTGALSLFRCVASYCQTMVASSVGGTMSFLVILLFGGFIIPRLSMPNWLKWGFWISPLSYAEIGLTGNEFLAPRWLKFHSLKRYSDTIWTSATGTSRAIISRDKFSTFDRRGKDMSKDMDNRMPKLQVGNALAPNKTGTMVLPFSPLTISFQDVNYYVDTPVEMREQGYKERKLQLLHNITGAFQPGVLSALMGVTGAGKTTLLDVLAGRKTGGVIEGDIRVGGYPKIQQTFARISGYCEQTDVHSPQITVEESVAYSAWLRLPTEVDSKTRREFVDEVIQTIELDDIRDALVGLPGVSGLSTEQRKRLTIAVELVSNPSVIFMDEPTSGLDARAAAIVMRAVKNVADTGRTVVCTIHQPSIEIFEAFDELMLMKRGGELIYAGPLGLHSCNVIHYFETIPGVPKIKDNYNPSTWMLEVTCASMEAQLGVDFAQIYRESTMCKDKDALVKSLSKPALGTSDLHFPTRFPQKFREQLKACIWKQCLSYWRSPSYNLVRILFITISCIVFGVLFWQQGDINHINDQQGLFTILGCMYGTTLFTGINNCQSVIPFISIERSVVYRERFAGMYSPWAYSLAQVAMEIPYVLVQILLIMFIAYPMIGYAWTAAKFFWFMYTIACTLLYFLYFGMMIVSLTPNIQVASILASMFYTLQNLMSGFIVPAPQIPRWWIWLYYTSPLSWTLNVFFTTQFGDEHQKEISVFGETKSVAAFIKDYFGFRHDLLPLAAIILAMFPILFAILFGLSISKLNFQRR

SEQ ID NO: 13520 - protein, 479 aa, Staphylococcus epidermidis RP62A
MEVFNMTNQLFINNEFIDSQSKETMDVINPATGEAFDTITLATEEEVNDAIEKSQQAQLEWERVPQPTRAEHVKLLIPLLEKNRDEIAQLYVKEQGKTLTQAYGEIDKSISFIDYMTSLSMSDKGRVLQNSIANETIQIINKPIGVTAGIVPWNAPILVLMRKVIPAIVTGCSVVIKPSEETTLLTVRLAELFRASTIPAGLIQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDDNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 13521 - protein, 805 aa, Vitis vinifera
  misc_feature (783)..(783): Xaa can be any naturally occurring amino acid
MAIPLSLSSNILRQRQRHTPESVRPVPIRILTVGKKRSRGVQLIVDEYIEKLKYYCSADDIQIRSNPKNARDVKAQVENEDTAVMGLIRPDDWVVMLDEHGLDLGSIQMAELLRDVGNTLFITSVSQGAARLSFCIGGPYGHGEQLRKRANISIKLSSMVLNHQIALLVLMEQLYRLVGNSGGVLHATRLKILRRKMMAETATAASESAEEVPVRELCVNGTCVKTDEFEAKLDEGNIEEAESSLRETFSLSSEDARALLGKLEYQRGKMEAAIQKLLPPPDEKTPPRKARSRPGSMQAVSQQPAGPVIEALYLKSKCLQKLGRTTEAADECRGVLDAVEKIFPLGIPEVLAEKKLQEILSQAAELLPELWKQADNYNEVMAAYRRALLSQWNLDNDCCARIQKRFAMFLLYSGVEAGPPSLAAQIDGSYVPRNNLEEAILLLMILTRKYYLGKTKWDQSVMDHLGFALSLCRQTSLLAKKFEEAMPGVFPRDDRWKALALCYVGAGENGVSLNLLRKSLHKDENPDDLVTLLLAAKICSEDSLLAAEGVEYARRAISNANGADEHLKGVGLRLLGLCLGKQARVAPSDFERSRLLSEALKSLDGAIALEQNNPDLIFELAVQYAEHRNLSAALHYAKQFTDATGGSMEKGWRLLAVVLSAQQRYPEAEVVIDAALDETAKWEQGPLLRLKAQLKIAQSLPMDAIEIYRYLLALVQAQKNSFGSTSQGEDDRINEFEVWNGLANLYSSLSRWKDAEICLGKAIELKDYSVESLHQKGKTRNSXPIHTSISRIGHGLKVIVIENYN

SEQ ID NO: 13522 - protein, 358 aa, Coprinopsis cinerea okayama7#130
MIFSSSLRSAARRGFVTNAPVNGFDGAIGNTPLIYLKGLSERIGSKIYGKAEFQNPGGSVKDRAALGLINNAEKLGLLKPGGTVVEGTAGNTGIGLAHVCRAKGYKCVIYMPNTQSQEKIDLLRMLGADVRPVPAVAYENPKNYNHQAKEYAESLPNAVWTNQFDNVANAQAHYDTTGPEIWEQTGGKVDGFICATGTGGTLAGVGRYLKEKSGGKTQVWIADPPGSVLTSYVNSGGKLTERSGSSITEGIGQGRITDNLGTFVKQVDGAFTVPDEKSIAMLYELLETEGLYLGASTALNVVAAYELAQKLGKGSSVVTILADGAYRYQSRLFSKKWLEAKGLSGAIPEHLKKYSVLE

SEQ ID NO: 13523 - protein, 463 aa, Debaryomyces hansenii CBS767
MSDQPSTEPVKHTEAAEQPTVEPQAQESEEQEVSESPVPVSEEEHSASEEQPNEQPNEQQQQQQPHAGQQAQQQKANEQAVDTNPASAVEGGREVSNKILYVGGLHKSVSDEMLKDLFAVAGAIQSVKILNDKNRPGFNYAFIEFENTQSADMALHTLNGRIINNSEIKINWAYQSSTISSLNPDEPTFNIFVGDLSPEVDDETLNKSFSKFPSLKQAHVMWDMQTSRSRGYGFVSFGQQADAELALQTMNGEWISGRAIRCNWASHKQLNNNNNYRNNNRHHQNNRQFRPFNNAIPQQLQNQNNGMPIGNGQFNPNQQGNMPPSQQQLHNVPQANNSNNGNQANIPVMSPQSYDIVLRQTPSWQTTVYLGNIAHFTQQTDLIPLLQNFGFIVDFKFHPERGCAFVKYDSHERAALAIVQLAGFTINGRPLKCGWGKDRPPMGQFQNFGRGVPPPPMYNQGRP

SEQ ID NO: 13524 - protein, 182 aa, Coprinopsis cinerea okayama7#130
MGANLSKAMGKIFGNKEMRLLMLGLDAAGKTTILYKLKLNQSVTTIPTVGFNVETVTYKNVKFNVWDVGGQDKIRPLWRHYYTGTQGLVFVVDSQDRERIDEAKQELHRILSDREMKDCLLLVFANKQDLPGAMSPAEVTEKLGLHRMRDRSWYVHPSCATTGEGLFEGLQWLSQNVKKRQQ

SEQ ID NO: 13525 - protein, 158 aa, Glycine max
  misc_feature (11)..(11): Xaa can be any naturally occurring amino acid
  misc_feature (21)..(21): Xaa can be any naturally occurring amino acid
  misc_feature (75)..(75): Xaa can be any naturally occurring amino acid
  misc_feature (137)..(137): Xaa can be any naturally occurring amino acid
MATNRSVGSFXEGDWKGKRVXVLVVLSVPLNDNLYICDNTRGWAGAITIKYLTGNGSNVILYRHYRHPKGVTPKXYSLKPVVPRLFEIIEIYVQMVNDCIDEEVDIFFAQLPQSGVLLLENDMIYNVDDMNDPHFAXKIACIADLYMTDAFSAVHRAH

SEQ ID NO: 13526 - protein, 405 aa, Dehalococcoides ethenogenes 195
MAVVVHKYGGTSVGDAERIKHVAKRIIAARQKGSDVVAVVSAMGDTTDDLIALAHKLNDCPEPREMDVLLSTGEIVSSTLLAMALKNMGQDAISLSGQQAGIRTDSAHSKARITGIDPKRIHDELAKGRVVIVAGFQGVSDCQDVTTLGRGGSDTTAVALAASLGASICERYTDVDGVYTADPRLIPDARRLAEISYEEMLELSSYGAKIMHPRAVEIGQVYNIPILVASSFNENPGTLIHGGENMEIRNRVSGIAHDFEVAKITILGVPDKPGIAAGLFAPLAKAGVSVDTIVQNSSQDHITDLTFTVTKSDLGKALEVIGPIAKDIQAREVLSDSRIGKVSIIGTGMLNAPGYAARMFKALSDAGINILLISTSEIRITCIIEEDKVKDAVKAIHKAFEMEKD

SEQ ID NO: 13527 - protein, 338 aa, Aspergillus oryzae
MGSSLRTLEPKKQPKVLVRPKPRPTIPEEFAKSDSVYYRKPGNESVIGAGTYGKVFKAIHVYTQRKVALKKIRMEGEKDGFPVTAVREIKLLQHLRNDNVVSLLEVMVERNECFMVFEYLSHDLTGLINHPTFTLTAAHKKDLAKQMFEGLSYLHHRGVLHRDIKAANILISNRGQLKYADFGLARFFSKSRQLDYTNRVITIWYRPPELLLGETRYGPAVDVWSAACVYVEMFTKKAVFPGEGGEISQMEKLYNCLGTPTRAEWPDIVEMPWFELMRPTERKRRVFEEVYGQILTPAALDLVSQIFRYDPTARPNAEEILAHPYFAEEEPRPQQAIE

SEQ ID NO: 13528 - protein, 269 aa, Solanum tuberosum
MVGSVNIDQQGKGGYVSDEVLGTFLPIVVYWVYSGLYLMLGNMDNYRLHSKKDEDEKNLVSKKEVVKGVLLQQIVQAAVATVLFAVTGDDGESGGDRHTSIFVLGRQLFIAMLMLDTWQYFMHRYMHQNKFLYKHIHAQHHRLIVPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDMILGTYMPYELERRPEGGFEAKPVKDCKEH

SEQ ID NO: 13529 - protein, 136 aa, Prunus persica
MAEENQVIGCHTTQAWEEQLHKGNENKKLVVVDFTASWCGPCRLIAPILAELAKKTPEVTFLKVDVDELRTVSEEWGVEAMPTFLFLKEGKIVDKVVGAKKDELQIKVAKHVAAAAAASATSASATAATATATASA

SEQ ID NO: 13530 - protein, 345 aa, Zea mays
MELFERARTVRLRSHHDKYLYADEDEVHVIQDRNAASPNARWVVEPVPHSPGVLRLRGRYGRYLSASNEPFLLGGTGRKVLQTLPHRLDSSVEWVPVRDDAGSNAHARAVRLRTRYGNFLRANAGLPPWRNSVTHDVPHRHTGWVVWDVEIFQALPPPTGPDSSSSSAAAETDADAFASSPAPSSSYNNKAPHSSAPLPTSALRPPPPPAHHREENLVPFKGQPAPPPPGYIAPPAPGFYRLESTDSFSVPLHKVEGRAVHYHIGDSDGEVRPDEEPHYLTFNGTSLEELLERLKEETGLHDVIMCSRSPINGKLLPLRLQLPPNNAAVHIVLVQESSNVAKTFA

SEQ ID NO: 13531 - protein, 122 aa, Schizosaccharomyces pombe 972h-
MSSKSGLFLPLSSVITSYNENTNLSLKTIDAFLGFLVVVGGLQFGYALLVGTYPFNSFLSGFISCVGQFVITVGFRMALTQQELQSSSSKKKSPVVSPYKRAFLEFCFSSLVLHFFAVNFLG

SEQ ID NO: 13532 - protein, 243 aa, Candidatus Protochlamydia amoebophila UWE25
MKREPQAVKIAPSILAGDFGHLADEAKKAEQAGADSLHLDIMDGHFVPNLTMGSQAVSAINRATNLFLDVHLMIYNPFDYIERFVQAGADSITFHMEATEDVEETLAYIRKCNIRAGLAFNPETSVSMIPKYLDKCDMILLMTVNPGFGGQKFIEKVLDKVQFTRDLCNQLNIRAGGVTLKDNSSTGHQLPPFDIQVDGGITHLNVRRCVEAGANVIVAGTSLFKSPNFADAIKQMRQSAEGH

SEQ ID NO: 13533 - protein, 534 aa, Mesembryanthemum crystallinum
MGICASKNKATQPEDNGYTPANGVGSNNQSKPPAQQNYHQQPPQQPVAPPQPASHPPVRMPSPKPAPKVEPNTILGKPFEDVKVYYTLGRELGRGQFGVTYLCTDKKTGQQYACKSISKKKLVTKADKDDMRREIQIMQHMSGQPNIVEFKGAYEDKTSVNLVMELCAGGELFDRIIAKGHYSEKAAATMLRQIVNVVHVCHFMGVMHRDLKPENFLLSSKDENSLLKATDFGLSVFIEEGKVYRDIVGSAYYVAPEVLRRRYGKEIDVWSAGVMLYILLSGVPPFWAETEKGIFDAILQGHIDFESKPWPSISNGAKDLVRKMLTQDPKKRITAAQVLEHPWLRDGEASDKPIDSAVLLRMKQFRVMNKLKKLALKVIAENLPDEEIQGLKQMFANMDTDGSGSITYEELREGLARLGSKLTETEVKALMEAADQDGSGSIDYYEFITATMHRYRLERDEHLYKAFQYFDKDNSGFITTDELETAMKEYGIADENCIAEILLEVDTDNDGRINYDEFSAMMRSGTQNPVTKLI

SEQ ID NO: 13534 - protein, 951 aa, Solanum tuberosum
MADFQRSSLADRDIDQAIAALKKGANLLKYGRRGKPKFCPFRLSNYAVAEDRKNALKSLFSQNLDIKDESAVVWYHDKEEKQLELCHVSRIIPGQRTAIFQQYPRPEKEYQSFSLICNDRSLDLICKDKDEAEVWITGLKAIITRGRSRKGKYDARSETVFSDSPHGQRVTTSTSSIDQGDNQRTESLPQSRLGKAYADIIQYTAAGKSPTLVETGSFNLSSLSAGAVDNSNARSSTADTFRVSLSSALSSSSQGSCLEDFDNLGDVFIWGEGTGNGLLGGGKHRIGKSSGTRIDANTPKSLESSVVLDVQNISCGNRHAMLVTKQGEAFSWGEEAGGRLGHGAETDVSHPKLIKNFKGMNVELIACGEYHSCAVTSSGDLYTWGDGAKSSGLLGHRSEASHWIPKKVCGLMEGLRVSHVSCGPWHTALITSAGRLFTFGDGTFGALGHGDRSGCITPREVETFNGLKTLKVACGVWHTAAVVELMSGLDSRPSDAPSGTLFTWGDGDKGKLGHGDNKPRLAPQCITALVDKSFSEVACSYAMTVALTTTGRVYTMGSNVYGQLGCPLANGMSPICVEDYLVDSTVEEISCGSHHVAVLTSRTEVYTWGKGENGQLGHGDCENKCTPTLVDILRDKQVKRIVCGSNFSAAICVHNWALSADNSICFGCRIPFNFRRKRHNCYNCGFVFCKACSSKKSLKASLAPSTSKPYRVCDDCYDKLQKAIESEPFSRVPKVKAGNALYKASEQTDKESGFPLLVGHTSRLSSSDSFNRAQGRISRVDQYENRASSFQNENPPRESFSLSKSPISAFRVSKSLFSASLPSTRVVPQSTSPLLGKASALWSAIPAPYPPVRTAEVVVDNLKPINDSLSQEVKQLKAQLEAMLLGLFKNANGLEELASKSQLLEAELGRKTKQLMDATAKAAVEAEKRRAAKHVIKSLTAQVRLSLYADV

SEQ ID NO: 13535 - protein, 366 aa, Magnaporthe grisea 70-15
MSSFNIVVFAGDHAGPEVVAEAVKVLKTVEEKSKTGVKFNLQDHLLGGASINAHGNPLTDEALAAAKSADAILLGAIGGPEWGPSSPVRPEQGLLKLRKELGTFGNLRPCSFASDSLVDFSPLKADVCRGTDFVVVRELTGGIYFGDRTEDDGSGYALDTEPYSRHEIERIARLGAQLALARSPPAKVWSLDKANVLATSRLWRKVVDEIFAKEFPQLELGHHLIDSAAMLMVKNPRALNGVVITSNLFGDIISDEASVIPGSLGLLPSASLGTIPDGQSRCNGIYEPIHGSAPDISGKGIVNPVGTILSVAMMLRYSLRMPAEADAVEAAVKAAIDGGIRTKDLGGNAGTKEMGEAIIAELNKLL

SEQ ID NO: 13536 - protein, 410 aa, Oryza sativa Indica Group
MNALAATSRNFRQAARLLGLDSKLQKSLLIPLREIKVECTIPKDDGTLATFVGFRVQHDNSRGPMKGGIRYHPEVDPDEVNALAQLMTWKTAVAAVPYGGAKGGIGCTPGELSRSELERLTRVFTQKIHDLIGINTDVPAPDMGTNAQTMAWILDEYSKFHGHSPAVVTGKPIDLGGSLGRDAATGRGVMYATEALLTEYSDHFRINLVIQGLGNVGSWAAKLIHQKGGKIVAVGDVTGAIRNKSGIDIPALLKHRSEGGSLEDFYGAEVMDAAELLVHECDVLVPCALGGVLNRENAAEVKARFIIEGANHPTDTEADEILAKKGVIVLPDIYANSGGVVVSYFEWVQNIQGFMWDEEKVNRELQKYMKNAFQNIKDMCKSQNCNLRMGAFTLGVNRVAKATLLRGWEA

SEQ ID NO: 13537 - protein, 559 aa, Mortierella alpina
DPMLQDSQGFNALHLATHSSNAMLVLYLLMAGEMPVDTADTLGHTSLMWAAYQGDSLSVQILLKHGARVDTKDREGFTPLHWAVVKGNRECLSKILMAGADIKAGDKSGKTPVDMIKELKGTMIWDKALSDAKLSSDGQTRRTPFDKLMVLFPWYIALPLAVAQFLFGHIGAIKFLLRTRTPNDMLQTPYYTAVFQSTAFWVGFVWLRYLLGNTSHLLWMNIAFFVGYTSALYFFYGAVMADPGWTKANSSYESQREAVVQMADRGLLDARHFCVSCIAQRPLRSKHCKFCNRCVAKFDHHCPWIYNCIGAKNHRAFLIFLALFLSSVPIYAYLSFEYLHVLSPSYVPVSSDPCLLGDTLCGYFQYDAFTTTLAFWSLFQMTWPGLLFLVQLYQVGQAKTTNEAMNFQRHSYLGKSMTIRQRILRSLTEIDSEMAGAGHPLQEESINLLEANGTATNDEDEVTLFAQEESKPVGFGDHEGHNHGARRAGGGGMWNLLVGTARRRRQQGEDRDVNPFDFGLWQNCVGFWSDGTQGPMRGVNWYSFYEAEARGGAATSRRM

SEQ ID NO: 13538 - protein, 207 aa, Brassica napus
MEIKVKPKALESELIATKVEDDMKKMKECVPIGQAADEEITKEQETMTTMEEGLRQNSDETKQDLSKSDSRSSSLEMIKKLENDRDSSQNAENTQKQEEKKKENNNMMKHKKASSHVWDCGSSLYDSFELNSFKRQLDSAISASSARTMSMSHLPDRRLPLLNSLSPESPLPPPPVTSCSSSRKQKHSNKISRSLQRFLKSVFRPKH

SEQ ID NO: 13539 - protein, 242 aa, Zea mays
MSPWLAPQGVVPQSDDGMVVARGTLNGQPAVVIAIEGTFQGGSMGEVSGAKMAAALELAAEDNRNGIPTQAVLCLETGGVRLQEANLGLAAIADIHAAIVDLRRYTPVIGIIAGTVGCFGGMSIAAALCSYLIVTREARLGLNGPQVIEQEAGIEEYDSRDRPFIWSMTGGEIRYASGLVDALVGDGVNAVKSAMNDCIAKGVPAQHRSDKYADFLPRLTQFDTRQQADTAQIKQLFAREDK

SEQ ID NO: 13540 - protein, 300 aa, Magnaporthe grisea 70-15
MEGQGRSRRGGRGGGGGGQSRDVSISRALSRLLRHQAANAGIQLDGEGYAPLDKVLAWGPIKSLKATLPEIREAVSSSDKQRFSMKPLSASTSPDSTDPADFLIRANQGHSIKLESAEHLTAVTVEAGNVPEVVVHGTYYAFWPAIVASGGLRPMGRNHVHCSTGLPSSEAQVVSGMRRDAELLVYLDVERALRDGEMKWWLSDNGVVLTEGGQGGLVPVKYFKEVVGRRPNEVGVLWKDGEKVADLPEGLKIKVPAGKERLGGGAGRGRGGGRGRGGRGGRGGRGDATGEGTEQSDAKS

SEQ ID NO: 13541 - protein, 686 aa, Arabidopsis thaliana
  misc_feature (155)..(155): Xaa can be any naturally occurring amino acid
METESDDATITVVKDMRVRLENRIRTQHDAHLDLLSSLQSIVPDIVPSLDLSLKLISSFTNRPFVATPPLPEPKVEKKHHPIVKLGTQLQQLHGHDSKSMLVDSNQRDAEADGSSGSPMALVRAMVAECLLQRVPFSPTDSSTVLRKLENDQNAXRPAEKAALRDLGGECGPILAVETALKSMAEENGSVELEEFEVSGKPRIMVLAIDRTRLLKELPESFQGNNESNRVVETPNSIENATVSGGGFGVSGSGNFPRPEMWGGDPNMGFRPMMNAPRGMQMMGMHHPMGIMGRPPPFPLPLPLPVPSNQKLRSEEEDLKDVEALLSKKSFKEKQQSRTGEELLDLIHRPTAKEAATAAKFKSKGGSQVKYYCRYLTKEDCRLQSGSHIACNKRHFRRLIASHTDVSLGDCSFLDTCRHMKTCKYVHYELDMADAMMAGPDKALKPLRADYCSEAELGEAQWINCDIRSFRMDILGTFGVVMADPPWDIHMELPYGTMADDEMRTLNVPSLQTDGLIFLWVTGRAMELGRECLELWGYKRVEEIIWVKTNQLQRIIRTGRTGHWLNHSKEHCLVGIKGNPEVNRNIDTDVIVAEVRETSRKPDEMYAMLERIMPRARKLELFARMHNAHAGWLSLGNQLNGVRLINEGLRARFKASYPEIDVQPPSPPRASAMETDNEPMAIDSITA

SEQ ID NO: 13542 - protein, 128 aa, Glycine max
  misc_feature (51)..(51): Xaa can be any naturally occurring amino acid
VCSMISSPAVTTVNRAGACMVAPFTALKSMVGFPWRKTTIDITFVAINGGXVQCMLVSPPIANKKFETLSYSPYLNDAQLLYEVKYHLKTGWIPCSQFDTDHGLGYHDHNRAPGYYYGLYWTMWKLPM

SEQ ID NO: 13543 - protein, 554 aa, Mycobacterium avium 104
MTSVHTLPDITATPAWDALRKHHDRIGDTHLRQFFEEDPDRGRELTVTVGDLYIDYSKHRVTRETLRLLVDLARTAKLEERRDQMFAGVHINTSEDRAVLHTALRLPRDAELIVDGRNVVADVHEVLDAMGEFTDRLRSGEWTGATGKRISTVVNIGIGGSDLGPVMVYQALRHYADAGISARFVSNVDPADLIATLADLDPATTLFIVASKTFSTLETLTNATAARRWITDALGDAAVAHHFVAVSTNKRLVDDFGINTDNMFGFWDWVGGRYSVDSAIGLSVMAVIGREAFADFLSGFHIVDRHFQTAPLESNAPVLLGLIGLWYSNFMGAQSRAVLPYSNDLARFAAYLQQLTMESNGKSTRADGSPVTTDTGEIFWGEPGTNGQHAFYQLLHQGTRLVPADFIGFSQPIDDLPTAEGSGSMHDLLMSNFFAQTQVLAFGKTAEEIAAEGTPADIVPHKVMPGNRPSTSILANRLTPSVLGQLIALYEHQVFTEGVIWGIDSFDQWGVELGKTQAKALLPVITADNSPAPQSDSSTDALVRRYRSERGRTS

SEQ ID NO: 13544 - protein, 420 aa, Rhizobium tropici
MVEKRFPAAGRDAMAYVLAGGRGSRLKELTDRRAKPAVYFGGKTRIIDFALSNALNSGIRRIGVATQYKAHSLIRHMQRGWNFFRPERNESFDILPASQRVSETQWYEGTADAVYQNIDIIEPYGPEYMVILAGDHIYKMDYEWMLQQHVDSGADVTIGCLEVPRMEAVGFGVMHVDDKDRIIDFVEKPADPPGIPGNPDFALASMGIYVFHTKFLIECLKRDAADPNSSRDFGKDIIPHIVKNGKAVAHRFTQSCVRSDFEREAYWRDVGTIDAYWQANIDLTAVVPELDIYDKSWPIWTYAEISPPAKFVHDDEDRRGSAVSSVVAGDCIISGASLYNSLLFTGVRANSYSKLEGAVVLPSVKVGRRAQLKNVVIDHGVTIPEGLVVGEDPELDAKRWRRTESGICLITQSMIDKLDL

SEQ ID NO: 13545 - protein, 502 aa, Arabidopsis thaliana
MAISLLCLFLITFVSLTIVGCKIKRSIWNLPPSPPKLPVIGNLHQVGELPHRSFRRLAERTGHVMLLHLGFVPVTVISSREAAEEVLRTHDLDCCSRPNLVGSRLISRGFKDLNFTPYGEEWKERRRFLVGELFCSKKLQSFIYIKEVECNFLVKKLSESAVDQSPVDLSKTLFWLAASILFRVAFGQSFHESEFTDTDKIDELVFETETAQGSFTCSDFFPIAGLGWLVDWISGQHKRLNDVFLKLDALLQHVIDDHSNPGRSKDHKDIVDVMLDVMHKQGKDDSLRLTIDHIKGLLTNIIIAGIDTGALTMIWTMTELARNPEIMKKVQGEIRDRLGNNRERITKEDLDKVPFLNLVIKETFRLHPVAPLLLPRETMAHVKVQGYDIPPKRRILVNAWAIGRDPKLWTDPEEFKPERFIDSPVDYRGQHFELLPFGSGRRICPGMAMGMATLELGLLNLLYFFDWKLPDGMSHKDIDTEEAGTLTVVKKVHLKLVPVRVP

SEQ ID NO: 13546 - protein, 346 aa, Rosa banksiae
QNWSNGEHSNELLHAQAHIWNHIFSFINSMSLKSAIQLGIPDIINKHGYPMTLSELTSALPIHPTKSHSVYRLMRTLVHSGFFAKKKLSTTDEEGYTLTDASQLLLKDHPLSLTPFLTAMLDPVLTKPWNYLSTWFQNDDPAPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADAVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13547 - protein, 346 aa, Rosa banksiae
QKWSNGEHSNELLHAQAHIWNHIFSFINSMSLKSAIQLGIPDIINKHGFPMTLSELTSALPIHPTKSHSVYRLMRILVHSGFFAKKKLSTTDEEGYTLTDASQLLLKDHPLSLTPFLTAMLDPVLTKPWNYLSTWFQNDDPTPFDTAHGMTSWDYGNHQPSIAHFFNDAMASDARLVTSVIIDDCKGVFEGLESLVDVGGGTGTVAKAIADAFSHIECTVLDLPHVVADLQGSKNLKYTGGDMFEAVPPADAVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13548 - protein, 266 aa, Agrobacterium tumefaciens str. C58
MARSALLNVMVQAAIKAGKSLSRDFGEVQNLQVSVKGPSDFVSQADLKAEKIVREELMKARPTYDFLGEEGGEEKGTDGAHRWIVDPLDGTTNFLHGIPHFAVSIALERNGEIVAGVIFNPATDELYTAERGGGAFLNDRRIRVAARKVLTDCVIGCGVPHLGRGNHGKFLVELRHVMGEAAGIRRMGAASLDLAYVAAGRFDGYWEADLSPWDVAAGLVLIREAGGFASDAKGGTDIFGTGSVAAGNEYIHKALVEVANRPIPGR

SEQ ID NO: 13549 - protein, 875 aa, Staphylococcus epidermidis RP62A
MTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICERYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEEALKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIISVDGSAGDLYLGAIETVNAEHSEEFDQFMTWSEEIARLQVRMNAETPQDIKAGYDFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGVTCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRQFNQWEIDYVSCSPFRVPGAILATAQSQAEESER

SEQ ID NO: 13550 - protein, 346 aa, Rosa beggeriana
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSRGAITSKDKKGKVIIIDMMMENQKGDEESIETQLFFDMLMMALVTGKERNEKEWAKLFTDAGFSDYKITPIL

SEQ ID NO: 13551 - protein, 446 aa, Tropheryma whipplei str. Twist
MYSCTGFSRRVCTWWKSVMCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 13552 - protein, 496 aa, Yarrowia lipolytica CLIB122
MSLFSKLTLANGLEVDQPTGLFINGEFVAAKSGKTFETINPTTEEVICSVSEADEEDVNAAVDAAAAAFKTWGFKTAPSARGAALFKLADLIERDLDIIAAIETTDNGKVYAHAKGDVALVVKVIRFYAGYADKIYGDVIHGNDGHFSYTRKEPIGVCGQIIPWNFPLVMWSWKIAPALATGNTVVLKSAESTPLSALYAAKLAQEAGIPAGVLNIVSGYGKVGALMTNHPKIRKVAFTGSTATGKQVLKGAALSNLKKISLELGGKSPNIIFDDANLPNAISWAALGIFFNSGEVCAAASRLYVQEGVYHEVVAALKQRAEALVVGDPFDQQTFQGAQTSKIQFDRVMSFIEAGKAEGATLLTGGCRAKDKGYFIRPTVFTDVKKDMKIVQEEIFGPVVVVTKFKTLEEVIELANDSEYGLAAGVHTQDISRAHYLAENLHAGTVWVNTYNSFHISLPFGGFNQSGFGKEMGKDGLDSYIQTKAVRIMFDQAKLQ

SEQ ID NO: 13553 - protein, 324 aa, Zea mays
MPGDAYDLLCAEDDAAGSALLCTTDDDDGCCSAVEEDSAAAAASIAELIGGEAQYSPRPDYPDRLRSRSIDPAARAESVAWILKVQEYYGFLPLTAYLAVNYMDRFLSLHRLPQEDGWAMQLLAVTCLSLAAKMEETLVPSLLDLQVEGTSRYDCFEPGTVGRMELLVLMALNWRLRSVTPFTFVDFFACKVDPGGRHTRCLIARATQVILAAMHDVEFLDHCPSSMAAAAVLCAIGETPSLESVSPGAAVSWCIGLAEEGISSCYRLMQRLVIGNVRTRVASTTTITMAAVNLCCSDEALSSHSSATSSPPPAKRRKRSPTAT

SEQ ID NO: 13554 - protein, 414 aa, Zea mays
MATGPVVHPQPVRGDPIDLKNAAAKNRRALGDIGNVDSLIGVEGGKLDRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLIDCSKLLAFIHSKAGESKLRGVLKKYSKLGRGAVALISPAKSLMSSAP

SEQ ID NO: 13555 - protein, 341 aa, Agrobacterium tumefaciens str. C58
MTERLEDIAIKMVADGKGLLAADESTGTIKKRFDSINLESTETARRDYREMLFRSDDAMKKYISGVILYEETLFQKAADGTPFVDIIKAAGSLPGIKVDIGAKPMAFHPHEFITEGLDGLYERLRKYHEAGARFAKWRGVITIGEQRPSWGSIKANSQSLARYAALCQQADIVPIVEPEVLMDGEPGTHDIDRCAEVTQWVLQTVFADLFDARVNLEGMILKPNMIIDGKNARKASVEEVAEKTVKVLKATVPTAVPGIAFLSGGQSSEEATAHLSAMNAGYDLPWSLTYSYGRALQDTALKTWGGKSENVAAGQRAFTHRAAMNSLAAKGNWKQELEKAA

SEQ ID NO: 13556 - protein, 395 aa, Microcystis aeruginosa PCC 7806
MSVNWTNSRAKRLSALPPYVFARLDELKALARKEGLDLIDLGMGNPDGPAPRPVIEAAIQAFETPQFHGYPPFEGTASFREAIAKWYDRSYGVELNPDNEALPLLGSKEGLSHLALAYVNPGDVVLVPSPAYPAHFRGPLIAGATLYPIILKAEQDWLIDIDSIPEDVAKQAKILYFNYPSNPTAAVAPLEFFEKIVAWAQHYEIMLVHDLCYAELSFDGYQPTSLLEIPGAKEISVEFHTLSKTYNMAGWRVGFVVGNSDIIQGLRTLKTNLDYGIFSVIQKAAETALQLPDEYVKQVQERYRQRRDFLIKGLGQLGWDIPPSKATMYLWVPCSVGMTSTDFALSVLQKTGVVVTPGNAFGEGGEGYVRVSLIADIPRLGEALQRLEDAGIRYQ

SEQ ID NO: 13557 - protein, 362 aa, Lotus japonicus
MKNPKRHPSESSLRRVTSEETVTGLKNAHRRRLKIRRMKYSCQAKINAGDGDFPPSGKERREIHESVQISLSLANSSSSSSSEEDRERKRDDGVLPYGSVSVVGSRKEMEDAVSVETGCVTKCDYFAVFDGHGGAQVAEACRERLYRLVAEEVERCGNGVEEVDWEEVMEGCFRNMDGEVAGNAALRTVGSTAVVAVVAAAEVVIANCGDCRAVLGRGGEAVDLSSDHKPDRPDELMRIEEAGGKVINWNGQRVLGVLATSRSIGDQYLRPYVISKPEVTVTKRSSKDEFLILASDGLWDVISSEMACQVVRKCLNGQIRRICNENQSRASEAATLLAEIALAKGSRDNTSVIVIELRGTVT

SEQ ID NO: 13558 - protein, 440 aa, Tropheryma whipplei str. Twist
MPEVTFLLTDPGEGLVEAEIVSLRVTEGDAVDVNQIVVEVETAKSLVELPSPFKGVVRKLLVAVGELVKVGSPIMLIDTDETPPAGLPKTGKMPVSDVRDGGHDTAKNTHPRDTGSSKDIHDAFGKEDGREIDFGRNVLVGYGPCEDNARVRGDDITGRPSLDETLERPVAKPSVRKFAKELGVDLYGVKPTGIGGTITRRDVLNATSTQEEATTRVPVKGLRRQTAQNVTLSAFSVPHVSVFVDVDVTRTIELVDRLKRDPLYEQVRISPLLILSRAVTWAVKRSPIVNSTWSEQEILLHKSVNLGIAVATDRGLVVPNIKNAQCLSMLDLAKAIESLVDDARSSRIRPEDTLNGTITITNIGVFGVDSGTPILNVGESSIVFIGAIKPRPWVVNGEISVRRVATIGGSFDHRVMDGDTASRFLVNVASILEEPALLVE

SEQ ID NO: 13559 - protein, 620 aa, Physcomitrella patens subsp. patens
MNSLKEMTLGVSAPFAAFDGLRVSAAGQQRATVRGVSLPGSLDVRAVATPVKPPTTMPPKRSKVEIIKQNSDFLRHPLKEDLTTDAPNVSEDAVQLIKFHGSYQQDNRELRGPGKKAYQFMLRTKNPSGIVPNRLYLVMDELADKYGIGTLRLTTRQTFQLHGVLKTDLKTVMSSIIHNLGSTLGACGDVNRNVLAPAAPFKTTEYMHATELSTKIASLLAPQAGAYYDIWVDGEKITQDEPEDVTLARNDNSHGTNFEDSPEPIYGIQFLPRKFKIAITVPGDNSVDVLTNDIGIVVVSDEHGEVEGYNLYVGGGMGRTHRNEATFPRLADQLGFVSKDDILYVVKAIVATQRDYGRRDDRRMSRMKYVVEEWGIDKFRTVVEQYFGKKIQPFKDIPEFKFQSYLGWHEQGDGHLFFGVHVENGRIKGEAKKVLREVIEKYSLNVRITPNQNMILCDVRPSWRPRITKALAAVGLVSPRYVDPLNVTAMACPALPLCPLAIAEAERGAPDILKRIRNLFEKVRLKSTESLVVRITGCPNGCARPYMAELGLVGDGPNSYQIYLGGSPNQTRLAESFMERVKLDKLESVLEPLFYMWKSQRQVGESFGDFSFRQVRPVHP

SEQ ID NO: 13560 - protein, 282 aa, Lotus japonicus
MTGREILHKMKEKVLGSSDPDSGKGKSKMSKNITHGYHLVKGRSDHAMEDYVVAQFKTVDNNELGLFAIFDGHSGHNVPDYLQSNLFDNILKEPDFWTKPVEAVKKAYVDTDSTILEKSGELGRGGSTAVTAILINCQKLVVANLGDSRAVLCKNGEAIPLSVDHEPATESEDIRNRGGFVSNFPGDVPRVDGQLAVSRAFGDKSLKKHLSSEPHVTVELIDDDAEFIILASDGLWKVMSNQEAVDAIRNVKDARSAAKNLTEEALKRNSSDDISCVVVRLQ

SEQ ID NO: 13561 - protein, 295 aa, Candidatus Protochlamydia amoebophila UWE25
MIGRNDICWCGSGQKWKKCHYPNESSPQRKSKESTREEYLRQHRIIIKDQKQIDGIRASCHLASRILEAACAKAKVGVTTQELNDYAHKLHDAAGAIPAPLNYGHPPFPKSICTSLNDVICHGIPNEIPLKEGDILNIDVTCILNGYYGDCSAMVMIGEVDTEKRLVVDVSYNCLMCAIEIIKPGIAISAIGEVIENYAHSKNCSVVYQFVGHGVGINFHEGPQISHHRNYNSILLVPGMTFTIEPMINAGSREAIIDPIDQWTARTKDGKASAQWEHTLLVTEDGHEILTNWKR

SEQ ID NO: 13562 - protein, 451 aa, Neisseria meningitidis Z2491
MSEYTPQTAKQGLPALAKSTIWMLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 13563 - protein, 537 aa, Candidatus Protochlamydia amoebophila UWE25
MEFRMSKTSPSHFFNYSASKKLQELAKHPLDLTKELTPERVTQYVAEAGGFKLLYGTERVTNDVLAALKQLSEESHALDKMNRMQDGEVMNFIERFPSENRPALHTATRDLFDYPRTAKKAQEAAQLAKAELEKLRQFLEKNDQNYHFTDLVTVAIGGSDLGPRAHYHALEHLLKPGHHVHFISNVDPDDVAGVFRKIPDLKRTLVAVVSKSGTTLETATNEELVREKFRQAGLDPKKHFVSITMPGTPMDNQEQYLKTFYMWDWIGGRYSTTSMCGALMLSFAFGINTFWEFLKGAHEMDRIALETNLNKNLPLLAALLGIWNRNFLDYPTVALIPYSQALLRYTAHIQQVDMESNGKHIDQQGIMTNFHTGPIIWGEPGTNSQHSFFQLIHQGTATVPVSIIAFKENLYGEDLEFQGTTSQEKLLSNLFAQSLALATGQISENPNKTFLGNRPTNILLAKKLTPYTLGALLSFFENKVAFQGFIWGINSFDQEGVQLGKVLANRLINEFANQRKKTKPSSFAIGEAYLKHLDHFS

SEQ ID NO: 13564 - protein, 112 aa, Oryza sativa
SFYTPRSNPDGVAVTAACVDPGTLVHSGGCHCGRVRWRAEAPASVVVWICNCSDCAMRGNAHFVVPASKFTLAAGAGESLTTYTFGTHTAKHTFCRVCGITSFYTPPPPSKT

SEQ ID NO: 13565 - protein, 558 aa, Neisseria meningitidis Z2491
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKITGQLSGGERGRLHLAKTLLGGGNVLLLDEPSNDLDVETLRALEDALLEFAGSVMVISHDRWFLDRIATHILACEGDSKWVFFDGNYQEYEADKKRRLGEEGTKPKRIKYKPVTR

SEQ ID NO: 13566 - protein, 500 aa, Arabidopsis thaliana
MAFPRFLSLLAVVTLSLFLTTTDASSRSLSTPPKTNVLDVVSSLQQTQTILSLDPTRSSLTTTKPESLSDPVFFNSSSPLSLELHSRDTFVASQHKDYKSLTLSRLERDSSRVAGIVAKIRFAVEGVDRSDLKPVYNEDTRYQTEDLTTPVVSGASQGSGEYFSRIGVGTPAKDMYLVLDTGSDVNWIQCEPCADCYQQSDPVFNPTSSSTYKSLTCSAPQCSLLETSACRSNKCLYQVSYGDGSFTVGELATDTVTFGNSGKINNVALGCGHDNEGLFTGAAGLLGLGGGVLSITNQMKATSFSYCLVDRDSGKSSSLDFNSVQLGGGDATAPLLRNKKIDTFYYVGLSGFSVGGEKVVLPDAIFDVDASGSGGVILDCGTAVTRLQTQAYNSLRDAFLKLTVNLKKGSSSISLFDTCYDFSSLSTVKVPTVAFHFTGGKSLDLPAKNYLIPVDDSGTFCFAFAPTSSSLSIIGNVQQQGTRITYDLSKNVIGLSGNKC

SEQ ID NO: 13567 - protein, 453 aa, Arabidopsis thaliana
MASLMLSLGSTSLLPREINKDNVKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 13568 - protein, 223 aa, Oryza sativa Japonica Group
MAAAAVDPMALGLGTSGGGGGGESAVGGDGAEPVDLVEHPSGIVPTLQNIVSTVNLDCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQR

SEQ ID NO: 13569 - protein, 457 aa, Leuconostoc mesenteroides subsp. mesenteroides ATCC 8293
MSDSKGDSNLPKRGLQNRHVQLIAIGGTIGTGLFMGAGNSIHFAGPSILLVYLVIGMFMFVVMRAIGELLYADPSQHTFISFITKFLGNRAGFFARWSYWLTVVFMGMAELTAVAKYIQFWLPDLPSWLIQIVMLILLTSINLIAVALYGETEFWFAMIKIVAILSLIVTGIIMALTGFETPVGKVAFSNVWHHFELFPNGVGNFINAFQMVMFAFVGMEFIGMTTAETENPRSVLPKAINQIPWRILFFYLGALFIIMTIYPWQKIPEDQSPFVMVFQLAGVKWAAALINFVVLTSAASALNSVLFSASRNFFALSFQSKAKFLQPFRKTSKTQLPVNAVLVTSLMVAFSALISVIPSITNAFSFVTSASTDLFLMIYVLILFAYMKYRKSDSYMPDGFLVIAPKTLVPLAILFFSFVFITLFFNPESRLPAIGATIWMVVFGCISMKQPKQALNK

SEQ ID NO: 13570 - protein, 439 aa, Schizosaccharomyces pombe 972h-
MSTTSSHSNVVGVHYRVGKKIGEGSFGMLFQGVNLINNQPIALKFESRKSEVPQLRDEYLTYKLLMGLPGIPSVYYYGQEGMYNLLVMDLLGPSLEDLFDYCGRRFSPKTVAMIAKQMITRIQSVHERHFIYRDIKPDNFLIGFPGSKTENVIYAVDFGMAKQYRDPKTHVHRPYNEHKSLSGTARYMSINTHLGREQSRRDDLESMGHVFMYFLRGSLPWQGLKAATNKQKYEKIGEKKQVTPLKELCEGYPKEFLQYMIYARNLGYEEAPDYDYLRSLFDSLLLRINETDDGKYDWTLLNNGKGWQYSAAKQHVVQRRHTQGTNNRRQSTIPPYARTRQNLLSSPSKQTPVNNVVDASVATQKDGIPGKAASPQVQQQQQTSSAQQQQPQRVEQPAPQTTQPTQVDTQQAAKPAPSKEKSRKKFHLRLLSCCISKQE

SEQ ID NO: 13571 - protein, 766 aa, Zea mays
  misc_feature (481)..(481): Xaa can be any naturally occurring amino acid
MAAAAILPELATQVLIPVAAAVGIAFAVVQLVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLCAVTSLVSGFLGMKIATYANSRTTLEARKGVGKAFITAFRAGAVMGFLLSASGLLVLYIAINLFGIYYGDDWEGLFEAITGYGLGGSSMALFGRLGGGIYTKAADVGADLVGKVERNIPEDDPRNPAVIADNVGDNVGDIAGMGSDLFGSYAESSCAALVVASISSFGINHEFTPMVYPLLLSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYXVAVAALGMLSTIATGLAIDAYGPISDNAGGIAEMAGMSHRIRERTDALDAAGNTTAAIGKGFAIGSAALVSLRLFGAFVSRAAISTVDVLTPEVFIGLIVGAMLPYWFSAMTMKSMGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 13572 - protein, 358 aa, Glycine max
VEKFFGQYAKVNSVRLPHHVGDKKLFCGTALVEFSSEEEVEKVMKEKMVYAGAELELKPKKDFDAEREKELEDYKKSRPPVGSNHQNSSNVEEDYPKGLIIAFKLKSISEEIPSEQNGVDQQAKDNSVVSKTDENPRSEITSGENDQKVTENVGVDEEKNEMKEAKETVNEEDNEMKEAEETESEDNTDMKEAKGTESEDNNGMKEGKVTKDEEKKQQAGEKFSAAAYKDNMDVVSREDLKSVFEKFGTVKYIDFKIGAESGYIRFEETEAAQKARAAAVISEKDGLVVKNYIAILDPVTGEAEKEYWSLLRGNQGKHREFKNKQGRGGWHGRGGKHARSRDNGSRDRRNKAQKVGGA

SEQ ID NO: 13573 - protein, 280 aa, Leuconostoc mesenteroides subsp. mesenteroides ATCC 8293
MDLGNDFVTRLGLEKPHDLEKVRGGDINEAFSIYSNNQRYFLKIQQNAQASFFDHEVAGLKALGEEVTVPAVLAQGQLQGHAYLVLTWINQGNGSQQELAKSLVKMHQATAPKFGFDSDNLVDFVPKNNTWQSSWAEFFVKQRLDPLMAQAQKNNFWLTQRGDHYSNLRETILNDNHAQTVQPSLLHGDFWAGNFMFNDQGKPVFIDPNVFYGDREYDLAISRVFAGFSPSFYNQYMQEWPLDDGWQKREKWYEFYYILMHFTRFGDIYAPRMNKLLTSF

SEQ ID NO: 13574 - protein, 92 aa, Arabidopsis thaliana
MASSMLSSATMVASPAQATMVAPFNGLKSSAAFPATRTANNDITSITINSGRVHCMHVWPPIGKKKFETLTHHPDLTDSDLAIEVNYIIRIN

SEQ ID NO: 13575 - protein, 993 aa, Methanococcus maripaludis S2
MIIKNIKMENFRSHRNTSINFSKGITSIIGQNGSGKSSIFQAMNFALFAPRGNNFRIENLMQQGAASFSVELEFEMMGNTYLVKRKRFQHKTDDKLYVNGKLNAESASEINKKIEEILEIDNSVFSNAIYIKQGEIANLIQMTPRDRKEVIGKLLGIEKYEKASEKMNIVKKSYEETLLKLEGELTQEPEILENLEKLKNEVSESEILKEEILKKYENLEKLKLEKNSEILQMEEKFAENNQLKENLKDIISEIKNINLEIQNFKNSLNLVAEESKNISENEENYKKYLELELKIKELNNKLIGHKSNYESYNKLKTIEESLLKELGVLKESLKDNKKNPDELKENLKENDEKILILDKIKEKIKELEFIEKQIYEIKIHKKTVETLFDSVKIYDDSIKTFEELKTKKNSYENLLKEKFDLEKKLQNETDEKTKLISELTDFEKIEEKINLENELKEKYEDLSEKIDKLNEIVLKKESKISEYKNSKAELEKTKDSCHVCQSKITEEKKQELLEKYNSEIQNEQLSTESLKKQLEIILNKKEKMKVKLNEIDSFKLKYGELKEKKNYSLKVEESIIETTEKLNELTGKINEYSSLNDEISLIENKLKNLENDYKNCNYSSQFLTKNDESEFLTKKLELSKIIGDYDSSKIENEKKSLENLKDELKNTIYNLEREINLKKELKNIQNDISSKIGIVECYVKWETEKSDFENKLSECKENYEKYMESLAVLKNYSKTYSVEINNLNEFLNQKIAEKQQFCEKLLETRTEIEKNIQTVNYNPELHENAKRLYENILNEFNDILRTLERISSELKLKNENISYLNEKIQNLSNKKEEKKKIEEFKEYLDKIKREIFSKDGFQKYLREKYIPLIQRHTNQIFQEFELPYSHIQLKDDYSLIVDGLPVETLSGGEQIAVSLALRLGISKAVCNNIECIILDEPTAYLDEDRRKNLLNIFKNIKTINQMAIITHHQELEQIADNIVKVRKIGENSKVSLE

SEQ ID NO: 13576 - protein, 346 aa, Rosa beggeriana
QKWSNGEHSNELLHAQAHIWNHIFSFINSMSLKSAIQLGIPDIINKHGYPMTLSELTSALLIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCNGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13577 - protein, 131 aa, Methanococcus maripaludis S2
MYRVIPDTNFLIYAFKQGINFEYELNSAIDSGYKICIMDCVLKELEKLKLEFKGKEKLSANIALKYAKNFEIIEYSNGKYADEMIINYSKENKDVIICTNDKKLKKDLIDIGTPIILVKQHNHFELQGYLK

SEQ ID NO: 13578 - protein, 152 aa, Nicotiana tabacum
MSTPARKRLMRDFKRLQQDPPAGISGAPYDNNIMLWNAVIFGPDDTPWDGGTFKLTLQFSEDYPNKPPTVRFISRMFHPNIYADGSICLDILQNQWSPIYDVAAILTSIQSLLCDPNPNSPANSEAARMFSENKREYNRKVREIVEQSWTAD

SEQ ID NO: 13579 - protein, 346 aa, Rosa beggeriana
QKWSNGEHSNELLHAQAHIWNHIFSFINSMSLKSAIQLGIPDIINKHGYPMTLSELTSALLIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13580 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGREFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 13581 - protein, 152 aa, Nicotiana tabacum
MSTPARKRLVRDFKRLQQDPPAGISGAPYDNNIMLWNAVIFGPDDTPWDGGTFKLTLQFSEDYPNKPPTVRFISRMFHPNIYADGSICLDILQNQWSPIYDVAAILTSIQSLLCDPNPNSPANSEAARMFSENKREYNRKVREIVEQSWTAD

SEQ ID NO: 13582 - protein, 346 aa, Rosa beggeriana
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSRDKKGKVIIIDMMMENQKGDEESIETQLFFDMLMMALVTGKERNEKEWAKLFTDAGFSDYKITPIL

SEQ ID NO: 13583 - protein, 307 aa, Staphylococcus epidermidis RP62A
MNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSVDAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNLESAIRLANQASSLTVQRKGAQASIPTRKEVEAEYN

SEQ ID NO: 13584 - protein, 582 aa, Frankia sp. CcI3
MTTGQAEDPRPHCPAPIRTAPSRWPRPLGRLELGRLLPGRADIESMRRQPGRDLLAGMTVAVVALPLALGFGVSSGLGAAAGLVTAIVAGALAAVFGGSNLQVSGPTGAMTVVLVPIVHRHGPAGVLTVGLLAGMILLALAVLRVGRSVRYVPAPVVEGFTVGIAAVIFLQQVPSALGVHARNGDRVTGVAWAAVADFVHRPHWLALALAVGVAATMLVGARLRPTVPFSLLAVALATALVTAREWDVTTLGAIPATLPGPSLGFLDITAIPTLATAAVAVAALAALESLLSASVADGMTVGQNHDPDRELFGQGLANLAVPLFGGVPATGAIARTAVNVRSGASSRLAALAHAVVLAGVMLAAAPLVARIPLAALAGVLLATAVRMVEVSSLRTLGRASHSDALVMALTAGATLALDLVIAVVLGLAVAGALALRAIARTARVEEVPLDPGDHHDSEHALLAEHIVAYRIDGPLFFAAAHRFLLELTEVADVEILILRLSRVSAVDGTGALVLRDVIDRLEHRGVKVYVSGLRPEHAKAVAAVGLVDRLRGQGRLFDSTPSAIQAARDHLHHTGALAAVPT

SEQ ID NO: 13585 - protein, 346 aa, Rosa bracteata
HKWSNGEHSNEPLHAQAHIWNHIFSFINSMSLKSAIQLGIPDIINKHGYPMTLSELTSALPIHPTKSHSVYRLMRILVHSGFFAKKKLSTTDEEGYTLTDASQLLLKDHPLSITPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAAPPADAVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13586 - protein, 336 aa, Agrobacterium tumefaciens str. C58
MTVKVAINGFGRIGRNVLRAIVESGRTDIEVVAINDLGPVETNAHLLRYDSIHGKFPADVKVEGDTIIVGGGKPIKVTAVRDPATLPHKELGVDIALECTGIFTARDKAAAHLTAGAKRVIVSAPADGADLTVVFGVNDDQLTKDHLVISNASCTTNCLVPVVKVLDDVIGIDHGFMTTIHSYTGDQPTLDTMHKDLYRARAAALSMIPTSTGAAKAVGLVLPHLKGKLDGTSIRVPTPNVSVVDFKFIAKRDTTVEEVNEAIKSASNGKLKGILGYTEEPLVSRDFNHDSHSSIFAIDQTKVMEGNFVRVLSWYDNEWGFSNRMSDTAVAFAKTI

SEQ ID NO: 13587 - protein, 922 aa, Astragalus sinicus
MELQHIWMLRLVVACALFLCIFFRSTSAVEGFESIACCADSNYTDPRTTLNYTTDYIWFSDKQSCKQIPEIVLSQRSNENVRLFHINEGKRCYNLPTIEDKVYLIRGTFPFDSFDSSFYVSIGVTQLGEVRSSRLQDLEIEGVFKATKDYIDFCLVKGEVNPFISQIELRSLPEEYLHDLPASVLKLISRNNLGDKKDDIRFPVDQSDRIWKATSNLSSALPLSFNVSNVDLRGNLTPPLQVLQTALTHPERLQFIHDGLDTEDYEYSIFLYFLELNSTIIAGQRVFDIYLNNEVKKERFDVLAGGSKYSYTILNISANGSLNITLVKASQSKFGPPLNAYEILQIRPWIEETNHIDVKVIQKLRKELLQNPENKALESWTGDPCILFPWKGIKCDGSNGSSVINKLDLSSSNITGPIPSSVTEMTNLEILNLSHNSFVGHIPSFLRSSLLISVDVSYNDLTGPLPESIISLPHLKSLYFGCNHHMSEEDPAKLNSSRINTDYGKCKVKEHKHGQVFVIGAITGGSLLITLAVGILFFCRYRYKLIPWEGFGGKNYPMETNIIFSLPSKDDFFVKSVSIEAFTLEYLEVVTEKYRTLIGEGGFGSVYRGTLDDSQEVPVKVRSATSTQGTREFDNELNLLSAIQHENLVPLLGYCKEKDQQILVYPFMSNGSLLDRLYGDAAKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLTGNWGVAGEPLNIKRPRTEWSLVEWAKPYIRASKVEEIVDPGIKGGYHAEAMWRVVEVALQCLEPYSTYRPCMVDIVRELEDALIIENNASEYMKSIDSLGGSNRYSIVLDKRVLPATTSTAESTITTQALSHPQPR

SEQ ID NO: 13588 - protein, 515 aa, Vibrio sp. Ex25
MMESQPEKKVNQTGADYLRQILRAPVYEVATVTPLQEMPRLSARIGNNVQIKREDRQPVHSFKLRGAYNMVASLSEAQKAAGVIAASAGNHAQGMALSGTKLGIKTTIVMPKTTPDIKVDAVRSFGGNVVLHGSNFDEAKAEAERLSEQYGYTFVPPFDHPLVIAGQGTIGMEMLQQNGHLDYIFVPVGGGGLAAGIAVLVKQLMPEIKVIAVEPEDSSCLKAALDAGEPVVLDQVSMFADGVAVKRIGEETFRLCQKYIDGHIAVSSDEICAAVKDIFEDTRAIAEPSGALALAGLKKFAEQNKLKDKNLGTVLSGANTNFHGLRYVSERCELGEKREGLLAVTIPERQGAFFEFCNLIGGRAVTEFNYRYNDDELANIFVGVRLQGGQEELENIIHDLREGGYPVVDLSDDEMAKLHVRYMIGGKPSKQLKERLYSFEFPEYPGALLKFLSTLGTHWNISLFNYRNHGADYGRVLCGFELDEGDLAQFSAHLRELGYQCKDETDNPSYKFFLS

SEQ ID NO: 13589 - protein, 346 aa, Rosa bracteata
HKWSNGEHSNELLHAQAHIWNHIFSFINSMSLKSAIQLGIPDIINKHGYPMTLSELTSALPIHPTKSHSVYRLMRILVHSGFFAKKKLSTTDEEGYTLTDASQLLLKDHPLSITPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADAVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13590 - protein, 402 aa, Porphyromonas gingivalis
MKKACFMGLGYIGLPTAIVTAKSGIEVLGVDINTNIVAKTNSGQLHFVEAGMEELLQEVIQKETFRASTTPEDSDVYLVVVPTPFKANHEPDITCVEAATRSILPLLKKGDLFIIESTSPIGTTEQMADLIYRERPELKDQLYIAYCPERILPGNVIYELEHNDRVIGGLTAEATERAKEFYAHFVKGTLHGTNARTAELCKLTENASRDVQIAFANELSFICDKAGINVWELIELANKHPRVNILQPGSGVGGHCIAVDPYFISSAFPLESKLIAGAREINNYKAFWCAEKISRAIQDFGVKYGRMPVVAMMGLAFKPDIDDLRESPAKYIATRVMQGLNNAEILIVEPNISKHNTFKLTDYRDAYEQADIVAFLTAHTPFKFLEYRTDKVILDFCGVFKK

SEQ ID NO: 13591 - protein, 505 aa, Silicibacter pomeroyi DSS-3
MNAPKPVVLCILDGWGLSDDKTANAPYLAKTPTFDAIMTKGPHARLITHGPDVGLPSGQMGNSEVGHTNIGAGRVVAMDLGQIDLAIEDGSFFDNAALRDFIARTRAAGGTAHLMGLVSDGGVHGHLNHIIAAAQAITNAGVPVVMHAITDGRDVAPKSAYGFMAELEDRLPKGARIVTVTGRYFALDRDNRWERVQEAYDAMVRGEGRRVSTAHSAIDYAYNQSESDEFITASVLTGYDGMRDGDSLFCLNFRADRAREILRAIGEPGFADFDTGARPALSALLGMVEYSDAHNAYMTTVFPKRDIVNTLGAWVARHGLRQFRLAETEKYPHVTFFLNGGKEEAEPGEDRFMPKSPKVATYDMQPEMSAPEVTDKFVEAIGAGYDLIVTNYANPDMVGHTGDLKAAIKACEAVDQGLSRVIAALEQAGGAMIVTADHGNCEMMIDPETGGPHTAHTLNPVPVALVGGPAGVTLRDGRLSDLAPTVLALMGLPKPPEMTGESLIT

SEQ ID NO: 13592 - protein, 488 aa, Aspergillus oryzae
MTISKQIRRVAVIGAGPSGLSAVKYLLAEKAFTKIDVFEKRSAVGGVWNYTPPALKQSTLVPVPQLDPNEPGDEPIWHPTADIQGPLEPAFISPIYSTLDTNIPKELMAYGDKPFPPDAQVLPKYSTVKEYLDEYAENVQDYIHLDTQVVNIKSGDSGADAWAVTTKNLRTGVGRTDTYDAVVVASGHYDVPYTPDIPGIKIWNETYPGIISHAKLYDSPEPFRGKKVIIVGGSASGIDIGSQINRLSQGEVLASQRTESYLMPSNATDKDYVPEIVEFLPPTEYKRAVRFADGRIENDIDAIVFCTGYLYSFPFLSSLDPPVITDGRRVLNTYQHLFYIHNPTLVFPVLPQRVIPLPLSENQAAVFARVWSGRLTLPDAAEMKAWEDDTVIKKGNGTAFHLLHFPLDADYMNLLYKWAGSAEPRQGLPDNGNGKQGNYWGERERWMRQLFPEIRRTFIGKGDERHKFKSIEQLGYDFEKFRKEQAHL

SEQ ID NO: 13593 - protein, 610 aa, Zea mays
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIAMATGDKKDCLCFIEVIVHKDDTSKELLEWGSRVSAANSRPPNPQ

SEQ ID NO: 13594 - protein, 175 aa, Hordeum vulgare subsp. vulgare
  misc_feature (88)..(88): Xaa can be any naturally occurring amino acid
MAAAGDAGEKKMITLKSSDGEEFEVEEAVAMESQTIRHMIEDDCADNGIPLPNVNSKILSKVIEYCNKHVQAKPADAGASSDTASAAXGAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 13595 - protein, 592 aa, Aspergillus oryzae
MAPLKTLVALLSANVLTSVLAELVKFEVDLTWAKGSPDGNLRDMIFVNDQFPAPQLTLNQYDDVEFTVNNHMPFNATVHFHGIVQLNTPWSDGVPGLTQKPILPGGTFTYRWTATEYGTYWYHAHARSLMADGLYGAIWINPAPEIPQPFHLISDDEKDIEAMQKAESDPKLVILSDWSHYTSEEYQKIMEESGSISCVDSILINGRGRVHCPGADFINSLQTDYLKASIDNLPLTDKGCYPKIYKTQGSFPRNDSKVPPGLESGCVATAGTHEIIEVDPEDGWVSMKFISAAWLKAVIASIDEHPMWIYEVDGHYIEPQLAHTMVMYNGERYSAMIKLDKTPKDYTIRIPDTNADQIIAGFATMRYKGSDQTGESEPYVDYGGLNTTADVIALNESILVPYPSIQLPTAADQLINLTFGRRESAYQWTLEGKQLYDVMANYDDPILYNLTAKENLGDKVTVQTQNGTWVDVLLQVGIMPNTPPIQAPHIIHKHSNKAFIVGEGDGFFNWTSVAEAATERPELFEFERPRLRDTFMVLGLLGPRWMVIRYQVVNPGPFLIHCHIETHLANGMGVALLDGVDEWPEVPPEYAL

SEQ ID NO: 13596 - protein, 276 aa, Dehalococcoides ethenogenes 195
MIKISIQGARGSFHDIVARHKFPGDSEIIESDTSHQVFEDVKKGLADYGVVAIENSLYGSFLDNYDNLLKYESKIVGETYLHVILNLIALPGVKMEQIHEVYTHPIAMIQAESFLEKHPSVIRIEGYDTAGSVRMIKEKNLTTAAAISSNLSAQLYDMKILAKDIETEKQNYTRFLIIAKEPKYPPQANKTSLAIKAENNAGSLYKCLKCFYDQGINLSKIESRPVMGRTWGYYFYLDFERGLNTPETQRALKELAKVTETIHVLGSYEQGSVFEE

SEQ ID NO: 13597 - protein, 401 aa, Aspergillus oryzae
MSFSLPETFAKLPRYPLLYPYPSPIHPLPALTRHLNHNPRSAPAVSLFAKREDHSSPLACAGNKYRKLEYIVPDILSNSSLHGPGERSEAKATTTLVTEGAIQSNHTVQVASVARRLGLEAIVILHKATGGGLTASSDKDVFLRTGNVQIARLLGAEVRMLEDSSTVDNSDPITPILEGLRAQGKVPYWIPSGASLHPLGGLGYARCAFEIAAQEKEQLGENGRFDYVFVACGSGSTVGGLIAGFKLLQKIEAQRQDENAERVIGRKVIGILNSPTKPREYHEGRVLNFARRAAYLIGLDPERDVTPEDVQLDDRFAGTAYGELDQTSKKTLAFLAQEEGVIVDPVYTVKVMRGVMHWVQVGELIRDWSRRLESSPSEGRVNALFIHTGGQSALSAYADIE

SEQ ID NO: 13598 - protein, 456 aa, Bordetella petrii
MQQDYEFDLFVIGAGSGGVRAARMAAQRNARVGLAEVGALGGTCVNVGCIPKKLYSYAAHYGDAFKESHGFGWDAAPPLLDWQRLKSRRAAEILRLNGIYQGLLEGAGVRIVRGRASLYDDHTVQVETEQGGRMFTARHILIATGGTPSVPTLPGSEHAVTSDAMFDLDRFPQRLVVVGGGYIACEFASIFNGMGAQVTQLCRGTQLLRGFDDDIREFIADEMGKSGVDVRLGVHVASIAKSAGDFEVELADGSDLSADTVLYATGRVPNVSGLGLEAVGIVLRDNGAIVVDADYRTSVPSVYALGDVTGRVQLTPVALGEAMAFADQLFGQGRRKMNYDHIPTVVFTHPNIGTVGYGEAQAREMFGEVTVYRSEFRPLKHTLSGRPERAMVKLVVDASDRVVGLHMVGPDAGEIVQGFAVAMKAGATKSVFDSTVGVHPTLAEEFVTMREAVTTP

SEQ ID NO: 13599 - protein, 233 aa, Glycine max
MESGGNGKRAHEEAGPSSGIDGRKLEMTEKASDDDKEEEEEEEEEEEGAIEDSKNGFFVPGPLLSLKEQIERDKEDESLRRWKEKLLGCLESDIDGQLDPKVKFHSIGILSEDFGEIVTPLPVDENRNGCTLFTLREGSRYQLKLKFSVLHNIVSGLTYSNTVWKGGLQVDQSKGMLGAFAPQKEPYVYALKEDTTPSGALARGVYSAKLKFEDDDRRCHMELKYLFEIKKRS

SEQ ID NO: 13600 - protein, 382 aa, Coccidioides immitis RS
MSAQAPHPTLLIPGPIEFDDAVLQSMSHFAESHVGPAFVKTFGESLTLVRKLFQSTSPTAQPFILAGSGTLGWDLVASNLIEAGQEALVLHSGYFADSFAACLETYGAKATQLKAPIGDRPSLSDIEQALKLADYKVITITHVDTSTGVLSDIKAVAELVRRVSPNTLVVVDGVCSVGCEEIAFDEWDIDVVLTASQKAIGCPPGLSIVMCSGRAMERFKTRQSPPASYYASMVNWLPVMQNYEAGKPSYFATPATQLVRALHTSLVQIASKPLSERFAAHRAASQRVKSAVAELGLHQLATKPENQANAMTAIRLPEGLTPADILPILGKKGVVFAGGLHKEIASKYIRFGHMGVSVTDPARDDIDKAIQALKEAFVEVTK

SEQ ID NO: 13601 - protein, 197 aa, Buchnera aphidicola str. APS (Acyrthosiphon pisum)
MVLVTQNAPNFIAPAILKNNQIVEQFDLKKYSNGQSTVLFFWPMDFTFVCPSEIIEFNKLHSEFKKRNVKIVGVSIDSVYVHQAWQNTLPKNGGIGKINFPMVSDVKHDIQKSYGIQHPNLGIALRASFLIDSNWIIRHQVVNDLPFGRNITDMIRMVDALDFHNKFGEVCPANWKKGEEGITASSEGVSQYLSKYS

SEQ ID NO: 13602 - protein, 276 aa, Xanthomonas axonopodis pv. citri str. 306
MKAQWRERFAGIDRLYGVGTVERLSACRVAVVGMGGVGSWVVEALARTGVGHIRLIDADDVCVSNTNRQLPALAGQYGRNKARAMAERCVAINPDIEADAVEAFLTSGNIETLLGQGLDLVIDACDSFRVKVETIAWCRRRKLPLLTVGAAGGRTDPTLVRVRDVSRTEHDAMLALTRKKLRSEFNFPKNPQRYFGVPAVYSLENVKYPQADGSVCGIRPQLDADATLKLDCGAGLGAATHITGTFAFVAVGKALDMLLKPKAAVAMPAAEAVAAS

SEQ ID NO: 13603 - protein, 88 aa, Zea mays
STSVTPPASSMMPTAPPLHPTSTAAQHPSYGTPLLQPFPAPSPPPSLTPAHNDGLVISRDKVKDTLQRLVQNDEFIDLIYRELQSVHM

SEQ ID NO: 13604 - protein, 125 aa, Glycine max
  misc_feature (13)..(13): Xaa can be any naturally occurring amino acid
  misc_feature (95)..(95): Xaa can be any naturally occurring amino acid
  misc_feature (110)..(110): Xaa can be any naturally occurring amino acid
QGKSGGAAGGVAXTPANRGRPFGSGNNSASAAASAADSAAPSNLLGPSLHVHNSFADQNNKRIVLALQSGLKSELTWALNILTLSPLKKRMHAQXATPLQNSGLLDALFXVIDDWRDISKGITTP

SEQ ID NO: 13605 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 13606 - protein, 436 aa, Rhodobacter sphaeroides 2.4.1
MSGEFDGLLAEIAAISLSRRYGRVTGIGRGTLSVGGLEQGTALGDRVEICGAGGILGGEVLRLSSHEVTILPDGSPEGLAIGDAVALVGPAEIAPDDSWIGRIVDPLGRPLDGRPLFRGPRARPLRAAAPQAAARRSLGPRLPTGVAVFDTLLPLVQGQRIGLFAGSGVGKSSLLAKFARSVVADVVVIGLVGERGRELREFTERVLGPAGMARAVVVTATSDQSPLVRRRCGWAAMAVAEHFRDQGLHVLLLVDSITRFAEAHREVALAGGEAASMRGFPPSTAHTIMALAERAGPGAEGTGDITAVFSVLVAGSDMEEPVADILRGVLDGHVVMDRKIAERGRFPAIDLLRSVSRALPEAASTAENALIAEARRLLGAWDRAEMMIQAGLYARGSDPLVDAAIRVWPALDAFLAEDASDGIDASFRRLADCLGL

SEQ ID NO: 13607 - protein, 346 aa, Rosa canina
QKWSNGEHSNELLHAQAHIWNHIFSFINSMSLKSAIQLGIPDIINKHGYPMTLSELTSALLIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHLFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13608 - protein, 346 aa, Rosa canina
QKWSNGEHSNELLHAQAHIWNHIFSFINSMSLKSAIQLGIPDIINKHGYPMTLSELTSALLIHPTKSHSVYRLMRILVHSGFFAKKKLSKTDEEGYTLTDASQLLLKDHPSSLTPFLTAMLDPVLTKPWNYLSTWFQNDDPTPFDTAHGMTFWDYGNHQPSIAHLFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREATTSKAKNGKVIIIDMMMENQKGDEESIETQLFFDMLMMALVTGKERNEKEWAKLFTDAGFSDYKITPIL

SEQ ID NO: 13609 - protein, 250 aa, Rhodobacter sphaeroides 2.4.1
MSDETSNTTHFGFRTVPEGEKAGMVHGVFTRVASKYDIMNDLMSGGVHRLWKDAMMDWLAPRPGQKLLDVAGGTGDISFRFLKRAPGAEATVCDMTESMLVEGRQRADAAQMADRLDWVVGDAMALPFASNTFDVYTISFGIRNVTRVQDALNEAYRVLKPGGRLMVLEFSQLPNPMMQWAYDRYSFNVIPVMGQIVANDRDSYQYLVESIRKFPDQETFADMIRKAGFGLVKYRNLSLGIAALHSGWKI

SEQ ID NO: 13610 - protein, 496 aa, Staphylococcus epidermidis RP62A
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNGGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGIGRELGKEGLEEYLVSKHILTNTNPEPVDWFSK

SEQ ID NO: 13611 - protein, 346 aa, Rosa canina
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNCLSTWFQNDDPTPFDTAHGMTFWDYGNHQPRIAHFFNDAMASDARLVTSVIIDDCKGVFEGLESLVDVGGGTGTVAKAIADAFPHIECTVLDLPHVVADLQGSKNLKYTGGDMFETVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 13612 - protein, 502 aa, Hyoscyamus muticus
MQFFSLVSIFLFLSFLFLLRKWKNSNSQSKKLPPGPWKLPLLGSMLHMVGGLPHHVLRDLAKKYGPLMHLQLGEVSAVVVTSPDMAKEVLKTHDIAFASRPKLLAPEIVCYNRSDIAFCPYGDYWRQMRKICVLEVLSAKNVRSFSSIRRDEVLRLVNFVRSSTSEPVNFTERLFLFTSSMTCRSAFGKVFKEQETFIQLIKEVIGLAGGFDVADIFPSLKFLHVLTGMEGKIMKAHHKVDAIVEDVINEHKKNLAMGKTNGALGGEDLIDVLLRLMNDGGLQFPITNDNIKAIIFDMFAAGTETSSSTLVWAMVQMMRNPTILAKAQAEVREAFKGKETFDENDVEELKYLKLVIKETLRLHPPVPLLVPRECREETEINGYTIPVKTKVMVNVWALGRDPKYWDDADNFKPERFEQCSVDFIGNNFEYLPFGGGRRICPGISFGLANVYLPLAQLLYHFDWKLPTGMEPKDLDLTELVGVTAARKSDLMLVATPYQPSRE

SEQ ID NO: 13613 - protein, 144 aa, Porphyromonas gingivalis
MLNAIYFYRLSHWLYRHHIPILPKLITLLIFLIYNSKIPPQAKIGKGSKFGYGGISVVVHHDSVIGENCSIGQLVTIGGGNSKYPGVPTIGNNVRISCGSIVGGITIGNNVVIGAHTVVNFPVPDNAVVVGNPGRIVRIKESKC

SEQ ID NO: 13614 - protein, 778 aa, Solanum chacoense
MGMAKTVQGSCWLLVFMVFLLFNLSDEFLEPSQSEAIVKIKQLLNFPQDLSSWSDNTDFCNSEPNTALTLMCYEDNITQLHISGYNWFPNLPQGFSTDTLFSNLALLPNLKVLSLVSLGLRGTLPKKIGFLSSLEIINISSNFFYGEIPGEISYLKSLQTLILDDNKFTGQVPEGVDLLHSLSVLSFKNNSFSGSLPNSLSNLQTLRILSISGNNFSGVVPNLHNLSNLQVLDLESNNLGPNFPNIPTKLVSLVLRKNKFSLGVPKELSSCYQLKKLDISSNELVGPFSPTVLSLPSLSYLDISGNKLTGKLLKNVTCSQDLSFVNLSSNYLTGELPDCLKPSSSSKIVLFSGNCLSNKEQWQHPYSFCHNEALAVSIEPHKGKVKGGNGKAVLASSMIGGFVGVVAIVGLALVVVRREYAKQKACQAPQTRLILEKVSPAHTLKLLNDARYLSETRKLGLLGAPPYRTFVLDELREATNNFDISNLIGASSSGQIYKGRLTDGTVVAIKSIKMRKRHSVQSYTHQLGRISKIRYCHLVSTIGHCFECYQDDSSVSRICLVFEFVPNVTLRGVISEANSAQKFTWTQRMSAAIGIAKGIQFLHTGIVPGIFSNQLKITDVLLDQNFHVKISKYNLSLLIENKKMDAGPSSSGSKGNDGQRLKYEEKDDVYDFGVILLEIISGRTIDTKNDIDVSKDILIVSLTADEIGRRNIIDPAVRKECSDSSLRTLMELCIKCLSDEPSQRPSVEDLIWNLQFAAQVQDPWNRDTYGNQESPGHV

SEQ ID NO: 13615 - protein, 448 aa, Pseudomonas syringae pv. tomato str. DC3000
MNMFELSDVPVTSQLKLDAHWMPYTANRNFHSDPRMIVAAHGSYLTDDKGRKIYDGLSGLWTCGAGHTRKEIQEAVSRQLGVLDYAPGFQFGHPLSFQLAEKITELTPGNLNHVFYTNSGSECADTAVKMVRAYWRLKGQATKTKMIGRARGYHGVNVGGTSLGGVNGNRKMFGQLMDVDHLPHTLLASNAYSKGMPEAGGIALADEMLKLIELHDASNIAAVIVEPMAGSAGVIVPPQGYLKRLREICDQHNILLIFDEVITGFGRTGSMFGADSFGVTPDLMCIAKQITNGAIPMGAVIASSEIYQTFMNQPTPDYAVEFPHGYTYSAHPVACAAGLAALELLQRENLVQQVAEIAPHFESALHGIKGAKNVVDIRNYGLAGAIQIAPRDGDAIVRPFEAGMKLWKAGFYVRFGGDTLQFGPTFNSQAQDLDRMFDAVGEALNLID

SEQ ID NO: 13616 - protein, 497 aa, Pseudomonas syringae pv. tomato str. DC3000
MSSIQHLIHGKFVADDGRTADVFNPSTGQVIHQVALASRETVQKAIESAKSAFPAWRNTPPAKRAQVMFRFKQLLEQNEARIAQLISEEHGKTLEDAAGELKRGIENVEYACAAPEILKGEYSRNVGPNIDAWSDFQPLGIVAGITPFNFPAMVPLWMYPLAIACGNCFILKPSERDPSSTLLIAELLHEAGLPKGVLNVVHGDKVAVDALIEAPEVKALSFVGSTPIAEYIYKEGAARGKRVQALGGANNHAVLMPDADLDNAVSALMGAAYGSCGERCMAISVAVCVGDQIADALVAKLVPHIQSLKIGAGTTCGLDMGPLVTGQHRDKVSGYIADGVASGATLVVDGRDLQVAGHEQGFFMGGCLFDRVTPQMRIYKEEIFGPVLCIVRVDSLEQAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 13617 - protein, 483 aa, Cleome spinosa
MATRIGLAGLAVMGQNLALNIAEKGFPISVYNRTTSKVDETVQRAKKEGNLPVYGFHDPESFVNSIQKPRVIIMLVKAGAPVDQTIKTLSAYMEEGDCIIDGGNEWYENTERREKAVAERGLLYLGMGVSGGEEGARNGPSLMPGGSYKAYEYIKDILLKVAAQVPGSGPCVTYIGKGGSGNFVKMVHNGIEYGDMQLIAEAYDVLKSVGKLSNRELHAVFSEWNKGELLSFLIEITADIFKIEDDKGDGYLVDKVLDKTGMKGTGKWTVQQAAELSVPAPTIEASLDARFISGLKEERVQAAKVFKESGLCGDILTDQEIDKKQLIEDVRRALYASKICSYAQGMNLVRAKSMEKGWGLKLGELARIWKGGCIIRAIFLDRIKQAYDRNPDLPNLLVDPEFAKEMVERQSAWRRVVSLAVDSGISMPGMTASLAYFDSYRRERLPANLVQAQRDYFGAHTYERADFDGSFHTEWFKIAKSKL

SEQ ID NO: 13618 - protein, 175 aa, Triticum aestivum
MAPTVMASSATSVVPFQGLKSTAGLPVSRRSNGSSLGSVSNGGRIRCMQVWPIEGIKKCDTLSYLPPLSTEALLKQVDYLIRSKWVPCLEFIKVGFIFREHNASPGYYDGRYWTMWKLPMFGCTDATQVINEVEEVKKEYPDAYVRIIRFDNMRQVPGVSFIAFNPPGCDDVDKA

SEQ ID NO: 13619 - protein, 630 aa, Cleome spinosa
MPVTVYFRILHSLKTTFEGDDDDDDDDDDDKKIPLQALMDIKASLHDPHGVLESWDRDAVDPCSWTMVTCSSDNFVISLGTPSQSLSGTLSPGIGNLTNLQIVLLQNNNISGTLPAELGRLAKLQTLDLSSNFFHGEIPSSLGHLTSLQYLLNNNSLSGGFPLSLANMTQLAFLDLSYNNLSGHVPRFAAKTFSIVGNPLICPTGAEPDCNGTALMPMSMNLNETGALSYSGKLKNHKMAIVFGSSITSVSLIILVFGFIMWWRQRHHQQTFFHVKDGHHEEVSLGNLRRFSFRELQIATHNFSSKKLLGKGGYGNVYKGILADSTVVAVKRLKDGNALGGEIQFQTEVEMISLAVHRNLLRLYGFCITPTEKLLVYPYMSNGSVASRLKGNPVLHWSTRKRIAIGAARGLVYLHEQCDPKIIHRDVKAANILLDDYCEAVVGDFGLAKLLDHRESHVTTAVRGTVGHIAPEYLSTGQSSEKTDVFGFGILLLELITGQRALEFGKSANQKGAILDWVKKIHQEKKLEVLVDKDLKNNYDHLELEETVQVALLCTQYLPGHRPKMSEVVRMLEGDGLAERWEASQRTDSTAKCSSSSSRRLNELSSSDRYSDLTDDSTLLVQAMELSGPR

SEQ ID NO: 13620 - protein, 153 aa, Aspergillus oryzae
MSDEQTFIAIKPDGVQRGLVGPIISRFENRGFKLAALKLCSPSKEHLEQHYADLSSKPFFPGLVSYMLSGPIVAMVWEGREVVKTGRTILGATNPLASAPGTIRGDFAIDVGRNVCHGSDSVENAKKEIALWFKPEELQKYKHSQFDWIYEKA

SEQ ID NO: 13621 - protein, 232 aa, Candidatus Protochlamydia amoebophila UWE25
MNLAWLLAEFIGTFTLIFIGVGAICLNEMNPGSVGLVGIALAHGLAIAVMVSNVGHISGGKLNPAVSIGVLIGGRSDWKTTVAEIFAQLAGAVFAALCLKIIFPTDVTEVTKLGTPVLADGVSMGIGIMAEAILTFLLVFTVYAAAVDPKGAFKSIAGFTIGGVIIFDILVGGGLTGAAMNPARAFGPALVSGEWIDQIVYWIGPILGGLLAGLLYSKLMLKDLTTLSTPSV

SEQ ID NO: 13622 - protein, 196 aa, Oryza sativa
  misc_feature (45)..(45): Xaa can be any naturally occurring amino acid
  misc_feature (86)..(86): Xaa can be any naturally occurring amino acid
  misc_feature (103)..(103): Xaa can be any naturally occurring amino acid
  misc_feature (120)..(120): Xaa can be any naturally occurring amino acid
  misc_feature (132)..(132): Xaa can be any naturally occurring amino acid
  misc_feature (141)..(141): Xaa can be any naturally occurring amino acid
  misc_feature (152)..(152): Xaa can be any naturally occurring amino acid
  misc_feature (165)..(165): Xaa can be any naturally occurring amino acid
  misc_feature (179)..(179): Xaa can be any naturally occurring amino acid
  misc_feature (186)..(186): Xaa can be any naturally occurring amino acid
TPFSIRESTGSEPPISRLRRRPTGVQNPNPNPSEEEGGGGGRRGXMVYYALYWWADLDNLTNLQPRYGCDDPTYPYYFKCKPFVGXSIRFVMIPGQGTPLTIXQSQKGERTCLMVFDCRXCEPIDFAFGNGXWKAESLEGXTSFDIDCSEGXEFADYDEKGECPXVGVGKLRSEFRVVXKKQESRXGKTKYVPSGV

SEQ ID NO: 13623 - protein, 478 aa, Pseudomonas syringae pv. syringae B728a
MNQPATVPPDTTFHAARLTELLEAQQAAFRAQGAPSYDQRIEDLNAVLRMVSDNQDRLLEAVSADFGNRSFDETRLGELMPVINGIKHIRSHLKAWMRPSRRKAGIVFRPATARVVYQPLGVVGILAPWNYPLTLTLVPLIEALAAGNRVMIKPSELTPRTCELLRQLLGETFPAEQVTVVTGDATLAGRFSELPFDHLLFTGSTHVGRQVMAAAARNLTPVTLELGGKSPVVVCDDFSISKAARMIAIGKLFNAGQTCVAPDYVLVPREHVDSFASEWLAAAEKLYPTLDGNPDYTSIISQRHYDRLMAMASQAVATGAKAWQHNAPATAGERKIAPMALTQVSLKADVMGEEIFGPLLPILAYESLDEAIAFINARPAPLALYCFSNDQTSVERVLNRTQSGGVTINGTMLHATQDDLPFGGVGDSGTGAYHGYEGFVRLSHARGVLKLGRFNMSDKVSAPYGRLTRLVTRFMIGK

SEQ ID NO: 13624 - protein, 305 aa, Kluyveromyces lactis NRRL Y-1140
MSYNPYYSEIGSDSNVGMAAAGKGKNISATGKQYGMQQPSLGPQTPQQQQQQNGSYLPSASTNMAFQFGQTAFNQFVGQENISQFQETMSKATGATNSSVAHYFQVSNSYVFHKFKLITVPFLQKNWQRIPDSSNSFQPPRIDVNSPDLYIPVMGLVTYILAWNVTQGLNGSFDPENLYFKLSSTLAFFLLDLIILRLGLYLLVSNTTSPVTSLVELTCYVGYKFVPLIFSMFFPASFIWLNRLAKLYLFVAFGVFLLRSIKFNLFADMGNSADFSFKKGTVKKVNYFLFVYGFFWQSVLMWLMG

SEQ ID NO: 13625 - protein, 199 aa, Physcomitrella patens subsp. patens
GKIFIGGLSWDTSTDNLQSHFKKYGEIIDAVIMKDRSTGHPRGFGFVTFADPAVCDNVVLDKHVIDGRTVEAKKSVPRENMAASKGPKTKKIFVGGIPPSITDEEFKSYFASFGSVVEHQIMQDHSTGRSRGFGFVTFDSEQVVEDILAHGKMHELGGKQVNDRDCSHLSNLIIQGLTSNLKISGRFQQRLTMLEDTTL

SEQ ID NO: 13626 - protein, 458 aa, Pseudomonas syringae pv. syringae B728a
MLNNGLLHSTTSQKTNANYLDRQSKFESNVRSYPRKLPLAIAKAHGVWVTDVEGTTYLDCLAGAGTLALGHNHEAIMASLDSFLTSGMPMHTLDLTTAVKDAFSETLLSLLPGQGRDYCLQFCGPSGADAVEAAIKLAKTATGRHNIISFSGAYHGMTHGALALTGNTAPKNAVANLMPGVQFLPYPHEYRCPLGIGGEAGTEALSYYFTQFIEDVESGVSLPAAVILEAVQGEGGVNPAPAAWLRQIREVTRKHGILLILDEVQAGFGRTGKMFAFEHAGIEPDIIVMSKAVGGGLPLAVLGFKREFDAWSPGNHAGTFRGNQMAMATGLATLEVLQRQNLAGQAAKRGDWLKEQLGLLQQRYPAIGNVRGRGLMLGIEIVDERKAADRLGSLPMDPDLAVAIQQHCFKQGLLLERGGRNGNVIRLLPPLIITEEQCQLVIQRFEQALKAALSQLRK

SEQ ID NO: 13627 - protein, 264 aa, Candidatus Protochlamydia amoebophila UWE25
MSPSHRPVVITGNWKMYKTVKEACTFAKALLPVVEVSPIQVWIAVPFTAIYPVKQEIRNSRLVIGAQNMNDASEGAFTGEIAGKMVKEAGASFVLLGHSERRHLYKEDNAFINRKVKKALEIGLTPVLCVGETFEERKSGETQQIIRTQIQECLAGLTAEDLKTLIIAYEPVWAIGNGQNAKPEGAQEIHQFCRKIIKEIFSEELAEQIVIQYGGSVNPSNAISLLKQPDIDGLLIGGASLSLETFVEIVNDGGSIFNLKAKLL

SEQ ID NO: 13628 - protein, 475 aa, Silicibacter pomeroyi DSS-3
MSTFDYDLIIIGSGPSGRAAAIQAGKLKRRVLVIDRKDRLGGVSVHTGTIPSKTLRETVLNLSGWRERSFYGRSYRVKDRISAEDLKARLHMTLDYEVDVLEHQFNRNHIDTLNGLARFVGPHEIEVATEAGDTTRLTAAKFLIATGTKTYRPDYVPFNGKTVVDGDDFLEMERIPRSLAVIGAGVIGVEYASMFSALDVRVTLIEPRETFLDFIDRTLIQEFTHQIRENGVDLRLGSAVEKIEDTGSHIEISLANGRHIRAEMLLFAAGRMGATSALNLDAVGLETDHRNRITVDRKTYQTSVPHIYATGDVIGHPSLASTSMQQGRVAACHALETPTLPESPWFPYGIYSVPEMSTCGMSEEELQERGIPYEVGVARFRETSRGHIMGLEHGMLKMLLSLKTRRVLGVQIVGEGATELIHIGQAVMNLKGTVDYFVQNTFNYPTLAEAYRTAGLDAFNRMPIPEEFKVKKPKK

SEQ ID NO: 13629 - protein, 362 aa, Buchnera aphidicola str. APS (Acyrthosiphon pisum)
MGFKCGIIGLPNVGKSTLFNLLTKGNSAVANFPFCTIKPNIGIVPVIDERINNLNQIVSPQKTVNAFIEFIDIAGLVKGASQGEGLGNQFLGNIRDVHAIAHVVRCFKDDNITHIYNQVQPIKDIDIINSELILSDFDLCEKTILKLQKKTLLKNKETQEKINTLKKCLNHLKQFFMLKTLNLNKTEKQLISYLRFLTLKPTMYIANINEEKESYYFLDKLNEIAKKEGSIVIPIHANLELDLVKMSDEEKKSFMKLFNIKTLGLNSIISSGYHLLNLITFFTVGDKEIRAWAIPNGSTSIEAAHKIHSDFSKGFIRAQIIKYVDFITYKSEAKIKEMGKFRTEGKQYYIQDGDIIHFLFNV

SEQ ID NO: 13630 - protein, 816 aa, Buchnera aphidicola str. APS (Acyrthosiphon pisum)
MKLLKFGGTSLANAEKFLSVSSIIEENTQTDQIAVVLSAPAKITNYLVKIIENTIKNNQILETVHLAENIFMQLINNFLNIQSNFPHKEIEKIIKKEFNELKNIIQGILLLKQCPDNIRAIIISRGEILSVFIMKSILQSKNYNVTIINPVKNLVAIGDNYLDSTVDISESKKNIQNMNINQSNIILMAGFIAGNKDKKLVVLGRNGSDYSAAVLAACLDANCCEIWTDVDGVFTSDPRKVPNARLLKSISYQEAMELSYFGAKVLHPRTIEPIAQFKIPCLIKNTNNVKSIGTLICEQNCSEKDFLKGVTHLDEIAMFNISGPHIKDVGSVISRIFTMMSRGNIKILLITQSSSENKINFCVYEHDIYKILYLFNKEFQLELKDGLLNPFKIKKNLSILSIVGSNIYKKHNIASKIFSVLGALKINVIAISQGSSKHSISLVIKKENILKAVQHVHNTLFFNKKTIHMFLIGIGGIGSTLLNQILKQKQFLDKKNIEIKICAIANSKKILLLDNTNDLSNWKNDFKKSTQKFNLELLNNLIKNNHFSNSVIVDCTSSQLLSEQYVNFIDNNFHVVTSNKKANTSEWNYYKKIRKSVAQTGKKFLYETNVGAGLPVIETLQNLFKSGDNLICFKGILSGSLSFIFGRLEEGILLSQATREAKELGFTEPNPCDDLSGIDVARKLLILARESGYNIELKDIKIEPLLPNNFKIYEDTDKFLLKLKELDVYFSNKIKQALNVGNVLRFVATIEQKRQFFIKLEEVNINNPLYKVKNGENALAFYTNYYQPIPLVLRGYGAGNNVTASGVFSDLLRTLS

SEQ ID NO: 13631 - protein, 449 aa, Desulfotalea psychrophila LSv54
MDPIIQQLHAKDQDQHEFHQAVEEVLESVKPVLDRNLWYRQQGVWERLIEPERVIMFRVPWVDDEGNVRVNRGFRVEMNSALGPYKGGLRFHPSVNLSIIKFLAFEQTFKNSLTTLPMGGGKGGSDFNPKGCSDFEVMRFCHSFMLELYRHIGPNTDVPAGDIGVGAREIGYLFGMYKKIKNEFTGVLTGKSLGWGGSLIRPEATGYGNVYFASEMLTTRDQTIEGKSCLVSGSGNVAQFTIEKILDLGGKVHTISDSDGYIYDEEGIDCDKLGWIKQLKNIRRGRVAEYVETYPQAVYTPIDPTLGYNPLWDHSADCAFPSATQNEINEQDAKNLVKNGVFLISEGANMPSSPEAVAVFHDANCLYGPSKAANAGGVAVSGLEMSQNTIRMSWPREEVDTRLKQIMHSIHSTCVDAASEYNYGQNYVAGANIAGFVKVVNAMLDQGVV

SEQ ID NO: 13632 - protein, 186 aa, Coxiella burnetii
MISAWMFVSAIACGNTFVLKPSEKDPSAALFLAELMQEAGLPAGVLNIINGNGATVDRLITHPKVAAVSAVGSTAAAEHIYQTAIAHGKRAHTFGGAKNHCVITPDADIDEAVDAILGAAYGAAGERCMAVSVVVAITDTVGDALVQRLKEKIPQLQIAAGTESRADFGPLVTKEHLAKSLTPIFI

SEQ ID NO: 13633 - protein, 350 aa, Staphylococcus epidermidis RP62A
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKELGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 13634 - protein, 469 aa, Vitis vinifera
MATLNGEDLLLLDCPHCLVPGPLTSSSASMLKPVRQRSCFSSHALLDLPASGIVSIPLAQTGEGIAECELLKWFVKEGDQVEEFQPLCEVQSDKATIEITSRYKGTVSQIIYVPGDIVKVGESLLKMVVEESQGSNLTSNAPDDMKSMGAEVCDSSIQSGVLATPAVRNLAKQYGVDINHILGTGQDGRVLKEDVLTHAVQKGLCKEPSSLSVNSVEHFQGEEKYSHTLAADGWQYEDKTVPIRGFQRAMIKSMTLAAKIPHFHYVEEINCDALVKLKASFQEENRDPEVKHTFLPFMIKTLSMALSKYPLLNSCFNEELQEITVKGSHNIGIAMATPHGLVVPNIKRVQLLSILEITKELARLQQLALANNLCPEDISGGTITLSNIGAIGGKFGSPLLNSPEVSIIAIGRLQKVPQFVDDENVYPASIMTVNIGADHRVLDGATVARFCNEWKLYIEKPEQLMLHMK

SEQ ID NO: 13635 - protein, 508 aa, Pseudomonas syringae pv. tomato str. DC3000
MNASLNDTSTTVARVKLLINGEWIDSQSGEWQDIVNPATQEILAQVPFATSDEVNAAVAAAHAAYRTWRDTPVGARMRIMLRLQALIREHSKRIAAVLSAEQGKTLADAEGDIFRGLEVVEHACSIGTLQMGEFAENVASGVDTYTLRQPIGVCAGITPFNFPAMIPLWMFPMAIACGNTFVLKPSEQDPLSTLLLVELAVEAGVPAGVLNVVHGGKDVVDAICMHKDIKAISFVGSTAVGTHVYDLAGRHGKRVQAMMGAKNHAVVLPDANREQTLNALVGAGFGAAGQRCMATSVVVLVGASKQWLSDLKALAQKLKVNAGHEPGTDIGPVISRRAKQRILDLIESGVREGATLELDGREVSVPGYEGGNFVGPTLFSGVTTDMQIYTQEIFGPVLVVLEVDTLDEAIALVNANPFGNGTGLFTQSGAAARKFQSEIDVGQVGINIPIPVPVPFFSFTGSRGSKLGDLGPYGKQVVQFYTQTKTVTSRWFDDDSVNDGVNTTINLR

SEQ ID NO: 13636 - protein, 93 aa, Cleome spinosa
MGYVQQARENHVKKKVEEALRSKMKAKALKECDHYTSKYAQCATGRTFSVVWKCRNQAKELNACLHQYTNDGVLEEMKREYMLQEEGNSSAAI

SEQ ID NO: 13637 - protein, 337 aa, Cleome spinosa
MAAISFVSNNHRLSDNRRHHHGPVVEEIEPLLRVFSDGCVERPPVVPTVPPSVLSDPSKLTASDIKLTNDIWTRVYVPAGHHTPLPLLVYFHGGGFCVGSASWGCYHEFLCNVAVKVRCVIVSVNYRLAPEHRLPAAYEDGETVIAWIKQQAFDKNQKSWLSKCDLSSVFLVGDSAGANIAYHVAVRLTASGRSVNPLNFKGIVLIQPFFGGESRTASEKVSDKKNSNSALTMSASDTYWRLALPRGATRDHQWCNPNPASLREAGKFPAAMVMVSEMDVLKDRNLEMCKMMRGCGKRVEAVVYGGVGHAFQILHNSPMAHVRVQEMMSHLKNFINP

SEQ ID NO: 13638 - protein, 605 aa, Zea mays
  misc_feature (332)..(332): Xaa can be any naturally occurring amino acid
MGGEAPEPRRLTRALSIGGGGGGWVPDEMLQLVLGFVEDPRDREAASLVCRRWHRVDALSRKHVTVPFCYAVSPARLLARFPRLESLAVKGKPRAAMYGLIPDDWGAYARPWVTELAAPFECLKALHLRRMVVTDDDLAELIRARGHMLQELKLDKCTGFSTDGLRLVARSCSSLRTLFLEECQINDKGSEWIRDLAVNCPVLATLNFHMTELEVMPVDLELLAKSCKSLISLKIGDCDLSDLIGFFQSATSLEEFAGGTFNGQGELTKYGDVKFPSRICSLGLTFMGASEMPIIFPFAAILKKLDLQYTFLTTEDHCQLIAKCPNLLVLAXISPAHVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTMLRRFALYLRPGGLSDAGLGYIGQCSGNIQYMLLGNVGETDDGLISFALGCVNLRKLELRSCCFSERALALAILSMPSLRYVWVQGYKASQTGRDLMLMARPFWNIEFTPPSSQNAGRLIEDGEPCVDSHAQILAYGSLAGKRLDCPQSVVTLYPA

SEQ ID NO: 13639 - protein, 511 aa, Debaryomyces hansenii CBS767
MSEPTVNFHIQTRLTEFKIPTELIKKNFKAVQKQIEKQKKSIGEDVAKVKKNNKLPTAMKIEMINKLIKSFEIFQKRLRTSINRDEVFRSRIIARLENLSELANYTVKTNVVLELNASPIDSDDNRDESSVTPKSMEDEDRPLDLHNVNLINWYRDQTNLLIIDYLIKSNTRSDQNIGLQLLKSISQTNPKFTKLIDYDLYDNFNKVFVSIIENHDLSLVIAWFNENRSFLKKANSNLEFEINYCKFLSLIEEGDVNEAIKFSQVNLSPYGNKGNYQSQEFMNHESNLNKLKEIGGLLVYMAINEKANAQIDKSIPFSSSLVINSPRFKEYKKLLSNERWDSLSQCFIENFTKLYGISRNYPLFIYLSAGLSSLKTKSCYCNTENTIFKQYEESSESNKNIYKKDLAVLTDKKYRGPNKYYKLLNKINHCPVCSPELYKLSKNLPYAQLITSIFNNPFKLPNGNIYPFDKLLNPSEKYLSEKNTLLRMGKIKDPLTREIFLIDDCVRVYPA

SEQ ID NO: 13640 - protein, 270 aa, Brassica napus
MELNDGFTEQRKHDDLAGLRRTPIQVVFRRSRSPQISESSLIVFSAMSSNTASSSAGSGDSSAARKNSKRPKYSKFTQQELPACKPILTPGWVISTFLIVSVIFIPLGVISLFASQDVVEIVDRYDNDCIPAPARTNKVAFIQGAAPKSCNRTLTVTKRMKQPIYVYYQLENFYQNHRRYVKSRSDSQLRSPKFENQISACKPEDDAGGKPIVPCGLIAWSLFNDTYTLSRNNTPLAVNKKDIAWKSDKEHKLGTKSSPRISKGNLTGGA

SEQ ID NO: 13641 - protein, 522 aa, Synechococcus sp. WH 7805
MLGELWSFQGRYRTLHLTWFAFFLTFVVWFNLAPLATTVKADLGLTVGQIRTVAICNVALTIPARVLIGMLLDKFGPRLTYSTLLVFSVIPCLMFASAQDFNQLVVARLLLSIVGAGFVIGIRMVAEWFPPKEIGLAEGIYGGWGNFGSAFSALSLVGLAGWLSFSGGFELPTGAVLNWRGAIALTGIISAIYGVIYYFNVADTPPGKVYQRPERTAGLEVTSMRDFWGLLGMNVPFAAILCVLCWRLQKVGFLNASTYPLALLAVLVWFVFQTWGIVRTNRELIMGTKVYPKEDRYEFKQVAILELTYIVNFGSELAVVSMLPTFFETTFDLPKATAGILASCFAFVNLVARPAGGLISDKLGSRKNTMGFLTAGLGFGYLIMSLIKPGTFTGSTGIVIAVLITMLASFFVQSGEGATFALVPLVKRRVTGQVAGLVGAYGNVGAVTYLTIFSLLPLWMGGAGEPTPETIAASNSAFFQILGIAGLIVAFFCFFFLKEPKGSFADLHEGETASEGTPSMAG

SEQ ID NO: 13642 - protein, 575 aa, Pseudomonas syringae pv. tomato str. DC3000
MKFEPLARSLIATALIVAYSPTFAASQAPVAAENGMVVTAQHLATHVGVDVLKNGGNAVDAAVAVGYALAVVYPAAGNLGGGGFMTIQLADGRKTFLDFREKAPLAATANMYLDKDGKVIPDLSAKGHLAVGVPGTVSGMEMALNKYGTRKREEVIAPAIKLAEDGFVLGQGDVDMLSSATDVFKADMADSGSIFLDKGKPMQVGQKLVQKDLARTLKEVSEKGSDGFYKGWVAKALVDSSQAGKGIITQADLDHYKTRELAPVECDYRGYHVVSAPPPSSGGVVICQILNILEGYPMKELGFRSAQGMHYQIEAMRHAYVDRNSYLGDPDFVKNPVEHLLDVKYAAKLREAIEPQKAGDSNKIKPGVAPHEGSNTTHYSIVDKWGNAVSVTYTLNNWFGAGVMASKTGVILNDEMDDFTVKVGVPNMYGLVQGEANAIAPGKTPLSSMSPTIVTKDGKTVMVVGTPGGSRIITATLLTMLNVIDYGMNIQEAVDAPRFHQQWQPEATNIDTFAVSPDTLKILESWGHKFAGPQPLNHVAAILVGAPSLGGKPVGNNRFYGANDPRRNTGLSLGY

SEQ ID NO: 13643 - protein, 386 aa, Yarrowia lipolytica CLIB122
QIDAKWKTCPTTCNLDHPSRFPTCQLLLKDVTIEQVVNASNNNNNTLTPLAESSAGATHTPPSSVHIVNEQKLAVRSIRQFLQSKSAYDVLPVSFRLIVLDTALLVRKSLTILLQNNIVSAPLWNSKTSKFAGLLTAADYINVIQYYFQNPDKMEEIDKITLDDFRDVEKAVGAKPIETISIHPMKSIFEACKKMIESKAKRIPLIDRDEETGREIVVSVLTQYRILKFVALNCKETRGLMMPICSLPKLGVFKGLATAHMDTPVVQVIKLLVDARVSSIPIVDTHNRLMNVYEAVDVLALIKGGIYTDLTLSVGEALMRRPEDFEGVYTCTNQDRLDTIMNTIRRSRLHRLYVVDGDGKLEGVVTLSDILRYLLFDEDVEQVEVK

SEQ ID NO: 13644 - protein, 250 aa, Triticum aestivum
HFPARNPLWPLGHFRCPIGPSFYQQTGWYGSGIPGILSTHASPNGATRTLTWTEGVGTQARGPPPSQLYTYIVQPWPPTVMASSPTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 13645 - protein, 631 aa, Aspergillus oryzae
MPLQENEWLAQLDTFTTVDFKALDPLLQRLNTHLLLRSFIVGYSLSTADIALWGALRGNRVGISAIRKGALVNLTRWFTFLEDLCPWATSALEALNAAAKDKKTTKGKQGGANYDVALLNTDKGVVTRFPPEPSGYLHIGHAKAALLNDYFAHEKYNGTLLVRFDDTNPTKENSEFQDAIVEDLALMGIKPDKMSYTSDYFDQLYEYGVQIIKDGKAYADDTDKETMAAQRMDGLPSKRRDATVEENLARFEEMKKGSPEGLGWCIRAKISVDDKNKALRDPVIYRSNPDPHHRTGTKWKIYPTYDFACPIVDSIEGVTHALRTIEYRDRNPQYQWMLDALKLRSVQIWDFARMNFIRTLLSKRKLTKLVNEGVVWGWDDPRFPTIRGIRRRGMTIPALREFILRQGPSKNITNLDWTLIWATNKKYIDPVAPRHTALLKKDVVKATIKGAPAPYTEEKPKHVKNPSVGTKKVVYSGSILFDQEDAKSFKQDEEITLMNWGNAIVRQIVTDPSSGVVKELELDLHLEGDFKKTEKKVTWLSTDQNLVPVELVDFDYLLNKDTLQEDDALEDVLNRNTEFREDATADCNVAELKEGDIIQFERKGFYRVDKAYAPGQPAVLFYIPTGKTGGK

SEQ ID NO: 13646 - protein, 338 aa, Phaffia rhodozyma
MAVKVGINGFGRIGRIVLRNAIIHGDIDVVAINDPFIDLEYMVYMFKYDSTHGVFKGSVEIKDGKLVIEGKPIVVYGERDPANIQWGAAGADYVVESTGVFTTQEKAELHLKGGAKKVVISAPSADAPMFVCGVNLDKYDPKYTVVSNASCTTNCLAPLAKVIHDNYTIVEGLMTTVHATTATQKTVDGPSNKDWRGGRGAGANIIPSSTGAAKAVGKVIPSLNGKLTGMAFRVPTPDVSVVDLVVRIEKAASYEEIKETIKKASQTPELKGILNYTDDQVVSTDFTGDSASSTFDAQAGISLNGNFVKLVSWYDNEWGYSARVCDLVSYIAAQDAKA

SEQ ID NO: 13647 - protein, 493 aa, Pneumocystis carinii
  misc_feature (398)..(398): Xaa can be any naturally occurring amino acid
CTTKHTGTSASTPIAAGIIALILSKRSDLTWRDVQALIVYTAVPFNLNYHEWDQLPSGRYYNNFFGFGKLDAYAMVQQAKTFQKLNPQTIFSTQLIQVNKKFSENNGHITSTFYIHRDYPTHYKFKNLEYICVSFCYKHQYRGHLEFSITSPANVTSQLAHRRPRDKHSGIVYWTFMSVKHWGEKIVGNWTIDVEDKKDQNLDGEVFDWQLHFFGESSESEGVPPPSYPFLSRYPTTTPPPDPDATSPPDPDANLPPDSNADPQPPSEPAPPSEPESQPSSEPGSQPPSKPGPQPPSDPQPPSDLKPPSKPDARPRPPSDPSSQQDPDTSLSSNPTSTSSSEPPPPSPPPPPPPPPAPAPAPAPPRPELEPEPEPGPEPVPQPPQPQPPQPQPEPPAXPPKPQPPPPSPPEQKPTSITSSTSTTSSSKTKISTTRKASSTKASSTTKTSTRPSPTEGTFTGSSASHLSFFEKRHLLLQMILLLFFFLFLGYSF

SEQ ID NO: 13648 - protein, 288 aa, Ustilago maydis 521
MEATMVESGASAVTSGDIAPNLDGILLLEAPFARAPFDELRRQQKTQQRLVERELLFATTTFSEASKLCSSLSSAGAGAGAGAGTAALEVEKSLDAVLGRLKGLKRKLEPLSDAAKTTLRMAQSRTDHLEQLHKLATDSDTEEFHEWSKTRLDRMVVDYMLRRGYRQAAHELAHSRGIEDLVDLQLFEQVARIEDSLCPPGWDAESGQVDVKPSCTLALAWCSENKAVLRKIRTPLEFNLRLQEFVELTRTRRPESLKEAIAYARRHLLPMLDALRRTLGDGQGARVR

SEQ ID NO: 13649 - protein, 264 aa, Schizosaccharomyces pombe 972h-
MEKSQHTLFRPCIDIHQGQVKQIVGGTLGNDADVKTNYVSLKPSSYYAELYKLNHLEGAHVIMLGPNCEEAAKTALHTWPGALQIGGGINISNAQNWLQEGASKVIVTSWLFPDAQFDLDRLKAISSKIGKDRLVVDVSCRRKDNRWFAAINKWQVMTAFELNEENLDLLSQYCSEFLIHAADVEGLCKGIDEDLVIKLGEWVKIPTTYAGGGRSIEDLDLVDKLSKGKVDLTIGSALDIFGGVLEFTRVVAWNRRFTPLPLQD

SEQ ID NO: 13650 - protein, 412 aa, Arabidopsis thaliana
MGLFGTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDYCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKPKEIRSRSSYDLLSAEVIEVTPTNCVIEISKSAGELRLYMEFCQSLSSLLTAEVS

SEQ ID NO: 13651 - protein, 389 aa, Haemophilus influenzae 86-028NP
MNLHEYQAKQLFEHYGLPVKNGAVCQSVEDVDLVLAQLSGDKWAAKCQVHAGGRGKAGGVKLVQDVEEARAFAEKWLGQRLVTFQTDKLGQPVNQIYFEETCDIDKEFYLSAVVDRASQKVMFIASPAGGMNIEEVAQNSLHLLHKVEIDPLFGGLPYQGRELAFKLGLSGTQNKQFTDIFMGLSRLFLEKDLSLVEVNPLVLTKQGYLVCLDAKISVDDNALFRHKDLLALQDLTQNDAREAEAEKFQLNYVALEGDIGCMVNGAGLAMGTMDIVKLYGGKPANFLDVGGGATKERVAEAFKIILTDPSVKVILVNIFGGIVRCDLIAEGVIAAVNEVGVRVPVVVRLEGTNAEMGRQILAQSDVNILTAQSLQQAAELAVNAAKGEH

SEQ ID NO: 13652 - protein, 127 aa, Triticum aestivum
  misc_feature (24)..(24): Xaa can be any naturally occurring amino acid
  misc_feature (52)..(52): Xaa can be any naturally occurring amino acid
GRYGRNSGVDPRVDQGNGGGANSXVAPGYTKGDGLGAEIVGTFVLVYTVFSXPLPIGFAVFLVHLATIPITGTGINPARSLGAAIIYNKKQAWDDHWIFWVGPFIGAALAAIYHVVVIRAIPFKSRD

SEQ ID NO: 13653 - protein, 469 aa, Pseudomonas aeruginosa PAO1
MHVATSVIEDQPLRATPAEGETLYEFSQSPLLERQSRQESNARSYPRRIPLALKKARGLLVEDVEGRTFIDCLAGAGTLALGHNHPVVIEAIRQVLADELPLHTLDLTTPVKDQFVQDLFGLLPPALAAEAKIQFCGPTGTDAVEAALKLVRTATGRSTILSFQGGYHGMSQGALGLMGNLGPKKPLGAVLSTGVQFLPYPYDYRCPFGLGGEAGVKANLHYLENLLNDPEGGVQLPAAVIVEVVQGEGGVVPADLDWLRGLRRITEQAGVALIVDEIQSGFARTGRMFAFEHAGIVPDVVVLSKAIGGSLPLAVVVYREWLDKWQPGAHAGTFRGNQMAMAAGSAVMRYLKEHDLAAHAAAMGERLAEHLRILQRDYPQLGDIRGRGLMLGVEIVDPQGEADALGHPPTDGALASRVQRECLRRGLILELGGRHGSVVRFLPPLIIGAEQIDEVARRFARALGAALAG

SEQ ID NO: 13654 - protein, 299 aa, Glycine max
MSMMSLTTVAAFKSLTMAESCLLSLPSLFYAKNNTLSLSIPTKPLNLHLPCSNSSLFPLTTKTTRHSSLLTFVAQTSDWAKEEEEEETSWENQGDTAWGTEEGGHEEGGFAEKAEEDKIFVGNLPFDIDSENLASLFGQAGTVEVAEVIYNRATDRSRGFGFVTMSTLEELKKAVEMFSGYELNGRVLTVNKAAPKGAQPERPPRPPRSFSSGLRVYVGNLPWEVDDARLEQIFSEHGKVEDARVVYDRETGRSRGFGFVTMSSETDMNDAIAALDGQSLDGRAIRVNVAQDRPSRSSF

SEQ ID NO: 13655 - protein, 473 aa, Buchnera aphidicola str. APS (Acyrthosiphon pisum)
MNKKIYTQVVVIGSGPAGYSAAFRCADLGLDTVLIERYDKLGGVCLNVGCIPSKTLLHIAKVIKEAKELHKTGVSFNKPDIDIKKIKNWKQHIVNKLTDGLSSMRKKRKIRIFQGHAIFETDKSLCVTNTEDKFTIFFDNAIIATGSKPIKIPSIPHDDIRIWDSTDALSLKKIPNNFLIIGSGIIGLEMATIYSALGSKVDIIDRFNHFLPVIDEDISSIYKKSINQQFNLMLNTHIDKVEVKKDALIVDMIHENIPKKNILYDAVLVAIGRTPNIDSLGLDRIGLKINNFGFIQVNNQLKTNIPHIYAIGDVAGTPMLAHKGVHEGHIAAEVISGKNHYFEPKVIPSIAYTDPEIAWVGLSEKEAKQENINYEVAIFPWNASGRAIASNCSIGKTKLIFNKQNNKIIGGSIVGSNAGELIGEVGLAIEMGCDAEDIALTIHAHPTLSESIGLSAEVFQGTVTDVLNFKLNK

SEQ ID NO: 13656 - protein, 451 aa, Medicago truncatula
MENYSYQSYPDSGDSSPHSREIDFENPPTTTPWEDQQNQTSYKAKFMCSYGGKIQPRTHDNQLSYVGGETKILAVDRNIKFSSMISKLSSLIEAHDVSFKYQLPGEDLDALISVTNDDDLDHMMNEYDRLYRASARPARMRLFLFVNDSVPSPDPVKPSNVDYLFGIEKPVTVAPIPAAVKFHDAVPEPVAPVPEYHPRQGLNPSDRVVSSDPGLNLNLNHPVEIQRQLQRMQIAAENEQTAYRRKSEENYPVSGGDYYVQKVPEKFPAMSNFAPPSQHQQQQPGYWTERPVSGEAYPPVAASGGGEQPVYMVPAPGAYYHAPVMRPPASQGYYAVQRMPSDAYRETQVYGGAPPPKAPFSSGVSAASYAPAQPVKGPAYAEGVSVVRSSGLPDNTSGSYAQVAYDSASGRQVYYNAPPGGVVHPPPQYQGVAAPVTTDVKVMSKISQGSV

SEQ ID NO: 13657 - protein, 426 aa, Clostridium cellulolyticum
MIRKEMIAMLLAGGQGSRLGVLTKNVAKPAVLYGGKYRIIDFSLSNCTNSGIDTVGVLTQYQPLKLNAHIGIGKPWDMDRIEGGVTILSPYLKAEMGEWFKGTANAVYQNIQYIDKYSPHYVIILSGDHIYKMDYSKMLDFHKENHADATISVINVPYEEASRYGIMNCHENGKIYEFEEKPKNPKSTLASMGVYIFTWSTLREYLIKDNECSDSVNDFGKNIIPAMLGDGKSMWAYQYSGYWRDVGTIQAFWESSMDLVSRVPQFNLFDPEWRIYTPNPVKPAHYIASSACVKKSIIAEGCSVHGTVINSILFPGAYIEEGAVIQDSIIMSNSRVCKNAYINRSIISEQAIIGEKARLGEGPDVPNEYKPGIYDSGITVVGEKSSIPADPVIGKNVMIDIGASAVDFTSLNVQSGKSVFKGGVAE

SEQ ID NO: 13658 - protein, 239 aa, Oryza sativa
MSKLCQSACKAAKSLLSATAAASSPRTSLLAEGRNAALATLTNLGRKSLPTAYAYSYHHNSSAAAAGWLAAIPAAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 13659 - protein, 711 aa, Haemophilus influenzae 86-028NP
MSRTIILIPVSTGVGLTSISLGLIHSLEQKGTKVAFMKPVSQPSTGEDKLDRTTSIIRTSTSLETAEPFMLSVAESLIGQNQSDVLLEKIVANHQQLTKNNDIVVVEGLIPTRKHGYANNINYEIAQALDAEIVLVAAPATETPTELKDRVEAAASLFGGKNNPNLLGVVVNKFNAPVDESGRTRPDLAEIFDSFQHNHISETEVNKLFAGSAIKLLACVPWNANLIATRAIDLVKHLGASIINEGEINRRIRGITFCARSLPNMVEHFRAGSLLVASADRPDVLVAAALAASNGIEIGGILLTGGYKIDAQINKLCQPTFEKAKLPIFRIEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 13660 - protein, 498 aa, Raphanus sativus
MRTNPTTSDPAVSIREKNNLGRIAQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVDNLGPVDTSTTSPIHKSAPAFIQLDTKLSIFETGIKVVDLLAPYRRGGKIGLFGGAGVGKTSLIMELINNIAKAHGGVSVFGGVGERTREGNDLYKEMKESGVINELNLAESKVALVYGQMNEPPGARMRVGLTALTMAEYFRDVNKQDVLLFIDNIFRFVQAGSEVSALLGRMPSAVGYQPTLSTEMGTLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFKLILSGEFDSLPEQAFYLVGNIDEATAKATNLEMESKLKK

SEQ ID NO: 13661 - protein, 572 aa, Staphylococcus epidermidis RP62A
MVNTNNHISDELDKNLDEMEFLKANSDFLRGTIEQSLANPITGSITQDDAKLLKFHGSYMQDDRDLRDERRKQKLEPAYSFMIRVRVPGGKATPEQWIAMDDISNQYANHTIKLTTRQAFQFHGILKRNLKQSMKNINHAVLDSIAACGDVNRNTMCNPNPYQSQVHKEINDYATRISNHLLPRTNAYHEIWLDGEKVLDSSEEKEPIYGNTYLPRKFKIGIAVPPSNDIDVYSQDIGLIAIVEQDELIGFNVTIGGGMGMTHGITETYPQLGRLIGFIPKEKVVDVCEKILTIQRDYGNRENRKNARFKYTVDRLGETWVTEELNRRLGWEIKAPRDFEFEHNGDRLGWIEGINNWNFTLFIQNGRVKDTEDYLLKTALREIAEIHTGDFRLSPNQNLVIANVSPEKKEEIQAIIDKYKLTDGKNYTGLRRNSMACVAFPTCGLAMAESERYLPSLITKIEDLLDESGLKEEEITIRMTGCPNGCARPALAEIAFIGKAPGKYNMYLGGSFKGERLNKIYKENIDENEILESLRPLLLRYSKERLDGEHFGDFVIRDGVIAKVHDGRDFHS

SEQ ID NO: 13662 - protein, 267 aa, Methylobacillus flagellatus KT
MDNSIEMDWERRFGGVRRLYGELALHRFRHAHVAVIGMGGVGSWAVEALARSAIGKLTLVDLDNIAESNVNRQLHAVEGAFGLAKVTAMAQRVREINPLAEVREVEDFIASDNLDVLLDSSVDAVLDAIDDARAKVALAAWCRKLGIPLVMAGGAGGRVDPTRIRVADLADVHGDRLLAKVRNQLRRDHGFPKGLDGNKPGSKKKLPTFGIACVYSDEPVQQPETSCNVEAGSITGLNCAGYGSSVAVTASCGMIAAAAVLKRLAVG

SEQ ID NO: 13663 - protein, 269 aa, Coccidioides immitis RS
MESNDAAHHKHSEHPAPPPPPAGNWIPFPKTSKPLTFKHGDHSYAILPAPGLYEHYTLAFVNSEETAEQDLAAAAVQASGMSEPRVRLTRHHAQLNFGNELRQLLRAFGDNAPHPDFPQEPNPETVRVLDEIVTDFIIETCHAAAQVAAHAGRQKVKVDDFMFVIRRDAAKLGRVQELFQLEKELKEARKAFDQNDDRVGKDATAGKEIEGLVGSDGEGAETVVDGTSAAAGKKKGKGKKRAAGMETAASESGAGKKRKVSTVKAESTA

SEQ ID NO: 13664 - protein, 156 aa, Kluyveromyces lactis NRRL Y-1140
MSGKACYICGKLGHLASDCDSEKLCYNCNKPGHVQSECTVPKTVEFKQCYNCGETGHVKTECTVQKCYNCDGFGHISRECDQPKRFRNNERSGPKVSCYKCGGPNHIAKDCLKSEPTCYNCGQAGHLSKDCQNGENEKVCYNCNGVGHIAKDCSSY

SEQ ID NO: 13665 - protein, 466 aa, Arabidopsis thaliana
NLPSQTCLNNVKVLQAIVLFILFWVWLSWMGGSSSKESPRGGGSGRRYERSVSGSSSYSSAWDQSSYYQTPNHPSASPVSSYNSGRQTPKNLERKYSRIADNYRSIDEVVVSVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 13666 - protein, 137 aa, Arabidopsis thaliana
MLKFLSKVRIEFNTLDPRLASCVEFLAQCNARKAKESNPNCQVLVKRRTDEQPPQITVTFVNGVEEAFDAAATSAQSIRKMILDKGQYLETEQMFREAGEQWPVIIPDEELLQEAPGVKVCDCTFSMSHLSLERRKL

SEQ ID NO: 13667 - protein, 1249 aa, Oryza sativa Indica Group
  misc_feature (804)..(804): Xaa can be any naturally occurring amino acid
MPEPDVGVLGGRGLHRDGLKGWPDLRSLSGKKMTTPPPPPVEKQQQQARPAAVAPPDQTLEFSDGLLLRVLACLPEPHLTGAASLVCRRWMRLAGRLRRRLVVRDWAFVTHRLHHRFPELADLDLFPASIVAPAVPSPTSPLLTCAEVSLTLDTGADPPLGACRFLADDVLDRGLVAVAASFPNLRRLSATAASESGGLMDIAGGCATLQELELHRCTDLALRPVSAFAHLQILRLVAASSALYGTSEDGGVTDIGLTILAHGCKRLVKLELVGCEGSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCSVRRYNACKLQCMDPSMFGVSMPLLLLWRVKFLSLEGCSQLTTRGLESVITSWSDLQSLKVVSCDKIKDEEISPALSELFSTFKELKWRPDNKSRLAASLAGTGMGKKGRVLCKRQILPGHQRVKGTMLNYSTVLVQLREREMKGKGQRTDAGAQLSTNRARMSVKGRAPPPEEGKKNGEKMAAAAAVPIPIPCVAEPTAASRVSPGSSPARSDASEGAAFYAADTEAEPEASVGRSTQMLLAMAAMGGRGGPYGRRPASSYGSCAAWSAGSLTDHRPASPSPICSPVSSNGGEGCRDVERTNPVPPRFIHKATPARLMRRACSSHNYRRRLGAMDAINEWRLPKVSEEEDEAVDQTNWQADTLSSRISSARDWNFEAGGAYEGSDHNGGAFNHSDGENSPVAVQRMGRWPQXSAVKHKENFIHAKLVAWKNAEIEKLIDKLRRKEADIDEWQMNQVTQAKEKMKRIEIKLEKKRARAAEKMQKAIKDAQKKADKKKIKEHAATDNQIASVERAMVKMSRTGKLPWFLEVFVCPSNCNQNNSSALSTIPMRSGEGRDCEVPGSTAVQGTNVPTISQEQDRSVYKELRSQNEEFFELFMLKVSLKRQIDRVNHHLALCRKLWRQANESAGGHRCGNSSCSGGHRHRAVAVPVPHAEATPRAMPSTPLAVPLPATAMAQRTQCNLARMPRPQQPNCGGRPGSSRGGAVGLSAAGRMLETPGQPHVAPNGWPAGHGHPASGTLAAAMACSSRPVARQQGNRREQGWDAHQAQVGAQHQNLQRFPPQQGGGNIGERQGQGQFRPGTPSYVQEQRPPPQSSSSHEALQAGERQQANNNSSGSSRQQRQTDTATVASRREPMSK

SEQ ID NO: 13668 - protein, 215 aa, Triticum aestivum
  misc_feature (92)..(92): Xaa can be any naturally occurring amino acid
  misc_feature (116)..(116): Xaa can be any naturally occurring amino acid
  misc_feature (151)..(151): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPWGTTMAGYWXTMWKLPMFGCTDATQVINEVEEVKKEYPDAYVPHXSGFDNMRQVQCVKLHRPSSHRGCEESGKAKQLTHHGPHIKCHCGFVNSDIASGLLSPFIFLVCS

SEQ ID NO: 13669 - protein, 516 aa, Candidatus Protochlamydia amoebophila UWE25
MHNSHYFVNPLNEPNRPIKIPESCILVIFGATGDLTARKLIPALYNLARDGQLPGHFACVGFARRAKTHDEFREEMLEAVNKFSRSKPVEQGLWKRFREQLFYHQSEFDDDEGYKSLNQFLEKLDTQMGTKGNRVFYLSIQPSYFPLVVEKLSQHQLTYPVKQVKDKWSRVIIEKPFGRDIESAKQLQQDLVQHLDESQIYRIDHYLGKETVQNLLVFRFGNPIFESVWNNHHIDNIQITVGEEIGIGSRGRFWEEAGMLRDIVQNHVMQLLSLVAMEPPTSLQANSVRGEKVKVIEAIRPIPFDSMEQCVIRGQYGSGFINGEPVKGYRDEENVDSKSFVETYVALQLSIDNWRWAGVPFYLRAGKRLPKRATEIAITFKKAPGYLFEGTSALIDSNVLVIRIQPDEGISLRINCKVPALNTVIQPVKMDFRYGSYFGAIPPEAYERLICDCMAGDNTLFARDDEVIMSWKLLTPILEHWQETSPTDFPNYAAGTWGPDRAEEMLKRQGRHWRLI

SEQ ID NO: 13670 - protein, 260 aa, Silicibacter pomeroyi DSS-3
MDPDLIRFVAEESLRIVQRYLFFAAGAFALFYLLLRRLMWPRKIQKRWPRLTDYGRDLAFSLISVGIFAVISSLIFFVFRDQTSIYGGSMGSRGWGYLVFTFVWMLALHDTYFYWIHRLMHTRVLYRHVHLVHHHSTNPSPWTAYAFHPVEAVLEVGILPLIAFTLPVHWAAVMYFFIFQIAYNVYGHLGFELYPRGFHKHWLGRWINTSVAHNQHHGRFTGNYGLYFLFWDRVMGTLRADYDAAYEGATGAAAPVTATK

SEQ ID NO: 13671 - protein, 252 aa, Zea mays
MYMTITLRPCSVVPDWSPGLIFSRITSLKKKKKKKKKKKKKKKKKKKKKKKKERGAARSCAPPRSPRSCGNMGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATTGEGLYEGLDWLSNNIANKA

SEQ ID NO: 13672 - protein, 384 aa, Oryza sativa Japonica Group
MDAKKPYVIVIVIQLINTGLFVISKAAFNHGMNTFVFIFYRQAAASLLLLPLAIVLERRNAPPMSLRLFTKLFLYALLGNTLSLNMYNLGLKYTSPTVASATTNSIPVVTFFFALLLRRAQSIIHLWVEVIRLKSLSGAAKMAGVVLCVGGVLAIALYAGPAISPVNHHRAFGGGGGGGHESASATTRTRWVKGTLLMLLSNATWSLWTVLMASLLREYPSKLLATAAQCALSAAQSLALAAAAAGRDPAAWRLRPDAGLLAVAYSAVAVTGASLYMQAWCIEKKGPVFLAMSNPLSFVFTIFCALFVLGEVVHLGSVVGGVLMVVGLYSVLWGKSKEHDTLTLATAMPTPASVQQQEKKVAAVPAPADSSSSDSEQERLASIA

SEQ ID NO: 13673 - protein, 320 aa, Glycine max
MVSSNGLATSQPLFSFGLISDVQYADIPDGRSFLGVPRYYRHSLLILQRAVKEWNTHQKHKFVINFGDFVDGFCPKDQSLDTVKKVVDEFEMFTGGPVYHMIGNHCLYNLPRSKLPSLLKIHTLDGRAYYDFSPVPEYRFVVLDAYDISAIGWPQDHPKTLEALKILREKNPNEDKNSPTNLEGPERRFVMFNGAVGKEQVEWLDGVLLESTNLKQKVVVCCHLPLHPGAATEETLLWNYDEVMNLIHRYNCVKVCLAGHDHKGGYSIDSHGIHHRVFEAALECPPGTDAFGYIDVYDDRISLVGTDRMKSTEMDFTPPS

SEQ ID NO: 13674 - protein, 347 aa, Staphylococcus aureus subsp. aureus COL
MKALKLYGVEDLRYEDNEKPVIESANDVIIKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 13675 - protein, 166 aa, Arabidopsis thaliana
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGNNGETTTQGFDDLVKRCAKYYEAGARFAKWRAVLKIGATEPSQLSIDQNAQGL

SEQ ID NO: 13676 - protein, 310 aa, Oryza sativa
  misc_feature (29)..(29): Xaa can be any naturally occurring amino acid
MDRYQRVEKPRPEAAVISENEIRITTQGXLIRNYVTYATSLLQEKRVKEIVLKAMGQAISKTVAIAEIIKKRIPGLHQDTSISSVSITDVWEPIEEGLVPLEMTRHVSMISISLSPKELNKSSAGYQAPLHAEPIKPQRYQQTQQYQQQQHQSRPSQVQTDSYGRGRGRGRGRGRGWGGRGGYGGGYGGYDNNQGGYGGYGHQGGYGHQGGYGNQGGYGHNQGGYGGYGYNQGGYGGYENGGWNYNRNRGGGGGGGRGRGNWGYGGPGGYERSGPAYERGGRGGGSPGGRGYARGRGRMGGGRGRGNQNY

SEQ ID NO: 13677 - protein, 630 aa, Oryza sativa Indica Group
MAGQRSDSQSDESFEYMLLERDPDLYRTVFSGPSQISPWIDPSVLTLQHRIGRGPFGDVWIATHHQRTEDHDRYHEVAVKMLHPIREDQLQAFSVRFDEIFSKCQGLSNVCFLHGISTQNGRICIAMKFYEGSIGDKMARLKGGRIPLSDVLRYGADLARGIIDLHSRGILILNLKPCNFLLDEHDHAVLGDFGIPSLLFGLSLPNPDLIQRLGTPNYMAPEQWQPSIRGPISYETDSWGFACSILEMLNGIQPWRGKSPDEVYQLVVLKKEKPIFPYNLPPAIENVLSGCFEYDFRDRPQMTDILDAFESAKDVDYENTDQGNSENLRMVSPALPSRTNWSFFKDKLQVGDKVRSRKLKNTCSPTTMEVPDGTIVGMEDNGERDGYILVRIHGLHDPLKVRSSTVERVTYGFAAGDWVRLREDEKKRSQVGILHSIDRSGTVYVGLIGVDTLWKGEYSDLQMAEAYCVGQFVRLKANISSPQFEWQRKRGGGLATGRISQILPNGCLVIKFPGKFNLGEVCSCLADPSEVEVVSFDKCEGIVKKYEHLEDFHWAVRPLFIAVGFFTALKLGIFVGKGIARPRSRKVASVSDQSDHQQLQQQEVQNNANAAWLPPTVANMLFRDGPTLSG

SEQ ID NO: 13678 - protein, 417 aa, Rubrobacter xylanophilus DSM 9941
MPVEIRVPELGESVTDATVGRWLKKEGEAVKSGEPIVEVETDKINFEIEAEQDGVLESIAKGEGETVGVGDVIGTIAEGDGRAAAAAEEEEEPEEREEAPAAEAPAGREEAAEEGFRASPSVRRLAQEYGVDLAEVSGTGSGGRITREDVERLIRERSRPPAAPEEDGRREERPAPPPERAPGREALEERVRFSRRRQTIAQRLVESQRNAAMLTTFNEVDMSAVMDLRRRRKESFQERTGARLGFMSFFTKASVAALKAFPQVNAELAGNELVLKKYYDIGVAVSTDEGLVVPVVRDADRKSFAEIEKEIADLAVRAREGRLTLEDLRGGTFTITNGGVFGSLLSTPILTLPQVAILGMHKVQERPVVVDGEIQVRPMMYVALSYDHRVIDGAEAVSFLVRIKELVEDPETLLLEG

SEQ ID NO: 13679 - protein, 440 aa, uncultured marine bacterium 580
MSSEQILIPDIGDFDSVDVIEVLVNVGDSIEYDTPLITVESDKASMDIPAPKDGVIKDIKIKVGDKVKEGSLIGMIEVSEPKLDVKSEIKSSPKDDKKEDIEKVTNTPSRPAPEPPQKKVAKETPIPIGESVLNDENKKAHASPSVRKFARNLGVNLSFVNGSGNKNRILIEDIERFVKGELTKPRSENMGASFAPIPMPNIDFSEFGKVETKSLSKIKKLSGANLHRNWVTAPHVTQFDNADITDLEIFRKSMQKEAEKRGAKLTLLAFLIKASVNALKAYPMFNSSLSPDGNNLIMKSYYNIGFACDTPDGLVVPVVKDVQKKDVIDIAEDLGNLSEKARARKLKMDEMQGGCFTISSLGGIGGTKFTPIINCPEVAILGVSRASMQPVFNKSSEDFEARLMLPLSLSYDHRVVDGADGARFTSHLCMMLSDVRRLLL

SEQ ID NO: 13680 - protein, 580 aa, uncultured marine bacterium 580
MAELKKIHIPNIGDFDSVEVIEVMVKVGDKINIEDSLITVESDKASMDIPSPASGLIKSIDIKVGDEVKEGSLILSIDSEIEDSSGEKAPEEKKQATQKKEVQPAPQGDKSDEEYDVAVLGSGPGGYTAAFRAADLGLKVALVEKYTTIGGVCLNVGCIPSKALLHTAKVITDAEDTASHGVSFTQPKIDLEQLRNWKSNKVVKKLTMGLSQMAKQREVEVIEGEGKFSSPNQIIVNLKDGTKKSIGFKSAIIAAGSQSSKIPNTPDDERIMDSTGALELRDIPKKLLIIGGGIIGLEMGTVYDALGSEVSVVELSDGLIQGCDRDIVKPLHRRMEKRFEDIWLKTKVTKIETIKEGVVVHFEGDDAPEKLTFDRVLVAVGRKPNGHKIDAEKAGVKVDEHGFINVNKQMKTNVDHIYAIGDIIGQPMLAHKATHEGKVAAEVIAGEKVEFQAMTIPSVAYTDPEIAWAGVTEEDAKTQNLEIEKSVFPWAASGRAISTNRTEGMTKLIFDKKTQRIIGAGIVGTNAGELIAETVLSIEMGADAHDIGLSIHPHPTLSESVAMASEIKEGTITDLFIKKR

SEQ ID NO: 13681 - protein, 321 aa, Cleome spinosa
MSRPSSRVESFVQTEINWDKLDKTKFYVVGAGLFTGVTVALYPVSVVKTRLQVASKDVAERNAFSVVKGLLKNEGIPGLYRGFGTVITGAIPARIIFLTALETTKIAAFKLVEPFKFSEPTQAAIANGIAGMTASLFSQAVFVPIDVVSQKLMVQGFSGHATYTGGLDVVRKVMKSDGVRGLYRGFGLSVMTYSPSSAAWWASYGSSQRLIWRFLGYGGESEVAAPSQSKIVLVQACGGIIAGATASSITTPLDTIKTRLQVMGHQEERLSARQVVKNLIAEDGWKGLYRGLGPRFFSMSAWGTSMILTYEYLKRLCAKDE

SEQ ID NO: 13682 - protein, 190 aa, Triticum aestivum
  misc_feature (68)..(68): Xaa can be any naturally occurring amino acid
  misc_feature (145)..(145): Xaa can be any naturally occurring amino acid
MAAVWMALAVMLVAAAQVAVAAPVTAPAFLWAPKNYGLSPNEVKEVVHYQTISPKSLADSVLEEGGWXSNLVCSKDGPQKNVDVAVLFLGSKLQSSDISKDKQVDPALADILKLSFSSSEFSMAFPYVAMSDDEALENSLLSGLXENWEDGSGGNHIHVPGPGSESSESGKKTSEPGILVQELGGNPRKG

SEQ ID NO: 13683 - protein, 482 aa, Zea mays
  misc_feature (78)..(78): Xaa can be any naturally occurring amino acid
MATVAPVVSDLVDFLNASPTAFHAVDEAKRRLKAAGFVQLSEREEWAGLEPGRKYFFTRNHSTIVAFAIGANLCVNVXRYVAGNGFHIIGAHTDSPCLKLKPVSKVTKGGYLEVGVQTYGGGLWYTWFDRDLTVAGRVIIREKKDGVVSYAHKLVRVQEPIMRIPTLAIHLDRTISSEGLKVNNQSHLVPVLATCIKNEMQKFVADNGPKQASENANTKHHPLLLQLIAKEANCEPGEICDFELQLCDTQPSVVAGATKEFIFSGRLDNLCMSFCSLKALIDSSSVEHSLDHESGVRMVALFDHEEVGSDSAQGAGSPAMLDALSRITGSFNSSGSKLLEKAIQRSFLVSADMAHALHPNYMDKHEENHQPKLHGGLVIKHNANQRYATNAVTAFIFREIAERHQLPIQDFVVRNDMACGSTIGPILASGVGIRTVDIGAPQLSMHSIREMCAADDISYSYEHFKAYFEEFTELDGKVKVDY

SEQ ID NO: 13684 - protein, 333 aa, Frankia sp. CcI3
MGTGTGENQADTRPPGAVASPDGPPPLRAAAERPGVVQFRMNSCRAAGFLSCRRVTTGRRHDRPRAGESQATTGNAGRAGRRAGRISGMPTLVLLRHGESIWNRENLFTGWVDVDLSEKGAKEATRGGELLRESGVLPDVVHTSLLTRAIRTAWLALDAAGRTWVPVRRTWRLNERHYGGLQGLNKAETLEKFGAEQFQLWRRSYDTPPPEIGPEQVSGVDERYDDLAPDVIPRTECLADVVARMLPYWYDAIVPDLRTGRTVLVAAHGNSLRALVKHLDHISDTDIAGLNIPTGIPLRYELDDQLGVVSSGYLDPDAAALAAAAVAAQGTKK

SEQ ID NO: 13685 - protein, 500 aa, Streptococcus mutans UA159
MNKRVKIVATLGPAVEIRGGKKFGEDGYWGEKLDVEASAAKIAELITEGANVFRFNFSHGDHAEQGERMATVRRAEELARQKVGFLLDTKGPEMRTELFADGVKEYEYKTGDKLRIATKQGIESTKDVIALNVAGGLDIYDDVAVGQTILIDDGKLGLTVTAKDITTREFEVTVENDGIIAKQKGVNIPNTKIPFPALAERDNADIRFGLEQGLNFIAISFVRTAKDVNEVRQICKETGNEHVKLFAKIENQQGIDNIDEIIDAADGIMIARGDMGIEVPFEMVPVYQKMIITKVNAAGKSAITATNMLETMTDKPRATRSEVSDVFNAVIDGTDATMLSGESANGKYPVEAVRTMATIDKNAQTLLNEYGRLNSDNLPRTNKTEVVASAVKDATKSMDIKLVVTITESGNTARLISKYRPDADILALTFDEKVQKSLMINWGVIPILTEKPASTDDMFEIAEKAALKSGLVESGDNIVIVAGVPVGSGGTNTMRVRTVQ

SEQ ID NO: 13686 - protein, 370 aa, Silicibacter pomeroyi DSS-3
MRTRAAVAVEAGKPLEVMEVNLEGPKAGEVLVEIKATGICHTDEFTLSGADPEGLFPAILGHEGAGIVLEVGEGVTSLKPGDHVIPLYTPECRQCEYCLSGKTNLCQAIRTTQGKGLMPDGTTRFSMLDGTPILHYMGCSTFSNHTVLPEIALAKVRPDAPFDKICYIGCGVTTGIGAVINTAKAEIGCRAVVFGLGGIGLNVIQGLRLAGADQIVGVDLNPDKVAMATRFGMTDFVNPAEVEGDMVAHLVELTRGGADYSFDATGNVGVMRTALECAHKGWGESIIIGVAPAGAEISTRPFQLVTGRVWKGTAFGGAKGRTDVPRIVDWYMDGKIEIDPMITHTLSLDEINKGFDLMHAGESIRSVVVY

SEQ ID NO: 13687 - protein, 546 aa, Yarrowia lipolytica CLIB122
MIIAKFSRKINPLHRSKRHDRNPPSDGRLPGISLEDVSQVAPAPPPKDHRYSRKSMDEDSNERRRLRHLSPFRSSEKRASGEYLRQAEKPKTRGAGERRPGSQTATPSPPPVPHTNPNPNNRASLDMNRPDLPDRGPPKPSRPATDDSAVSNASYSTVSTSFGAGHSQSPSYPNPGSPNRGSPNMGHRRGSPKSSPKMGSPNMVHPNLVHPNPGYPNGGRPIQIPGQHQQYPSPGQIPSPGSAGAKTTVKSPLMRPDSPDQPVPDMTDFNRSFHVQNPGKVTCGFEDIFLPVDVEKQEHHRLEHLQFRHEDSLKLHHTLQKQLYNKPGDVVLEFYDVTVYKEDIDNLQPGYWLNDNNISFVYEYLERLEIMRAGFQSQIFLLRPSMAFLLGQGDPKEVAEFLPDFKHASFIFLPINDNNNVEIVSGNHWSLLVVSVEDGKAIYYDTVGECNIAAARNVADKLGVVLGQKLNFLVAPTPQQSNGSDCGVYVCEITSLLLRRLLYTEGFIDLGISNLTFVADAGRTFILTAILQLISMFGPKIRERIE

SEQ ID NO: 13688 - protein, 178 aa, Triticum aestivum
  misc_feature (31)..(31): Xaa can be any naturally occurring amino acid
  misc_feature (60)..(60): Xaa can be any naturally occurring amino acid
  misc_feature (105)..(105): Xaa can be any naturally occurring amino acid
  misc_feature (111)..(111): Xaa can be any naturally occurring amino acid
MMKMEDFIKNGVYDSSAGLCGDGSQHLHVVXVDRSPLFFYRDASSRRIIIVGRGGTTREXTPQVSSTYDGGHNAVIIARNSKAAILLHRMLLSSFPPQKDVLGSXYMVGDXLIISDGGLQIIDDVEVLPAPAEMKAPHQFFGGDVSFIISSSGGAAPKVLDDESPSMDASAAGLKKGV

SEQ ID NO: 13689 - protein, 602 aa, Aspergillus oryzae
MNMKYFCDHCLILSGFSGWWVSLSTLSVSAKTLNYEWNITWVLANPDGLQERPVIGINGQWPLPVLNLTLGDRVIAKVYNALGNESTSIHWHGFFQNGTTHMDGAPSVTQCDIAPGSTFVYNFTVNQTGTYWYHSHARGQYPDGLRQALVIRGPDEPYSGQYDEERVITLSEWYHDPMPTLLKQFISVTNPTGAEPVPKSALMNDTQNLTIAVEPGKTYLFRLVNVAAFASQYFWIEDHTMKIVEVDGVWTEPAEASMIYITAAQRYSFLVTMKNDTNKNYAIVGSMDTDLFDTLPPTLNYNVTGWLVYDNKAERPAPTDISSFDPYDDFKLVPVDGERLLGDPDYTVTLDLTMDNLGDGANYAFFNGITYVMPKVPTLYTALSTGSAATNSTVYGYNTNAFILDKGDVIDLVLNNDDTGKHPFHLHGHNFQVVARSDEDAGHYDANNHSAFPSVPMRRDTIYVKPTGYFVIRFRADNPGVWIFHCHIEWHMDAGLAVVLIEAPLDLQQTLAIPEDHWQACDASDTLKRGNAAGNTKDFYDLTGANTSVSPLPAGFTARGIVALVFSCIAAILGLISIVWYGMAPITVKQSSTDERREVDSN

SEQ ID NO: 13690 - protein, 438 aa, Bacillus pumilus SAFR-032
MNIDVLKETIETADPYKRFGKVNRVVGLMIESKGPESSIGDVCLIHKKGRKHDPIKAEVVGFRDEHILLMPYVEASNISPGSLVEATGESLKVKVGTGLIGEVVDAFGEPLDGSMLPKGLAPVSTDQSPPNPMDRPPIREKMGVGVRVIDSLLTVGTGQRIGIFAGSGVGKSTLMGMIAKQTEADLNVIALVGERGREVREFIEKDLGTEGLKRSIVVVATSDQPALTRMKAAYTATAIAEYFRDRGKNVMFMMDSVTRVAMAQREIGLATGEPPTTKGYTPSVFAILPKLLERTGTNQLGSITAFYTVLVDGDDMNEPIADTVRGILDGHIVLDRALANKGQFPAVNILKSISRVMSNIASHDHKEAANRFRQLLSTYQNAEDLINIGAYKKGSSKDIDDAMQAYPHLISFLKQDVEEAVSIEDSVNVLLGLMNRED

SEQ ID NO: 13691 - protein, 247 aa, Hyphomonas neptunium ATCC 15444
MARNLFDLTGKVALVTGGSRGLGFEMVKAFAENGADVIIASRKLDACEAAAEEVRKLGRKAFAFAAHCGRWDDIDALIEASYGHFGRVDILVNNAGSGPRMASDEVTENLFDSVLNLNFKGPFRLASQVAKRMADGDGGSIINISSSGSLVPLPHVVPYGSAKAAINAMSLSLAHEYAPKVRVNTICPGPFLTDIAKAWPEQMRQSADNALGRPGYPEEIVTAALYLASPASSFTTGSLLRVDGSAA

SEQ ID NO: 13692 - protein, 320 aa, Silicibacter pomeroyi DSS-3
MSIAVLGSGAFGTALAISLAGKGPVTLWSRAPEQARQMQETRENHQRLPGLPLPAALNVTADLDQATRCDTLLLAVPMQKLRGMLSEHAAALHGRVLVACCKGIELNSGLGPMAVMAETLPGTRTALLTGPSFAQDIARGLPTALTLACADPDLGRDLQAQLTTTNLRLYRTTDTIGAELGGALKNVIAIGCGACIGAGMGDSARAALLTRGFAEMQRLAALKGARPETLMGLSGLGDLMLTCSSDLSRNYRFGLALGRQEPFDRATTVEGVATAHAVAQLARDLGIDMPISTTVAQLSNGDYSVAEAMRSLLNRPLKEE

SEQ ID NO: 13693 - protein, 144 aa, Hyphomonas neptunium ATCC 15444
MGTQETAGLGRLNAESPRWHSGGCHCRAVRFEVQLPEAFEVEDCNCTMCAMSGNIHVIVPASRFRLLQGKDNLSQYTFNTGAAKHLFCKTCGIKSFYIPRSNPDGVAVTWRALDDWMDLKVTVVPFDGQNWEANAARLAHKSKD

SEQ ID NO: 13694 - protein, 504 aa, Cucumis sativus
MDMNVPNYKLGKTLGIGSFGKVKIAEHALTGHKVAIKILNRRKIKNLDMEEKVRREIKILRLFMHPHIIRLYEVIETPSDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSSGARELIPSMLVVDPMKRITIPEIRQHPWFQAHLPRYLAVPPPDTMQQAKKIDEDILQEVVKMGFDRNQLVESLRNRIQNEATVAYYLLLDNRFRVSSGYLGAEFQETMETGFNRMHPSDPTNPAVGHRLPGYMDYQGMGLRAQFPVERKWALGLQSRAHPREIMTEVLKALRELNVAWKKIGHYNMKCRWLPGIPGHHEGMINNPVHSNHYFGDKSTIIENDGVVKSPNVIKFEVQLYKTREEKYLLDLQRVQGPQFLFLDLCAAFLAQLRVL

SEQ ID NO: 13695 - protein, 377 aa, Triticum aestivum
HYRTSLYKKAGWYRSGIPGISSTHASALRANKLRSYVDQMVAEAEEYFSKWGESGTVDLKYELEHLIILTASRCLGREVREKLFDDVSALFHDLDNGMQPISVIFPYLPIPAHRRRDQARTRLAEIFATIIKSRKASGQSEEDMLQCFIDSKYKNGRQTTESEVTGLLIAALFAGQHTSSITSTWTGAYLLKFQQYFAEAVEEQKEVMKRHGDKIDHDILAEMDVLYRCIKEALRLHPPLIMLLRQSHSDFSVTTREGKEFDIPKGHIVATSPAFANRLPHIFKNPDSYDPDRFAAGREEDKVAGAFSYISFGGGRHGCLGEPFAYLQIKAIWTHLLRNFEFELVSPFPENDWNAMVVGIKGEVMVSYKRRKLVVDN

SEQ ID NO: 13696 - protein, 375 aa, Solanum lycopersicum
MACCFPVILDRSMRSSFKLSKSSSSSKLDKSKSSICSPTSLSTKKKSIQENDNLVVCFGELLIDFVPTVSGVSLAEAPGFKKAPGGAPANVAVGIARLGGSSAFIGKVGADEFGYMLADILKQNNVDNSGMRFDTHARTALAFVTLKSDGEREFMFFRNPSADMLLTEAELDKNLIQKARIFHYGSISLIAEPCRSAHLAAMETAKNAGCILSYDPNLRLPLWPSEEAAREGILSIWDQADIIKVSEDEITFLTNGEDAYDDNVVMTKLFHSNLKLLLVTEGGDGCRYYTNNFHGRVSGVKVAAVDTTGAGDAFVGGLLNSMASDPDIYMDEKKLRDALLFANGCGAITVTEKGAIPALPTKEAVLKILDGATAN

SEQ ID NO: 13697 - protein, 412 aa, Kluyveromyces lactis NRRL Y-1140
MGSKRAFTEVGVSAYHDEPSVAVSSFFKGFQAPKDTTFELYKNKKNSDKYVLHGENDRLEYEGQTDDDFVNSSQYVVGVYDAATKSVELYKAPLVSSKVLSKSRKNLMGPDIKQANVRAALMRNALGEAFGTKKAKKAIADMERNRIDSDKLVDSAIDIVDTVKTASKELPSKEELQETVSSDRPTPLADLDATDVEQIYPLYNIIPKKEWSFIRVGSIMKEQDPEKRLEYFPYTKFQYVANKLPTLTQAAQMQKLQLLYYLSLLAGVYDNRRVNNKTKLLERINNPPDALLNGILERFTISRPGQFGRSKDKSFFIDPQREDKLLCYILVIIMHLDNFIVEVPPLAQQLNLKPSKLVSLFKILGATVKGATVAQAEAFGIPKSSASTYKIATLKVPFKLPEMIRRGKGPRR

SEQ ID NO: 13698 - protein, 158 aa, Buchnera aphidicola str. APS (Acyrthosiphon pisum)
MRRILSILLENESGALSRVIGLFSQRGYNIETITLAPTEDPTLSKMTIQTVGNEKAIEQIEKQLHKLIDVLRVVQIGQSSHIEREIVLLKVQINNHRRDDIKHITEVFRGQIVDITSATYILQLSGTTKKIDAFLKIIRNFSEIIEVTRSGIVGISRG

SEQ ID NO: 13699 - protein, 460 aa, Coccidioides immitis RS
MGQTLSEPVVEKNSEEGSDECVIYGLSAMQGWRISMEDAHSAVLDLQAKYLAKDHHPTDPSKRLSFFGVYDGHGGEQMALYAGKNVSRIVTNQETFARGDIEQALKDGYLATDRAILEDPNYEEEVSGCTAAVAIVSKDKIRVANAGDSRSVLGVKGRAKPLSFDHKPQNEGEKARISAAGGFVDFGRVNGNLALSRALGDFEFKKSPDLSPEQQIVTAYPDVTTHEITEDDEFLVIACDGIWDCQSSQAVVEFVRRGIAAKQELHRICENLMDNCLASNSETGGVGCDNMTMIIVGFLNGKTKEEWYNMIAERVANNDGPCAPPEYAQFRGPGVRRQFDDSPDEYDPGLDSRPTGRSGRIILLGDGTELLTDMGDGEMFENGDRVSEQESTREVTSSVDEPRNERKGTPGPQTNHVAHSNGPSNGLTAEASTTEMNPPAPAGVEQSANASTTEEQPKTT

SEQ ID NO: 13700 - protein, 264 aa, Buchnera aphidicola str. APS (Acyrthosiphon pisum)
MSCIIKTESEIKKMRISGKLAAEVLEMIKEHLQPKISTEDINQICHDYIVYKKKAISACLGYHGFPKSICISINDVVCHGIPSKNQVFKEGDIVNIDIAIIKDGYHGDTSKMFYIGKTSILSKRLCQVARESLYLSLKLVKPGIPLYKIGEIIQNYVESNNFSVVKEYCGHGIGRNFHEEPHVLHYKNKKNNIILKKGMIFTIEPMINSGNPEVKCMKDGWTVKTKDRSLSAQYEHTVLVTEYGCDILTWQKDEDISQKLVNIN

SEQ ID NO: 13701 - protein, 334 aa, Haemophilus influenzae 86-028NP
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVASGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKEE

SEQ ID NO: 13702 - protein, 341 aa, Rubrobacter xylanophilus DSM 9941
MDKGQLESTARALVAPGKGILAADESFGTIGKRFKAVGIESTEDTRRRYRQMLFTTPGIGEFLSGVILFDETIRQKADDGRPLPRVLEDQGVIPGIKVDKSTTALPLSPQEKFTQGLDGLRERLEEYRGMGARFTKWRAVITIGEGIPTERCIGANAHGLALFAAFSQEAGLVPIVEPEVLIDGDHTIERCYEVTEWTLNRTFDYIYEMGVELSGMLLKPNMVISGKDCPEQAGVEEVARMTVECLKRSVPAAVPGIVFLSGGQSDIQATAHLNAMNRLYDDLPWELSFSYARALQGRPMEIWKGDDANVEAAQKAFYHRAKMNSAARSGSYSEEMEKEAA

SEQ ID NO: 13703 - protein, 305 aa, Triticum aestivum
MNGISSTHASVGMFVPWRILSVLGILPSALPSPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISAVGMTVSLLVVSVSFFVKDNIEEASHLHSVMSMLSLAGLVAFVLAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 13704 - protein, 304 aa, Staphylococcus aureus subsp. aureus COL
MTNKVVILGSTNVDQFLTVERYAQPGETLHVEEAQKAFGGGKGANQAIATARMQADTTFITKIGTDGVADFILEDFKVAHIDTSYIIKTAEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSIGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 13705 - protein, 248 aa, uncultured marine bacterium 580
MMDREVDLERRFGGIIRLYGEKKFRLIQNSHVCVVGIGGVGSWVVESLVRHGVGKITLIDMDHIVESNINRQIHALDSTDGESKIKAMKDRIIDINPTCLVDCIDDFLEESNIESHISSRFDFIIDAIDQSSVKTSLAEYCQSKNLSLIMVGGAGGRVDPARIKIADLSKTFGDPLLSNIRKHFNKKNKLLKSKYEIPTIFSDEPIIKPDACEVDQLGGGLSCDGYGSSLNITATMAFYVVAYIFSKI

SEQ ID NO: 13706 - protein, 126 aa, Brassica napus
  misc_feature (94)..(94): Xaa can be any naturally occurring amino acid
MADLLPPLAAAKIDAKTKVDEKVDYSNLPCPVSYDELNREAIMSLKADTFEGLRFDFAKGLNQKFSLCHSVMMGPTEVPSQSPDTTIKIPTAHXEFGANYYDPKLMLVGRVMTDGRVNARVKADLT

SEQ ID NO: 13707 - protein, 413 aa, Deinococcus radiodurans
MKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 13708 - protein, 267 aa, Frankia sp. CcI3
MVMIVAVMGAGRLGGAMLSGLLRSGHAAQDIVVAERDADRAGEIVARHGVEVQAPTVAAAKADVLIIGVKPQDVGTLLAEIGSVVANGTLVVSLAAGITTDLLEERLPSLPPVVRVMTNTPLLVGEAMSAICGGRYAEEKHLATAEALLTPVGRVTRVAESQLDAVTALSGSGPAYFFYLVDAMIEAGVLLGLPRTLAAELMTQTALGSARMLRESGEHPALLREAVTSPAGTTIAALRELDRRGVRAALMDALEAASSRSRELGRS

SEQ ID NO: 13709 - protein, 306 aa, Populus trichocarpa
MAAELLPPDGPITAAAATTNTTASAAIDPTTTATTTALALAESENHGPPPPIPKRQRRPSVRLGEIGDHHHQTAHDTHVRRSTKQLQQHHTWRLPKDSSKSIKARSLTHLVNGNSNEIEEHELPNNNQNGDLNLLEFGHGRKAKRGTTKRVRSNWISSNSRIDEGDTNLENSNGEEGFVREFDLDSDSPLKDQSPVHSVENVALDFWQGNRRTGTGSGRVRVTESRENEGIEMENDDNSERKWEGVRTWLIELGLSRYAPVFEIHEVDDQVLPLLTLEDLKDMGINAVGSRRKLYSAIQKLRKGFQ

SEQ ID NO: 13710 - protein, 306 aa, Vibrio campbellii AND4
MKPTAQILTDILAEVRPLIGQGKVADYIPALSKVSNNKLGIAVYTNQGEVIKAGDAEESFSIQSISKALSLTLAMCLYKQEEIWARVGKEPSGQAFNSMIQLEMEQGIPRNPFINAGAIVVADLLQSRLSAPRQRLLEFARQLSGDTHIVYDKVVAASEMMHGDRNAAIAYLMRSFGNFENEVIPVLQNYFHACALKMSCVDLAKTFSYLANKGTSVQTGKPVVLPQQAKQLNALLATCGLYDGAGEFAYRVGMPGKSGVGGGIIAIVPGEMTIAVWSPELDPSGNSLAGTKALELLAERIGRSIF

SEQ ID NO: 13711 - protein, 505 aa, Cleome spinosa
MEMWFFIAVSLSISLFLHAVFSLRRSPRRLPPGSHSAIPFVGTPQGLAGLVPHLRRLHRRLGPIVTVRINSRPAIFVSDRSLAHQALIQNGAVFSDRPPALPAGKVFSSNQHNISSASYGPTWRILRRNLTSEILHPSRLRSYSHARKWVLQILVDRFRTSGGQEPVVVVDHLHYAMSALVVLMCFGDKLDEKIIKQVESAHRKLLLSVSRFNILDVCPKITKFLFRKRWEEVLQLRRDQEALLLPLIRARRKIVEENARPGISDSDNKDYVVSYVDTLLDLELPDEKRKLDEGEMVTLCSEFLNGGTDSTATALQWIMANLVKYPEVQKRLHEEIKSVTGETGGEVKEDDLQKMPYLKAVVLEGLRRHPPGHLALPHRVTDETDLGGYSVPKNGTINFMIADMGRDPEVWEDPMAFKPERFVNGGDPIDITGSRGIKMIPFGAGRRICPALNLALLHLEYFVANLVAAFEWRAAENDDVDLSEKLEFTVVMKNPLKAHAVPRSL

SEQ ID NO: 13712 - protein, 388 aa, Pseudomonas aeruginosa
MNLHEYQGKQLFAEYGLPVSKGFAVDTPEEAAEACDKIGGSEWVVKAQVHAGGRGKAGGVKLVKSKEDAKAFAQQWLGKNLVTYQTDANGQPVSKILVESCTDIDKELYLGAVVDRSSRRIVFMASTEGGVDIEKVAHDTPEKILKATIDPLVGAQPYQGRELAFQLGLKGDQIKQFTHIFVGLAKLFQDYDLALLEVNPLVIKKDGNLHCLDAKINIDSNALYRQPKLRAMHDPSQDDAREAHAQKWELNYVALEGNIGCMVNGAGLAMGTMDIVNLHGGKPANFLDVGGGATKERVTEAFKIILSDSNVKAVLVNIFGGIVRCDMIAEGIIGAVKEVGVKVPVVVRLEGNNAELGAKVLAEKRPEHHRGNQPDRRCPASLKAAEGK

SEQ ID NO: 13713 - protein, 448 aa, Aspergillus oryzae
MAASQAANIVEKVVGHNDNATVTTDVSNYNKGAYGQETGEKIKATTWQGKNSVQIVEMPKPRVVDEGDVIVKVTGSTICGSDLHLYHGVIPQLEKGDVLGHEFCGVVESVGPTVKKVKAGDRVVAAFPIACGECRNCKEQLTSACERTNENSITNAMYGKRTAGMFGYSHFTGGFAGGQAEYVRVPYGDVNLLQLPADVPDEKGLYLSDVLATAYHCVVDTGVKKGDVVAIWGGGPIGQMAAEYSFSQGATRVILIDGGEGAWRLDFVTSKIPKLETIDFSNLPRGESITSQLKKIVPGGPDVALECAAGEYAKGWAHYFEMLLGMETDTSEILNEMITAVRPFGRIGVTGVYAGYTNHFNIGALMQTGIRFIGNGQAPVQKYWEHLLELIRRQEINPLDMVTHRVSLENMPELYAAFEGRDKGMQKVYVQTRFSSPPAEGSPQLTEL

SEQ ID NO: 13714 - protein, 542 aa, Aspergillus oryzae
MKPHELSQDKVFVSAFVTEPSEVHVQIGPAFDMTKRSVLDLRDSAMAYRLSAQLPEPSPATIATPVARSGPFAPEDYTKPYCEFMTANPTIFHAVDGFTRQLESQGYKRLPERETWNSKLEKGGKYYVTRNGSAFISFSIGRDYKSGNGMAIVAGHIDALTAKLKPVSKLPNKAGFSQLGVAPYAGALSDTWWDRDLSIGGRVLVQDSNTGKVESKLVKLDWPIARIPTLAPHFGAPSQGPFNKETQMVPIIGVDNSDLFQQQAPSKIDQDNGIKPGTFAATQPEKLVKVISKELGITDYSSIISWELELYDSQPAQVGGLDKDLIFAGRIDDKLCCYAAQEALLASSDSTSTSSIKMVGMFDDEEIGSLLRQGARSNFMSSVIERITEAFSPNYGPNVLSQTVANSFFVSSDVIHAVNPNFLGVYLENHAPRLNVGVAVSADSNGHMTTDSVSYGFIKRVADRCGSTLQVFQIRNDSRSGGTIGPMTSSRIGMRAIDVGIPQLSMHSIRATTGSLDPGLGVKLFKGFFDYFEEVDKEFADF

SEQ ID NO: 13715 - protein, 716 aa, Candida glabrata CBS 138
MSDISLAESIELNSSVPKDDQVFDDEIPDAEVQSEPSEEPPKLKRRLYLEEEDKTDEALSTFVNLEDCLYSNKHVGNCNSNDFMECDCYEDFQNGKNHACGEDSDCINRLTLIECVNDLCGTCGNDCANQRFQKKEYANIAVFKTKMKGYGVRAESDIEINDFIYEYKGEVIEEEEFRDRLVDYDQKKFRHFYFMMLQSGEFIDATIKGSLARFCNHSCNPNAYVNKWVVAGKLRMGIFAKRKILKGEEITFDYNVDRYGAAAQKCYCEEPNCIGFLGGKTQTDAASLLPQNVAEALGVKASEEKKWIKLKKAEGQKIEKSEAENINIEFLESITINPCNTATDVQKVMSVLLQIENKTVAQKLLQRLYLSSNEELLHHVIKLHGYTCFTKLLQLFALEEDELKKILYFLERLPKTTKNGIISSHIDFQVKSVCKNHSSLSSIGDSLIEKWKAYEEYKRITKLDINNSTKTKLQDIRRIKLPPGWEIVFENGRPMYYNAEKKTKLLYPPTGASKTFASQKSSSPIPKFKNKRDQNNGIKRKLTDEEYEERKRKRIELEQENIKKAKEEELQRLKAKFNQEREQKQILENIIAEANRKKEEERQNQLKIEKEKKDKKESKKQLSQISKMEHKWTKFFASVVPNILKKYESDKKIDHDNMKQCARDIVKILAAKEMKKDSSKEPEATVSKEKRHKIKQFVHGYMEKFLEKLDKKKQRH

SEQ ID NO: 13716 - protein, 444 aa, Pseudomonas syringae pv. syringae B728a
MEELSNLKKLESNARTYAATFQQLFVSGRGMRVKDANGQEYLDCLSNAGTLALGHNPPVVREAVIEFLNSDHLQQALDLATPAKHAFVEELFATLPASMRDNSKILFCGPSGSDAVEAAIKLARHYTQRSPLMSFHGGYHGMTAGALSAMGNLNPKAGLLAQGTHFLPFPYRFRCPFGTDGEHTDRLSIEYIRTVLSDPESGVPKPAAVVVEVIQGEGGCIAASAEWLRAVREITHELGILLIIDEVQTGLGRTGNLFAIEHSGITPDILVLSKAIGGGYPISVIVYAEHLDTWGPGMHAGTFRGNQVAMVAGAATMRHIKEHDLVGNATRRGEQLHSGLEDIARQFPFIGDVRGRGLMLGVEIVKPTNGSRPGAGDGARARAIKLECFNNGMIIETGGRNSAVLRFLPPLNITESEVGMILDRFEQSLKSSSAARVSSVSAVG

SEQ ID NO: 13717 - protein, 222 aa, Triticum aestivum
MGGKVLLISAVLVGLVSLSSCRSLGELHEQKTHYGGSPTPTHGSGGGYNPTPTPTYGTTPTPSYGTTPTPTYGTTPTPSYGTTPTPSYGTTPSTPSTPSHDVPASPKKHGFIGSCDYWKNHPDAIVAAIGSLGNIGKTFGAACSMIGGKKLGNMHDALSNTRTDGIGALIREGAAAYLNSIVNKKFPFTTQQVKDCIVVAVTSDGAASAQAGVFKKANEFHY

SEQ ID NO: 13718 - protein, 62 aa, Brassica napus
MRGILADWLVEVSEEYTLVPDTLYLTVYLIDWFLHGNHIERQNLQLLGITCMLIASKYEEIY

SEQ ID NO: 13719 - protein, 118 aa, Brassica napus
MATISAAITTPSITRACLVQKRSLGFSSPVLGLPAMGKVGRVSCSMEEKPSSVKESSSSMLGMGASLMAAASAAAMSGPAMALVDERLSTEGTGLPFGLSNNLLGWILFGVFGLIWAL

SEQ ID NO: 13720 - protein, 1114 aa, Ustilago maydis 521
MPPPPSSTHNPSANGGIRNAAPSSSAMASSAPQSVNEPSPSSSVKLDNQKHAAYKLPSRPTHLQAPSGANQPQRRQWPQPSSAAQNGNSFNSVAPSSRHDYDDEDEDEEGAIDDSATSKPAANLLSSFRPAPPKTPPYPSNSQPAHEEHRGNDRFQPSDARKDQNHSSSYQLRSPSPPRRSQQSTTTSRAHVAHLRSPSPPESSSRRPGRDHDNGMTRISTNDRYHRGDPHLYHPSASELRSKDDRHDAAGSHMWDRAKQDLKRASNDDWRREDRGWNHDRRAGAGARGGGGGGGGGGGGGGGGGGGGGGARSWDREYDRRYDRNERDRDRPRTHSRYHDPRDELPREKPSNRNGRDKELSPHTAGTEQQYAGWSPTPPQGQPADPLSNGNNGEPFANRPPSRMGRAAPPPLLSNIDHPPTFNANRDLDSSLAKRARSRSPPAGLLKRKANFNAVMPPALAPVNPDASAPAESENVTPGAPLPPKVETLQSPSMPASRLGSESVAATAALGSLPGSAIATAASSGAATATFPTAASGGSVAVPADANFNATCQALDDFTLPSVRLSCLPRKLPDRPSTSGRERRKARGPPVPLNQRKFVGCSSLDDYEISIKLGQGTFGEVLKGRQILTGTQVALKKVTIHDAKDGLPITALREIKLLKKLRHPSVVPVIDMAFRPSGERGKLGDVYMVEPYMDHDLNGMLENPSIRLEHSQIKLYMKQLLEGTLYLHKNRILHRDMKAANLLIDNQGQLQIADFGLARPYRDPGQSWTGKGWTAGTHRYTNMVVTRWYRPPELLAGEKKYGPPIDMWGIGCILAEMITGRPLFKGTSEINQLELIAKLCGSPNETNFPGWSSLPGVKDADPTGRPDPHPEIPGQHAFGDYPRKVKDHFRSVYDAGPGCADLIDKLLVLDPRKRLTAQQALEHEWFWTKPYPADPKSLPKYEHSKEIDRARRDWKPAPAAAAAAPGGGGMAAATMARPRPAMQQLPYIAGAPQQRAYNRPAGFAQSAGYAMPATGMPTPDATDTWDARAAPPPMAGGGARHAFPHPQGGARFTHPNTRPAHHAHPQQPQQPQQAQQAHAYYPNHREPAQQRQQHSLPQRPVGPPRASGGNPYSM

SEQ ID NO: 13721 - protein, 419 aa, Dehalococcoides ethenogenes 195
MYELSVLPSGLRVISHHMPASRSVTICVYIGVGSRYETDCEAGASHFIEHMVFRGSKKYPDSQLISSAIEGVGGILNAATDRESTLYYAKVGSDKFALALDVLSDMLVTPLFNPEDLEKERKVIYEEISMSLDNPSHRVGLLLDEILWPDHPLGRDIAGSRQSVAGLDSQKLLDFMHRHYTPANIVVAVAGDIKHKNAVSAISQAFGGLAGQQKVQTFEPYHSGNPCQVGVDKRDAEQINLMLAMPGMNRLDERRYAFSILNTILGDGMSSRLFARVRDNLGLAYSVQSGLEYLHDTGAFSVFAAVDPANLTACIKAVLSELETAKTTITAEELTKAKEMSKGRIQLAMEDSRYMAKWIGSQELLCQRVNTHEDVIRLIDGVSLKGVMQLAGEYFQKPQMRLALVGPVDKDAVACLLKD

SEQ ID NO: 13722 - protein, 107 aa, Streptococcus pyogenes
MTQVFQGRSFLAEKDFTRAELEYLIDFSAHLKDLKKRGVPHHYLEGKNIALLFEKTSTRTRAAFTTAAIDLGAHPEYLGANDIQLGKKESTEDTAKVLGRMFDGIEF

SEQ ID NO: 13723 - protein, 284 aa, Triticum aestivum
  misc_feature (172)..(172): Xaa can be any naturally occurring amino acid
  misc_feature (177)..(177): Xaa can be any naturally occurring amino acid
  misc_feature (192)..(192): Xaa can be any naturally occurring amino acid
  misc_feature (231)..(231): Xaa can be any naturally occurring amino acid
  misc_feature (239)..(239): Xaa can be any naturally occurring amino acid
  misc_feature (248)..(248): Xaa can be any naturally occurring amino acid
  misc_feature (252)..(252): Xaa can be any naturally occurring amino acid
  misc_feature (260)..(260): Xaa can be any naturally occurring amino acid
MAPLGDAVAPEVAAAAPGLVVSFGEMLIDFVPDVAGVSLAESGGFVKAPGGAPANVACAISKLGGSSVFIGKFGDYKFGHMLVEILKKNGVNAKGCLFDQNARTALAFVTLKSNGEREFMFYRNPSDDMLLTEAELNLDLIRRARIFHYGSISLITEPCRSEHVAAMRAVKXTGILXSYDPNVRLPLWTSAXADRDGIMSIWKDADFIKVSDDEVVFLTQGDRTEEKNVLXSFWLEGLXLLMVTDGEXGVRXFTKGFKGXPCPGYSVKTFKTNGAGGSLGRGPP

SEQ ID NO: 13724 - protein, 471 aa, Rubrobacter xylanophilus DSM 9941
MADKFDLVIIGGGNAGYIPAIRASQLGMSVALVERREGGHLGGTCLNLGCIPTKALLQTAAMLHDARNGEEFGVKVGDVRFDYRQAAKRRDQVVNQLRRGVAGLMKKNKVSVYNGTGSFIQPRRIKVELNDGGTEELEAENVLIATGSAVNTLPGLEFDGEKVISSDDVVTENDGYPESVIILGSGAVGVEFASMYNDFGTEVTIVEILDRLVPLEDPEVSAELEKQFEGRGIRCLTGTKADPGSLDKSGDGVKIKVAGEGGEETLEAEKLLVAVGRKTVTEELNLEATSVKTDDRGIIQVDEFYRTDEPGVYAAGDVIGGYWLAHAAGHEGIVAVEHMAGKDPMPLDQNLIPRVTFCRPEIASFGLSEEQAREEGYEIKVGKFPFRAIGKALIEGEPNGFLKVVADAETDLILGMHAIGPHVTELIAEGVFAKLVEGTPEEIGMAVHAHPSLAEIVGEAAMAVDGHAIHF

SEQ ID NO: 13725 - protein, 375 aa, Xanthomonas axonopodis pv. citri str. 306
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLIECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 13726 - protein, 279 aa, Rhodobacter sphaeroides 2.4.1
MKTLLSLGHGYSAQALAHRLLPQGWTVIGTTRSAAKAAELEAGGIEPLLWPGDLGPALARASHILASAAPGREGDPFLATHGAELARADARWVGYLSTTGVYGDHAGGWVDEDTPLTPSTERGQARVQAERQWQALGLPLHIFRLAGIYGPGRGPFEKVRDGTARRIVKPGQVFSRIHVADIAQVLEASMQHPEPGAIYNVCDDDPAPPEDVLGYAAELLGLPPPPEVPYDEAEMTPMARSFYAESKRVRNDRIKARLGIALLHPDYRSGLRSLLAGGD

SEQ ID NO: 13727 - protein, 131 aa, Oryza sativa
MQHQQRMKQAAAAAQQQQMMQQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVG

SEQ ID NO: 13728 - protein, 507 aa, Kineococcus radiotolerans SRS30216
MTVYEAPGRAGSVVQYADRYDHWIGGERVAPAEGGYFENPSPVTGQPFTEVARGTAADVERALDAAHAAAPAWGRTSVAERALVLNRIADRIEQNLEELAVAETWDNGKPVRECLAADLPLVVDHLRYFAGVVRAQEGGISQIDDDTVAYHFHEPLGVVGQIIPWNFPLLMAIWKLAPALAAGNAVVLKPAEQTPASIMLLMDLVGDLLPPGVVNVVNGFGAEAGKPLASNPRIRKIAFTGETTTGRLIMQYASQNLIPVTLELGGKSPNVFFDDVASARDDFYDKALEGFTMFALNQGEVCTCPSRALIQSGIYESFLADALDRTRAVKQGNPLDTETMIGAQASNDQLEKILSYIDIGKQEGAKLLTGGERADLGGELSGGYYVTPTVFEGDNSMRIFQEEIFGPVVSVTRFDGPDDALKIANDTLYGLGAGVWSRDIHLAYRMGRGIQAGRVWTNNYHAYPAHAAFGGYKSSGIGRENHAMMLDHYQQTKNLLVSYSTSKLGFF

SEQ ID NO: 13729 - protein, 348 aa, Cleome spinosa
MAGLLAWAADVVGGHGKEEDGEKDQIPLVFSAEQKKYAEELDRKAAALSRSIQDLRLRLPPPDISQRLPHLLAHSLASNAALALQLNSHSATREQAQLREQTLLEENSAYEKAISNYILFVETRFVVVYFLCGKDYELEDAEENLTDELEDAQVSLKNTQTRNSGESVYQSDANSKDGSDAEAEKFAILEKLESKKKELSSMEEQVQYLEKKWAVIQERALKQPSPAQREKTLDKQLHSLIEQLAAKQAQAEGLVGEIHSKEMELERLNGLWRRYESSNIEGNNARNRFARTNSDKGSVSDHEVDAHSYLPYSSAPRNDTQTRLMYLRSAFVIYILALHVLVFIKISF

SEQ ID NO: 13730 - protein, 82 aa, Oryza sativa
MAAEKGSPLPKFGEWDVNDPASAEGFPVIFNKAKAEKKTGGNSQGQDLPPKSEHPFGQGLYPAKPNSSKKWFCCMHPTAAEF

SEQ ID NO: 13731 - protein, 503 aa, Cleome spinosa
MEVAVTKPKKKIKLGIGLVIFPLFLLTLLYLFLGFPFYYSFTSSSSSPSSSSPSSSSSLYNHFLKSSSSSSAAASSSSSSSSSVVSNPPYPPSNSSSISTYNHTNNSSLHHDGINNPNSNQSSLRSHDSIPSSSSNDHHSPHQETSREKHAGRRRRDCDISSGEWVPNHEAPYYTNTTCWAIHEHQNCMKFGRPDSGFMKWRWKPYGCDLPLFDPLEFLEIMRGKSMAFIGDSVSRNHMQSLICLLSRVEYPEDVSLVQDFNFPRWKYKSFNFTIASFWSTHLVRSTETGPTGQYMTNYYNLHLDEPDPIWASQIGGFDYVIVSSGQWFFRPLFFFDKGKLVGCLYCYMPGVRNVGAFFAFRRAFRTTFRAILGAKHFKGEVFLRTFAPSHFENGEWNKGGNCLRTHPDRSNETELKGMNLEAHEIQLEEFRIARREGRRKGVRFRLVDVTKAMLLRGDGHPSRYGHRPEDNVILYNDCVHWCLPGPIDSWNDFLLHTLKNQQ

SEQ ID NO: 13732 - protein, 527 aa, Prochlorococcus marinus str. NATL2A
MACLIRQDGRSVVLKLKNLLAKERIISPSRDVIAGLVVAFAMIPEAIAFSGIAGVDPRVGLFGAFLLSVTLAIFGGRMAMITSVTGSTALLMTGIVQQGENISPGLGLQYLLAAGLLTGVLQIAWGYLRLAHQMRFVPQPVMDGFVNGLAILIFLAQLPHLGIDIAHSEKVVTAVQLPAVWGLTILTLLIIYLLPKFTKLLPSALVAIFICTAISIVFKLNVPSVSNLGILPNGLPSFGIPKVPFNFETLGLILPTALAISLVGLMETFLTQDILDDMTDKSTNKNVEARGQGIGNIVSSLFGGMAGCALVGQSVMNVGYGGRTRLSTLSSGVCLIAMILAAKDWVNQIPMATLVGVMIMIAINTASWVSIKDIRRIPRSDSSVMILTVFVTVITHNLALGLLSGVGLAAILFSRKVAKVIKVESSLNGKDHRIYKVSGQLFFVSSIYFRQGFELHEHPKKITIDMAEAHIWDQSGVTVLDQVIRRIKLGGSEVEVINLNDESLNLFSRIGQASEAGGRGGEFKSAH

SEQ ID NO: 13733 - protein, 268 aa, uncultured marine bacterium 580
MHPLLNTAIKAARRAGSIITRASEDISSLTITSKNMNDFVSEVDLASEKEIIRVLSQAYPDHGFIAEESGLSEKKENMWIIDPLDGTTNFLHNIPQYCVSIALQQKEEITHAVVYDPNRNHLFTASKGQGAYLNDRRIRVSKSPKLQDSIIGTGIPFRDFTYLPQYLVILEEIIKKTAGIRRPGSAALDLAYVAAGWFDGFWEIDLSTWDVAAGGLIVSEAGGMVSDFDEKNNWLLTGNIVATNPKIYDPLIKIIQQHIPEELRIKDS

SEQ ID NO: 13734 - protein, 386 aa, Staphylococcus epidermidis RP62A
MEMSERLASIPDSYFGKIMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDEFLEKQNEIFRRRRDNFESQLKHAHLPFVHSKGGLYIWLHTPPGYDSEAFEQLLLKEKSILVAPGKPFGENGNQYVRVSLALDDKQLEEAANRLTQLRYLYER

SEQ ID NO: 13735 - protein, 402 aa, Coprinopsis cinerea okayama7#130
MPPKGSKKKGGRKAKAAVVEEIPNVEPEVETPQEDTQMNVDEQTTTEQPEASTSAKLASTVTNAVVEAEHAVEHAVEKVVEKVAEVGGAAKEFVEEMTMTGVESGSSGNASESATPGAQESGKDEPMEQDSSREASQSAEAESKPKLTLEERRAKMEALRKKMREGTMANRQSLAEETAKAKLTARELARLERQRKLAETLRLKADAEERGEDVERRKNWEYTIEENDEWEKKLARKKRRADFEFHDDAQASRRRYKKDLDQIKPDLEAYNRQKALAMGLNPSANALTSFSSTDVVASSSSSALQAVSSEEQRIAAENLYRDANTLIYGDSKPSDEAIDRVVGKINKDIDKKAKFHRKRLNEDEGDITYINEHNRVFNKKIARYYDKYTAEIRASFERGTAL

SEQ ID NO: 13736 - protein, 429 aa, Methylobacillus flagellatus KT
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLCANVPGQLAIQTALGGYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEGKASKEAQTTSQSASA

SEQ ID NO: 13737 - protein, 339 aa, Corynebacterium glutamicum ATCC 13032
MTCDREGRHIPSKMSEGLHRHMTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 13738 - protein, 296 aa, Cytophaga hutchinsonii ATCC 33406
MPFARTCIQMNKEAIESLLIHVIGTDVIVNEVRPIGGGNTSRAFAVKSSQGNFFIKTNRAGLVDMFEKEVKNLELLRKVLPSNTPEVVGYGTIDHVSYFILKLIEPGRRVADFWSDFGRTLSELHRVTGNTFGLEYDNYIGSLPQSNKQNSNWVDFFVNERIWPQAKKAEKVLGTEIVGMISKLSDRLPDLLTQSRPTLLHGDLWSGNFTLNQAGTVCLVDPATYYGNREIEIAFTKLFGGFEDEFYAAYSEVLPLDKGFFDTRADIYNLYPLLVHVNLFGGWYVASVRETLKRFV

SEQ ID NO: 13739 - protein, 102 aa, Oryza sativa
  misc_feature (78)..(78): Xaa can be any naturally occurring amino acid
MAPYVMAASVTTVAPLQGLKFTGGMPVDRRSGNFSFGNVSNGRRIKCMQVWPIEGIKKFETLSYLTPLTVEDLLKQIXYLLRSKWAPWLEFNKVCLDYRENH

SEQ ID NO: 13740 - protein, 394 aa, Pyrococcus horikoshii OT3
MVLRCVVCGREYPEDEVRYRCDCGGLLEVVIDLDKVDTSIFNGRDIKLWKYESWLPVKKRVSLEEGGTPLYRLSNLENELKVKELYAKNEGANPTGSFKDRGMTVGVSKALELGMDKVICASTGNTSASLAAYAAKAGIKAYVLIPSGKIALGKLAQAIIHGAKVIPIKGNFDDALRIVVEASRELGIYMLNSINPFRLEGQKTIAYEIYDQLGKVPDNIILPVGNAGNISAIWKGFKEMYEAGVIDELPRMIGIQAEGASPLVKAWKEKKKFQPEENPETVASAIRIGNPANWIKAWKAVEESGGLFESVSDEEILRAQRLLASREGLFVEPASAASLAGLIKLLESGEISRNESYILITTGHGLKDPNIVIKNFQIPEPIEPTLEAFKEVIK

SEQ ID NO: 13741 - protein, 109 aa, Oryza sativa Japonica Group
MAQPAFLSALRSRLRSPQPQAPALPHLQPPRRGFHVELGAREKAVPIVVIGITYYTTRGFRGGLLEEDTALKRFKSYKNSVKQVSKVGNILTGVVLFACAYEIVALANS

SEQ ID NO: 13742 - protein, 359 aa, Pyrococcus horikoshii OT3
MVEKPVVIKFGGTSVRYAFEEALELVAKLHENMKIIVVVSALAGVTDCLLRLAKGDKSALLEIDEIHEELSQELNVQLEHLIHQLKKTINSKSSFPSEKAFIDEIASFGERFSAKLFSEGLKILGITARPVDSKDVLFVKGEFGNAEVEFKKSAQGVDVLYRMLRRGIVPVVTGYYGNLNGFRATFGRGGSDYSATSIASLVNAKAVLIMSDVEGIYTADPKLVPPARLIHYISYKEAKTAAKLGMKVLHPRAIDPVEGKIPVILGKTRDLKFGTLISHESQGIPIVTHKLLENHAEISVVSVKTNIPLPYEVYEEGDLYFKIKTSKDQFLEVLRDVHRRVVENENLHSSHDGELWTWV

SEQ ID NO: 13743 - protein, 332 aa, Silicibacter pomeroyi DSS-3
MTVYALNGLGRMGKLALKPLLERGAEIAWINDAVGSPEMFAHLLEFDTVHGRWQAEFGWDDQSITIDGTRIPVHTSRRIEDLPLNGVDVVIDCTGVFKTEAKLTPYFDAGVKKVVVSAPVKDGDTANIVYGVNHDIYEPARHRIVTAASCTTNCLAPVVKVLHEGVGIKHGSITTIHDVTNTQTIVDRPAKDLRRARSALNSLIPTTTGSATAITLIYPELKGKLNGHAVRVPLLNASITDCVFEVARDTSAEEVNALFKAAAEGPLNGILGYEERPLVSADYTNDPRSSIVDAPSTMVVNGTQVKIYAWYDNEMGYAHRLVDVAIMVGDSL

SEQ ID NO: 13744 - protein, 209 aa, Cytophaga hutchinsonii ATCC 33406
MSLVGKKAPSFVAPAVLNGYEVVEAFSLDQYLGKKYVVFYFYPKDFTFVCPTEILAFQEKLAAFEAKDTVVVGCSTDTENSHFAWLSMPKNKGGIQGVKYPLVADTAKTIATNYGVLGGNFDIDDNGQMIFVGAPIAYRGTFLIDKEGIVRHETVNDFPLGRNIDETLRMVEALQHVEKFGEVCPANWGEGKEAMKATVEGVSDYLAKN

SEQ ID NO: 13745 - protein, 696 aa, Ustilago maydis 521
MAQRNGAPNPGQSPLPQAHALPQVQQPTNQMAYGAQYAAPMGYNMNLASNHGPVAYGFSAAGQGGFAQSQAYAQQASAAHQYHAPPHLHAQIHQAAIAAQAQAPPSQLQHPAMSQAAHLQQQQIAASQQQGLQAPNSGYMQRAPGASPINRSPSPSARPLNAAPRSPQPHGQAQTYSQQQQQQQQQQQQQQFYQQQQQQQQQQQQQQQQQYTQSGGSTSPNPANEKPADYVYFERSTNGMQKSTIEAATGAKLKLENFYKVYVEQAVERIKRAAELEDRLTNPPDGVHLSDERKARQLAQLGRRESNFLRLRRTRLGLDDFRTVKVIGKGAFGEVRLVQKTDTGKIYAMKTLRKSEMFKKDQLAHVRAERDVLAESNSPWVVQLYYSFQDTAYLYLLMEFLPGGDLMTMLIKYDTFSEDVTRFYMAECVLALEGIHKLGFIHRDIKPDNILIDAKGHIKLSDFGLSTGFHKQHDSAYYQRLFEGTAAQNPAQTGRNSVAVNSINLTLSSKDTIATWKANRRKLAYSTVGTPDYIAPEIFLQQGYGNECDWWSLGAIMFECLCGYPPFCSENAHDTYRKILAWRETLQFPDDIHLSPEAEDMIRRLISAPENRLGRNSASEIKGHAFFAGVDWATIRQIDAPFIPQLKSITDTSYFPTEDYQDVPETPAGADVGVGSKDLAFLGYTYRRYESNETVL

SEQ ID NO: 13746 - protein, 226 aa, Triticum aestivum
MATASLSALSSAAAAAGKRFVLSSPSLSFASRRIAAPARLRAAAVPGARRFAASAASASTVVATIAVGDKLPDATLSYFDPADGELKTVTVGELTAGKKVVLFAVPGAFTPTCSQKHLPGFIEKAGDLRAKGVDTVACVSVNDAFVMKAWKESLGLGEDVQLLSDGNLELTRALGVEMDLSDKPMGLGVRSRRYALLADDGVVKVLNLEEGGAFTTSSAEEMLKAL

SEQ ID NO: 13747 - protein, 521 aa, Crocosphaera watsonii WH 8501
MSLEATAADAAIKQNLEQFLVVLSVSLSVATLSRIFSWFRQIPYTLLLVIVGLGLAFVDVRLVNLSPELILEIFLPPLLFEAAWNIRWRSLKENWIPVVLFAVIGVIISVIGIALALSQLTSLTLPIALLVGASLSATDPVSVVALFRELGTSKKLTILMEGESLFNDGVAVVAFLLLVGIPLGTEVFSVTDTVVSFFKFVGIGIGVGCLVGFGISYLTQRFDLPLVEQSLTLVSAYGTYLITEELGGSGVISVVTVGIILGNFGSRIGMNPRTRLLVSEFWDFLAFFVNSIVFLLIGDQINFSSLSDNLGIIAIAITAVLVTRLISIFGLANLSNIFTKVDISLPEQTVLWWGGLRGSVSIALALSVPVSLNGRQDIIDTVFGVVLFTLLIQGLTTQWVLKKLNLVGDQPLRQEYSELLARKTAVGRVMDYFKKLDESPSIDSEFYRYEQELVKGELKSIEEKIYKFETEYPQLKSIAMQQLKDKLLDIEADTYAELIRSGQLGKNLSPVMLDILSKSGE

SEQ ID NO: 13748 - protein, 415 aa, Oryza sativa
  misc_feature (240)..(240): Xaa can be any naturally occurring amino acid
  misc_feature (269)..(269): Xaa can be any naturally occurring amino acid
  misc_feature (278)..(278): Xaa can be any naturally occurring amino acid
  misc_feature (302)..(302): Xaa can be any naturally occurring amino acid
  misc_feature (330)..(330): Xaa can be any naturally occurring amino acid
MSIKKIHARSIYDSRGNPTVEVDLYTDKGLFRAGVPSGASTGVHEALELRDNGKGENLGKGVNQAVRNINEIIAPALIAQNFNVTEQEKIDHFMLSLDGTKNKSKLGANAILGVSIAVCKAGASEKGIPLYRHIANLAGHSEIIMPVPAFNVINGGSHAGNKLAMQEFMLLPTGATSFRDAMRIGSEIYHNLKSVIKGKYGLDACNVGDEGGFAPSIQDNMEGLELLKTAIEKAGYTGRXIGMDVAASEFYENGQYHLDFKSKEPNPSXVVSADQMAXIYQDMIKNYPGRGRSRAPTTQDDXSRGAKFPANPFIQLAGDNLPGPKPEAIXKAPPQKSLNGLLLKGTQTGWAPGALGGVGGGVIQNQGGVGGSPFFPGERGRTSFCVYPPSGFLGCWGRNNKKKGEHPAPPLPQRE

SEQ ID NO: 13749 - protein, 182 aa, Erwinia carotovora subsp. atroseptica SCRI1043
MQFNIPTLLTLFRVALIPFFVLAFYLPFVWAPLLCALIFVFAAVTDWFDGFLARRWKQTTRFGAFLDPVADKVMVAVALVLVAEYYHSWWITLPAATMIAREIIISALREWMAEIGKRSSVAVSWIGKVKTTAQMMALFALLWRPERIVEGIGVAALYIAAVLTFWSMFQYLNAARHDLLEP

SEQ ID NO: 13750 - protein, 478 aa, Xanthomonas axonopodis pv. citri str. 306
MSEQFDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRLAVIGAGVIGLELGSVWKRLGAEVTILEALPDFLALADAEVAKTALKEFKKQGLDIKLGAKVGKTEITGSDDAKQVVLSYTDATGEQTLTVDKLLVAVGRKAATKNLLADGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 13751 - protein, 477 aa, Kineococcus radiotolerans SRS30216
MRGSRRSSRQHSRPQEHFVAGAAEQQYDVVILGGGSGGYACALRSAELGLKVALVEKDLLGGTCLHRGCIPTKALLHAAEVADSAKESETFGVRATFDSIDMAGVNKYKDGVIARLYKGLQGLVKSRKIDLVAGTGKLVAKNTVEVDGQRYTGKAVVLASGSYSRSLPGLEVGGRIMTSEQALALDSVPDRVVVLGGGVIGVEFASVWRSFGADVTIVEALPHLVPLEDEAASKALERAFRKRGIKFSLGVRFKGVEQTDSGVVVSLEDGKTFEADLMLVAVGRGPNTAGLGYEDQGITMDRGFVLTDERLRTNVEGVYAVGDIVPGLQLAHRGFAQGIFVAEDIAGLAPAPIDELGIPKVTYCEPEVASVGLTEAKAREKYGDVDVVEYNLGGNGKSQIIGTTGFVKLVRQKDGPVVGVHMVGSRMSEQVGEAQLIVNWEAYPDDVASLVHTHPTQNEAVGEAFLALAGKPLHSHA

SEQ ID NO: 13752 - protein, 308 aa, Glycine max
MATPIPPPPAAAAAAAADPKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 13753 - protein, 618 aa, Kineococcus radiotolerans SRS30216
MSNSVQMPALGESVTEGTVTRWLKAVGDTVEVDEPLLEVSTDKVDTEIPSPVAGTLLEILVPEDETADVGADLARIGDPSEQGGGSPAPQEQPAPAAPQDAPAPPSTEDTQAAPQAAQEPSPEEPPAAAAAPAPGGGEAVKMPALGESVTEGTVTRWLKAVGDSVEVDEPLLEVSTDKVDTEIPSPVAGTLLEILVGEDETADVGADLARIGDASAAPSPAPAAPAQEAPAAPQEESLADEVAERETARAQAESATQPSSTPSAEPASAPAQPVAPAPAPAAPAPQAPASTPAPAEVTGGGTYVTPLVRKLAKDLGVDLATVTGTGVGGRVRKQDVQEAADKAAEAARAAEAKAAEAAAPAPAAAAEKPAAKPAPAVEVSAKRGTTEKMSRLRKVIAQRMKESLQNSAQLTTVIEVDVTKIARLRARAKDGFLATEGAKLTFLPFFVKAAVEALKQHPSLNASIDGENIVYHGSENVSMAVDTPKGLITPVIKDAGDLNLGGLARKIADLAARTRASKITPDDLSGGTFTITNTGSIGALFDTPILNAPQVAILGTGAIVKRPVVLEVDGQETIAIRSMMYLALSYDHQIVDGADAARFLQTVKKRIEAGEFEGELGL

SEQ ID NO: 13754 - protein, 403 aa, Xanthomonas axonopodis pv. citri str. 306
MATEVKVPVLPESVSDATIASWHKKAGEAVKRDENLVDLETDKVVLEVPSPVDGVLKEIKFETGSTVTSNQILAIIEEGAVAAAAPAEEKQAAAPAATAAAPAAAPAPAAAAAPAASKSAADSLPPGARFSAITQGVDPSQVEGTGRRGAVTKEDIVNFAKAGGVGKASGARPEERVPMTRVRKTIAKRLMESKNSTAMLTTFNEVNLAKVSAARKELQDEFQKAHGIKLGFMSFFVKAAANALQRFPLVNASIDGDDIIYHGYSDISIAVSTDKGLVTPVLRNVERQSFADVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 13755 - protein, 226 aa, uncultured marine bacterium 580
MFKKFKEDLSIVFERDPAARSYLEILTTYPGVHAILIHRLSHKLWTIKLFWLGRFLSHISRFLTGIEIHPGAQIGSRCFIDHGMGVVIGETSIIGDDCTLYHGVTLGGTSWKQGKRHPTLENKVVIGAGAKVLGPITIKAGARIGSNAVVVSDVTKDATVVGIPARAVKETKKGTTFRPYAVGKDEDDPMVKSIQALINKVAKQEREIEALTKKKDKPKKAPPKST

SEQ ID NO: 13756 - protein, 256 aa, Arabidopsis thaliana
MSQEQPRRPREPVKYGDVFEVSGELADKPIAPEDAKMMQSAETHVFGHTQKGGPAAVMQSAATTNIRGGFVHPDDKTELVAERGATVEQTVPAATVTTEFVGGQVVGQHVEPRRVVAAARTDEEALQSTITIGEALEATVKTAGNKPVDQSDAAAIQAAEMRASGTNVIALAGVAASAQSAADHNATVDRDERKIKLRDVLTGAAGKLSADRAVTREDAEGVVSAEMRNNPKLCTHPGGVAASLTVAARLNERVDI

SEQ ID NO: 13757 - protein, 470 aa, Erwinia carotovora subsp. atroseptica SCRI1043
MVEKLKETADLAPEQGEGLQRNLTNRHIQLIAIGGAIGTGLFMGSGKTISMAGPSIIFVYMIIGFMLFFVMRAMGELLLSNLNYKSFSDFAADLLGPWAGFFTGWTYWFCWVVTGIADVVAISAYSQFWFPDLSQWVSSLLCVLLLLTLNLATVKLFGEMEFWFAMIKIVAIVALIVVGVALVMMQFSSPSGNVASFNNLWNDGGMFPKGISGFFAGFQIAVFAFVGIELVGTTAAETKNPKVVLPRAINAIPIRIIMFYVFALIMIMSVTPWGAITADRSPFVEMFVLVGLPAAASMINFVVLTSAASSANSGVFSTSRMLFGLAKQGDAPKSFGMLSKRAVPSTGLMFSCICLLSGVVLIYLIPNVMTVFTLVTTVSAILFMFIWSIILCSYLTYRKKRPQLHAESSYKMPLGVFMCRVCLAFFAFVIVLLTLQPDTRQALVVTPLWFIVLAIAYQFVRRKKQVVDVK

SEQ ID NO: 13758 - protein, 379 aa, uncultured marine bacterium 580
MIYLDNNATTALHPEVLKAMLPFLSTQQGNPASNHTFGRSAHTAIEEAREKVAASVNAHPSQVIFTSSGTESNNTIINGIAKAYPESHFGFSSIEHPCISEPIKSLAHQGFKVSEIPVDSNGIFNVSDVSDEMKQSLTFLSVMMANNETGVIQNIAEIADWARDNKIQFHTDAVQALGKIKVDFEALDIDAMTISSHKIYGPQGIAALIINKKIDLFPYMQGGGQEKGLRSGTENIAAIIGFGKACERSSQNRVIFDEKIDLLKSTLEKNLVDLGAIIFCEKSHRLSNTTFFSFKNIDGSTLLTALDRKGFAIASGSACSSKSDEPSHVLLSMGVDLDLAQGALRVSLGVESNENEINDFIDTLKDEVSRLKQLTAVAA

SEQ ID NO: 13759 - protein, 100 aa, Cleome spinosa
MGYVQQARENHVKKKVEEALRSKMKAKALMECDHYTSKYAQCATGRTLSVVWQCRCGFVEIQHNGNKALHLHFHITILSKWMVDNGVKTVVSYLKEILIQ

SEQ ID NO: 13760 - protein, 417 aa, Arabidopsis thaliana
MGNCLVGRNNENIAEEEEEKFEEVMKKDYKRKDRKLKIVLRRDELEKIILFQLNADGANKGGDAKLASFGVFLRELEAERLAGEAAAAVAKEEKSSRRLCRRWKPSLESVIEWPEEIVVNEIDENEEDNGAYNNDELNLGLNSQASVSLHHTLCKKTKMSSQICRSASKAAKSLLSSAKNARFFSEGRAIGAAAAVSASGKIPLYASNFARSSGSGVASKSWITGLLALPAAAYMIQDQEVLAAEVTIVISILDFGLSALCSSSLNVSDSIRWNELLLLSSLMISEIISRFERKGFKLVGIKVIVPSKDFAQKHYHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 13761 - protein, 407 aa, uncultured marine bacterium 580
MKNKLYDMPIYMDYSSTTPVDPRVAEKMIPYITEDFGNPASRSHPYGWTAEKAVEDARKEIALLVNADPREIVWTSGATESNNLAIKGASNFYSKKGKHIITLATEHKAVIDAVRECERTGYEATYMEPEPNGLLDIEKFKSTIRPDTVLVSVMFVNNEIGVIQDITTIGNICRENNIIFHVDAAQATGKVKIDLETLPVDLMSFSAHKTYGPKGVGALYVRRKPRIRIEPQMHGGGHERGMRSGTLATHQIVGMGEAFKIAREEMDEENNRIKNLQAKLLKGLTEIEETYVNGDLEKRVPHNLNISFNYVEGESLIMAIKGIAVSSGSACTSASLEPSYVLRALGRSDELAHSSIRFSIGRFTTESDVEFTIALLKEKIGKLRELSPLWEMFKDGVDLEKVEWAEH

SEQ ID NO: 13762 - protein, 784 aa, Oryza sativa Indica Group
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPSCPSHLEFPLSSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 13763 - protein, 126 aa, uncultured marine bacterium 580
MAYSDKVLDHYENPRNVGSFNKEDSNVGTGMVGAPACGDVMKLQIKMGNDGIIEDAKFKTYGCGSAIASSSLVTEWLKGKSLDQASEIKNSAIAEELALPPVKIHCSVLAEDAIKAAVEDLKSKQK

SEQ ID NO: 13764 - protein, 602 aa, Coprinopsis cinerea okayama7#130
MSPPAAQGQLPTKSKKEKERERREKAAQQQSNERLKTVVRRLPPNLPEDIFWQTVKPWVTEETATWKVYYPGKFKKRDNKENIPSRAYIAFKNEELLATFSREFDGHLFKDKAGNESYAIVEFAPYQKVPSEKRKPDTKNATIEKDDDYISFIESLNAATNTEPVTIDALLAATRPPSPPKTTPLLEALKAEKSAQKDKEAILRNHAHYKDQANLAAVTGVTTSSSRKEEKKKAQAAAIQAAQAQAAKQVVASAGGGTPATPSKKGKKGREAKEAAPAQKGSAPGKAANGPAEGKAAKPAPSAKQSRQQKAAAKAAEAAASNAAHTPQVTIAQPPKPQTAANAAPAATPAASGSSSSTAQTGGDAAPTPAPARRPRAVLGGRHFEAALAGVGARPKRERDTGAAASTATAPTNATNGAAPPPAAPPAPVPSSPVKEKVGGTSNNPTASPPRSRNRRGGGPAQQQSTSPTATKLPAILQRDAPATQAPPLLARPREEDEEEGGEVGGGVVPEEGRAVDDPGGGIHQEQEKFLSRWYQSPTKLEESSLDSMSFLDPHCKGPQPVFGWLATVVIMDHRWPSYPPHSDFACTPLLPTNPPSSPLPY

SEQ ID NO: 13765 - protein, 200 aa, Glycine max
MAEQALEGSQPVDLTKHPSGIVPTLQNIVSTVNLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHSAFSSYEPELFPGLIYRMKQPKIVLLIFVSGKIVLTGAKVRDETYTAFENIYPVLTEFRKNQQ

SEQ ID NO: 13766 - protein, 330 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSTQRLHQESQQPPQQQQPQVQQAQPQKQAASVMRRASSIAARQAAMAQQSQETKPVSSSPKIKRQTSVRSGSVASIKPPVAASTPKPGGSPNKGEVKPAAGPVQTPTTGADSSKPEPSAPSLPGAEGVDKMAIDEASGDAPEGAEELDPALEEETPMEETIRVTRAKLRRRMATEDPAGN

SEQ ID NO: 13767 - protein, 170 aa, Clostridium thermocellum ATCC 27405
MAKHTLSVLVENHAGVLSRIAGLFSRRGFNIDSLAVGVTENPEISRMTIVVDGDDYIVEQVTKQLNKLVDVIKIKELDESDSVSRELALIKVGANASTRSEIVQIAEIFRAKIVDVSKTTLTIEISGSVDKVAALEDMLKQFGIKEIVRTGTIAIERGNKVIKNKNSDEE

SEQ ID NO: 13768 - protein, 848 aa, Candida glabrata CBS 138
MKSNVFVGVKPMVGTVNGTETDLKDDVDYILAPVTNGRYREIVSRVISENRKSGDPLDHYSIDVPEPQLQEIGIPPFNDDPKQYIGLLASWLDLETADPVLRDVAFQVLLNECKYSRFIGVSKLIVAPPKNVLEIQKYARMVADLLNDPVVTEMPQLTLSISLPLCELSDPLATWELWNTIKNLCGAHECLTVSLALPKNKTPTHVLERWLTEPVSCLLLSSSIFVTNQHGFPVLQKYNQNIIFRFQEINGRNMLGQNELCIIMHGLEKFANDVKGGKASFINYINFILKKGDKLILQNMSKMLKACEKLAEPRILPQLKPHSEDLSNQTYALFEEDIVKYDLYEVAIKDAILENTKIWKNRGSSFITILVAGAGRGPLVDRVFKVLQELSILSECRVIAIEKNSRAYLYLQKRNFDKWQNRVTLINEDIQNWQINMAESQRTKVDLCISELLGSFGCNELSPECLLSLQKYHSQKETVYIPQSYSSYIAPIACPVLDMQLQKMCKQDLHVNVTQQPWVLHNIPYQTLSSKVNELWTFSHPMSEASNLQHDIVSEFKIKHRAEVNALIGYFSAVLYGDVILSIVPEGTIVRVPQSKNNHEGEALHSTPDKSAHTNDNKYYFKKIDKTPGLTSWSPMIFPLSQPLLVSDDTELSVMMSRRHNGKYTWYEWSLESYVYMVVTSTSTASDATMEVITPNNNAHNVTQEESKRVTSPHPYAPGWTFSANKSKDAQPLSKRKISNSSPFDKQQKLYSGRVSIDNEEMHHQDFEEGDTNNQINGWTNGWTSVNDLHRATEAIVPAYDIGNEPQEKIEKEKEIEKEKEKEVHIRVKTGVTMLHNSRGRCSRIELR

SEQ ID NO: 13769 - protein, 589 aa, Prochlorococcus marinus str. NATL2A
MTNKNPHEDSSCPVEQDVLEESSEEILEEIEQNSENGFSEFNFSEELIQTISDKGYSSPTPIQKAAIPELLLGRDLVGQAQTGTGKTAAFALPILERLKKNVGHPQVLVLAPTRELAMQVAESFRTYSAGHPHFKVLAIYGGSDFRNQINTLRRGVDVVVGTPGRVMDHMRQKTLNTSHLSCLVLDEADEMLRMGFIDDVEWILEQLPEERQLVLFSATMPSEIRRLSKKYLNSPAEITIKATELKERLIRQRYISVQNVYKVNALQRVLEAVSEEGVIIFARTKAITIVVAEKLESYGYNVAVLNGDIPQNQRERTVERLRQGSINILVATDVAARGLDVDRIGLVINYDMPFDREAYVHRIGRTGRAGRNGEAILFVNPRERSFLSNLERAVGQPIEKMDIPDNDLINNNRIKKLQAKLIKAASTERDNPEEANILEELIKNVEKELDIDPKDLTLAALNLAVGFNALLEKGNEDWIRQSAQRNTRNDRRDNNKFKQRRRGDFDNNRLEDEMDRFRVEVGHRDRVKPGNLVGAIANEAGLKGRSIGRIRIFENYSLVDLPKQMPDKVFQALKKVKVMNRELQINRAD

SEQ ID NO: 13770 - protein, 610 aa, Rhizobium leguminosarum bv. viciae 3841
MTAISGAEASRSAAAREEQMTDKVLKVLGVHGLGDQRASGWAEVWTGALESAFPNVPGLAITPEFMSYDDIFETTEISFAESVSAIWKLAKSGVSEIGRRDRGFVSDISDRIKWTAGYVVAWAEDEKFQQKTRNRVFAAIREHQPDIVLAHSLGSLITYNAFTHSDAKKADMPELLSKVRYVTFGSQIANPFVIRNLTNGRIQPLDVKFWYHLYNVHDDVFTAPIRLPDANNFSQTETPFDDAGMADHSAAGYLTNPATVANVWRSIAAESTNARTFAPSIVAQSRSVVGKPRKKQKALLVGINDYPEAANRLEGCVNDVFTMSAVLQDCGLPPESIRTCLDARATADGIVTRLKWLLDDPEPGDELVFYYSGHGARAPEYGENFEPDHYVETLVPWDFDWSQEKYIADDQIYDLYSQLPYDCRLVMIFDCCHSGGIHRDGGARPRGITPPDDIRHRELKWDGKTQMWVSRDFTRINDKFTPKKDVATGYFGKEGTTQRIGRASMLRGTSSTEYSRLKKQDPALAAGPYLPVIIEACGEDQLSYEYRHGATSHGAFTYSLANILRREKKISFEQLIEKTRSQLQELQYNQKPQILGPTAILQHEVPWSAT

SEQ ID NO: 13771 - protein, 149 aa, Glycine max
MVEQTSIMIKPDGVQRGLIGEIISRLEKKGFYLKGLKLVTVDRPFAEKHYAHLSAKPFFSGLVDYIISGPVVAMIWEGKNVVTTGRKIIGATNPAQSEPGTIRGDFAIDIGRNVIHGSDAVESANKEIALWFPEGPANCQSSQHSWIYE

SEQ ID NO: 13772 - protein, 428 aa, Triticum aestivum
  misc_feature (133)..(133): Xaa can be any naturally occurring amino acid
MANKHPSLSLFLLLLGLSSSLASGQVLFQGFNWESWKHNGGWYNFLMGKVDDIAAAGVTHVWLPPASQSVSKQGYMPGRLYDLDASKYGNKAQLKSLIGALHGKGVKAIADIVINHRTAERKDGRGIYCIFEXGGNPDARLDWGPHMICRDDRPYADGTGNPDTGADFGAAPDIDHLNPRVQKELVEWLNWLRTDVGFDGWRFDFAKGYSADVAKIYIDRSEPSFAVAEIWTSLAYGGDGKPNLNQDQHRQELVNWVNKVGGSGPGTTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSIRTRHGIHSESKLQIIEADADLYLAEIDGKVIVKLGPRYDVGHLIPGGFKVAAHGNDYAVWEKI

SEQ ID NO: 13773 - protein, 396 aa, Haemophilus influenzae 86-028NP
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 13774 - protein, 309 aa, Xanthomonas campestris pv. vesicatoria str. 85-10
MSGWTLADLPSQRGRVAIVTGASPGGLGYETALALAGAGAHVVLTARNPDRGEAARWALLARHSEAEVRVEALDLASLASVRAFAKRLTTRHAAVDLLINNAGVMAPPQRQTTADGMELQLGSNYLGHFALTAQVLPLLRAASAPRVVNLSSLAHRQARIDFDDLQSERPYRPWKAYGQSKLAMLMFSLELQRRSNTHGWGVRAIAAHPGIARTALIANGPDGAGRRSASGVATGLFTRCIGHSASAGARPTLYAATSPQAQAGGYYGPNGLFELKGDPAPAKIAHQAHDQQVAARLWDTACALTGVAF

SEQ ID NO: 13775 - protein, 459 aa, Vitis vinifera
MVKICCIGAGYVGGPTMAVIALKCPDIEVAVVDISVGRINAWNSDQLPIYEPGLDEVVKQCRGKNLFFSTDVEKHVSEADIVFVSVNTPTKTQGLGAGKAADLTYWESAARMIADVSKSDKIVVEKSTVPVKTAEAIEKILTHNSKGINFQILSNPEFLAEGTAIQDLFNPDRVLIGGRETPEGQKAIKALRDVYAHWVPVERIICTNLWSAELSKLAANAFLAQRISSVNAMSALCEATGADVTEVSHAVGKDTRIGPKFLNASVGFGGSCFQKDILNLVYICECNGLPEVANYWKQVIKVNDYQKTRFVNRVVSSMFNTVSGKKIAILGFAFKKDTGDTRETPAIDVCKGLLGDKAHLSIYDPQVSGEQIQRDLAMKNVVWDAYTATKDAHGICILTEWDEFKSLDYKKIYDNMQKPAFVFDGRNVVDAEKLREIGFIVYSIGKPLDAWLKDMPAVA

SEQ ID NO: 13776 - protein, 346 aa, Crocosphaera watsonii WH 8501
MSRYAEELRTTAKAMVARGKGILAMDESNGTCNKRFDKLGIPTTEEYRQIYRSLILQTPELSNYISGPILYDETIRQTTPDGVPLLKIITDAGMIPGIKVDTGAKDLAGCPNEKVTEGLDGLRDRIAEYYSMGARFAKWRAVITIGNGIPSRGCIKANAHGLARYAALCQEGGLVPIVEPEVLIDGDHTLERCWNVTDETLHEVFNQLYTQNVAFDQMVLKPSMVISGKDCPQQASVEEVAKATISCLLKNVPATVAGIAFLSGGQSKEQSSAHLNAMNQMFGDQCPWPVTFSYARAIQQPALDYWAGDSSRISGAQTRLLKRAQCNGAASLGEYSSEMEKTLATV

SEQ ID NO: 13777 - protein, 225 aa, Methanococcus maripaludis S2
MAEKRAEKRKFNTEAWEPKTQIGRMVKEGTISDISYIMDKGLPLLEPEIVDALLPDLEEQVLDVKLVQRMHKSGRRARYRATVVVGNKNGYVGVGMGKSKEVGPAIRKAIAHAKLSLIKVRVGCGSWECGCGSPHSIPFTAKGACGSVKVELLPAPRGVGLVAGNVAKAVLGLAGVKDAWTKTFGDTRTTYNFAEATFDALNNLNFVRCLPNQKEKLGLTEGRVL

SEQ ID NO: 13778 - protein, 331 aa, Rubrobacter xylanophilus DSM 9941
MVAAELLHAPLALVFPLSAAALVGLAWVLGQATESLGHHAGPRVGGLLNATFGNAAELIITLFALAAGLTTVVKASIIGSIIGNALLVLGASMLLGGLKNGTQSFSATIAGINASMLAIVAAALALPTIFALTGPGGRPSPTSLSIEVAAVMLLLYLLYLLYYFRHPEAGAAAGSGHAPFGRLASLLLLLGSTAAVAYVSEAFVGSIEPLVEEFGISELFVGVILVPLVGNIAEHLVGVQIAYRNQMDFSMAISLGSSLQVALLVTPILVFLGPLLGHPLTLVFTPLELGSLAAAVAITSIIALDGRSNWLEGAMLCGVYAIAALAFFFSP

SEQ ID NO: 13779 - protein, 160 aa, Vitis vinifera
MRSIPLKQKMGYVQFVRKEWGWILLAILQCNMEISLKYPFSLEFRRGGSNSTFSILRKELRDGNLQSIFGGSSRIVSSSNSEPDPLLSSFMYNAPVVVEPVVVQPDSSAEASVVKESSDEGFSERNIQKPQLSDKEQEEKARRCEFVQGLLLSTILEDSL

SEQ ID NO: 13780 - protein, 151 aa, Chlamydophila pneumoniae TW-183
MKGHLSAKNLRIAIVGSCFNQAMADALVSGTQETFLKFGGSEDGLMTIRVPGAFEIPCTIKKLLSSERKFDAIVACGVLIQGETDHYNQIVNQVAAGIGALSLEFCLPITLSIVAAPSAEIAWQRSGIKGRHLGVSGMTTAIEMATLFTQI

SEQ ID NO: 13781 - protein, 492 aa, Methylobacillus flagellatus KT
MKVIDPCTLVLFGASGNLSRIKLMPGLFRLDQAGRLPEKMAILSVGRSQVSREDWLADIKSMLDAKFPKGYDQAVFKRFIERHHYHANPPDDPSSFTRLKETLSDEAIFPQNLAYFLSVRPSDFAAIVDQLASVGLTEEGKYWRRVVVEKPFGTDLKSAQELQSSITKHLKESQIYRIDHYLGKSALQNIMLQRFANTILEPLWNKDYIDHVQITNTEQLGVGERTQFYDATGALRDMIQSHVLQTLALTAMEQPASLNPDDIRAEKIKVLEAIRPIPVDELEKYAFRAQYSSGEIKGEKVPGYLEELGDDSSVVETYAALKLFIDNPRWEGVPFYIRTAKRLHEADTRIAIRFKKAPLQLGNGQDQNWLIIGIQPRECIKFEIQSKIPGLDIATRTIELDGANRQEGDETIDAYEALLLNLMEGDNSLYLHISEVEAQWRLVDPVIEAWAKDRKPVHQYPAGSSDPEASKVIFEHEDQFWRYSIALGGDKK

SEQ ID NO: 13782 - protein, 269 aa, Populus trichocarpa
MACSATSTTLISSIAAAATATTTKSMAFPISKNITLPNSFFGTRKSFQSRVPRSISLTRGSHSRSTFVVKASSELPLVGNIAPDFEAEAVFDQEFINVKLSDYIGKKYVILFFYPLDFTFVCPTEITAFSDRHEEFEQINTEVLGVSIDSVFSHLAWVQTDRKSGGLGDLKYPLISDVTKSISKSYGVLIPDQGVALRGLFIIDKEGVIQHSTINNLAIGRSVDETKRTLQALQYVQENPDEVCPAGWKPGEKSMKPDPKLSKDYFAAI

SEQ ID NO: 13783 - protein, 382 aa, Aeropyrum pernix
MARLLMIPGPTPVDPEVLLAMARLVISHTSPEFDEIHSETVSMLQKLFRTSGKVFLLPGSGSLGMEFAVRSVAGRGSRALVLKAGYFGGYFERILRSLGATVTVVESPVGRGFTGADVEEALDRAGDVDVVFVQHVETSTSVANPVREIAGVVKKNGARLVVDGIASVGGMDLRLDEWGVDVALTGSQKALSTPPGLAIVAFSSEYSAELEKREPSGIYFDFLSLSREMESTRNYHITPAVNLVFALNASLKRILSEGLENRFERHRVLARAFTSAMEALGLRLVAEEPFRAWTVTAVYLPQGIEWSRFYSAMRKRGVEIAGGLGGLKGKIFRVGHMGEVDANDLIATIAAIERSLVELGYREARLGQGLEAAQKELSSLGL

SEQ ID NO: 13784 - protein, 382 aa, Aeropyrum pernix
MARLLMIPGPTPVDPEVLLAMARPVISHTSPEFDEIHSETVSMLQKLFRTSGKVFLLPGSGSLGMEFAVRSVAGRGSRALVLKAGYFGGYFERILRSLGATVTVVESPVGRGFTGADVEEALDRAGDVDVVFVQHVETSTSVANPVREIAGVVKKNGARLVVDGIASVGGMDLRLDEWGVDVALTGSQKALSTPPGLAIVAFSSEYSAELEKREPSGIYFDFLSLSREMESTRNYHITPAVNLVFALNASLKRILSEGLENRFERHRVLARAFTSAMEALGLRLVAEEPFRAWTVTAVYLPQGIEWSRFYSAMRKRGVEIAGGLGGLKGKIFRVGHMGEVDANDLIATIAAIERSLVELGYREARLGQGLEAAQKELSSLGL

SEQ ID NO: 13785 - protein, 110 aa, Nicotiana tabacum
MASSSGQNGIQLLLAAEQEAQHIVNNARTAKQARLKQAKEEAEKEIAEFRAYMEAEFQRKLEQTSGDSGANVKRLEQETDAKIEHLKTEAERVSPDVVQMLLRHVTTVKN

SEQ ID NO: 13786 - protein, 325 aa, Bordetella parapertussis 12822
MKLEGAKILVIGGAGFIGSFVVAELLKHPVAEVVIYDNFARGKQSNIDEYLSDPRCRIYPNGGDIRDIDLLNDAMQGMDGVVHLAAMWLLHCKDFPRTAFHVNIEGTFNVLEACVRNNVKRLVYSSSASVYGDAVEVPMTEEHPFNNRNFYGASKIAGEAMCHAFHDRYGLSYVGLRYMNVYGPHQDQTAAYTGVIPIMLNKIDANEAPVINGDGTQAYDFVYVEDVARCNVLALTSEATDQFYNVGTGVQTSIKELCDTILDMKDSGLQVQYRPYSEDDARRMVQNRIGCPVKASRDLGFTYQYALTEGLQKLIDWRAKNGAQS

SEQ ID NO: 13787 - protein, 331 aa, Clostridium thermocellum ATCC 27405
MNVIMAGIDYTLAPIDIREKFSFTKSTLQAVYNDLLKNENIFGAVIVSTCNRTELYLSCEEGLYINPFELLCDAANFDYEEYSNMHVLRTGVDVIRHLCELACGVKSQIWGEDQIITQVRNAIELAREMNASDSTLEVMFRIAVTSAKKVKTTLKLSSTERSIAYSALKIIKSKENISKALVIGNGEIGRLMASILIENGYDTTITLRRYRHGDNIIPLGAKTIEYVARYEKLKDCDVVISATLSPHYTLEIDKIDRIKYPRLFIDLAVPRDIDPKIKSLDNVELYDLDSIYAGEVDKNRTEQMIQVKKIIDKYIFDYYRWYEYRKRLVLT

SEQ ID NO: 13788 - protein, 225 aa, Streptococcus mutans UA159
MEELKKIAGVRAAQYVEDGMIVGLGTGSTAYYFVEEVGRRVQEEGLQVIGVTTSSRTTAQAQALGIPLKSIDEVDSVDVTVDGADEVDPNFNGIKGGGGALLMEKIVGTLTKDYIWVVDESKMVDTLGAFRLPVEVVQYGAERLFREFEKKGYKPSFREYDGVRFVTDMKNFIIDLDLGSIPDPIAFGNMLDHQVGVVEHGLFNGMVNRVIVAGKDGVRILEANK

SEQ ID NO: 13789 - protein, 111 aa, Nicotiana tabacum
MESNRGSQNGIQLLLGAEQEAQHIVNAARTGKQARMKQAKEEAEKEIAEFRAYMEAEFQRNVEQTSGDSGANVKRLEQETFAKIQHLKTEAESISHDVVQMLLRQVTTVKN

SEQ ID NO: 13790 - protein, 306 aa, Synechococcus sp. WH 7805
MGWTIEDMPDQQGRVALVTGANSGLGLETTRALIGRGCTVLMGCRSARKGEAARALLLEAGGSGLDLFELDLSDLTSVARCARDVADRYGRLDLLINNAGLMAPPRMLSQQGHEMQFAVNHLGHFALTQALLPLMNNRPQARVVTVTSGAQYFGAMAWDDLQGEQRYDRWKAYSQSKLANVMFALELNQRLQASGSAVRSLAAHPGLARTNLQPVSVAATGAWQEALAYRLMDPLFQSAAQGALPQLYAATASAAGGGEHYGPGQLGGMRGAPKQQPVARAAKDQHQRQRLWTVSESLTEHHSAAV

SEQ ID NO: 13791 - protein, 82 aa, Zea mays
  misc_feature (14)..(14): Xaa can be any naturally occurring amino acid
  misc_feature (21)..(21): Xaa can be any naturally occurring amino acid
  misc_feature (47)..(47): Xaa can be any naturally occurring amino acid
MSSWPRMDYATGHXERNLPAXLYCLTRLCLSSKPYYPAGTMGVLTAXLGLMRTLKDTYQLEPASSHASWGLDDNHCLGLIFR

SEQ ID NO: 13792 - protein, 382 aa, Aeropyrum pernix
  misc_feature (16)..(16): Xaa can be any naturally occurring amino acid
MARLLMIPGPTPVDPXVLLAMARPVISHTSPEFDEIHSETVSMLQKLFRTSGKVFLLPGSGSLGMEFAVRSVAGRGSRALVLKAGYFGGYFERILRSLGATVTVVESPVGRGFTGADVEEALDRAGDVDVVFVQHVETSTSVANPVREIAGVVKKNGARLVVDGIASVGGMDLRLDEWGVDVALTGSQKALSTPPGLAIVAFSSEYSAELEKREPSGIYFDFLSLSREMESTRNYHITPAVNLVFALNASLKRILSEGLENRFERHRVLARAFTSAMEALGLRLVAEEPFRAWTVTAVYLPQGIEWSRFYSAMRKRGVEIAGGLGGLKGKIFRVGHMGEVDANDLIATIAAIERSLVELGYREARLGQGLEAAQKELSSLGL

SEQ ID NO: 13793 - protein, 708 aa, Oryza sativa Indica Group
MVLLLLLLLALPAAAGGLAADGQALLAFKAAVLRDPEGALADWDASTAADPCAWNGVSCGAGSGAGGADRRVVALSLPRKGLVGSLPASPLPASLRHLNLRSNRLFGELPAPLLSAAAGLQSVVLYGNELYGPIPPELGDLPYLQILDLSSNSLNGTLPPAILRCRRLRSLALGWNNLTGALPQGFARGLSALEHLDLSHNHFSGAVPEDIGNLSRLEGTVDLSHNQFSGQIPASLGRLPEKVYIDLTYNNLSGPIPQNGALENRGPTAFVGNPGLCGPPLKNPCSPDAMPSSNPFVPKDGGSGAPGAGKNKGLGKVAIVAIVLSDVVGILIIALVFFYCYWRAVSSKEKGNGGAAGSKGSRCGKDCGCFSRDESATPSEHTEQYDLVPLDQQVRFDLDELLKASAFVLGKSGIGIVYKVVLEDGLTMAVRRLGEGGLQRFKEFQTEVEAIGKVRHPSIVTLRAYYWSYDEKLLIYDYIPNGSLSAAIHGKPGTMTFTPLPWDGRLKIMQGVAKGLSFLHEFSPKKYVHGDLRPNNVLLGSNMEPYISDFGLGRLANIAGGSPFTQSDHAGIEKAQSQQSDASVSPLVGKRSCYQAPEALKTLKPSQKWDVFSYGVILLEMITGRSPVVLLETMQMDLVQWVQFCIEEKKPSADVLDPSLARDSEREDEMIAALKVALACVQANPERRPSMRHVAEIPGSPQWFRLEK

SEQ ID NO: 13794 - protein, 382 aa, Aeropyrum pernix
MARLLMIPGPTPVDPGVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGIYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIALIERSLVELGYREARLGQGLEAAQKELSSLGL

SEQ ID NO: 13795 - protein, 461 aa, Triticum aestivum
LKGMSALTLSALIPYLQPPQCIGSFCPQPALHQYLIYFVGLYMIALGAGGIKPCVSSFGADQFDDTDPVERTKKGAFFNWFYFSINIGSLISGTVLIWVQEKYGYGIGFAIPTFFIALAIGSFFLGSEVYRFQIPGGSPLTRACQVVVAAIYKRNVDLPVDSSLLYECRGKRSAIEGSRKLEHSSEFSFLDKSAVVLRSECGDIHNPWRLCTVTQIEELKILMRMFPIWATGIVFFTVCAQNSSMFIEQGMALNNQVGSFKIPPATLSSLDVISIVVWVPIYERFIVPIARRLTGKERGFSELQRMGIGLFVSTIAVAVAALVEIKRLESARSEGLVHQKVPVSMSILWQAPQYLLIGVGEVFTSIGQAEFFYNQSPDSMRSLCSAFALVTVSLGSYLSSFILTLVSYLTTRGEQMGWIPDNLNEGHLDRFFWLIAGLSSLNFLAFVYFAQQYKCKKASVL

SEQ ID NO: 13796 - protein, 382 aa, Aeropyrum pernix
MARLLMIPGPTPVDPLVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGIYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIAAIERSLVELGYREARLGQGLEAAQKELSSLGL

SEQ ID NO: 13797 - protein, 113 aa, Brassica napus
  misc_feature (109)..(109): Xaa can be any naturally occurring amino acid
MKESSRKQGAASPCAACKLLRRRCAQDCVFSPYFPADEPQKFANVHRVFGASNVNKMLQELPLHQRGDAVSSMVYEANARVRDPVYGCVGSISSLQQQIDVLQGQLALXQAEV

SEQ ID NO: 13798 - protein, 472 aa, Pyrococcus horikoshii OT3
MPKLIKERVPTPERPVEERIKDFKEVNLGYTFELAKKEAERCLQCPPEYAPCIKGCPVHINIPAFIAKIKEGDIKGALRIIWNDNTLPAITGRVCPQEDQCEGACVVGKVGDPVNIGKLERFVADYAREHGIEEELLREFTEKCDGSKGKVAVVGAGPAGLTCAGELAKMGYKVTIFEALHKPGGVLAYGIPEFRLPKEILDHELKKLKMLGVEIRTDHVVGKTVTLDELLQEYDAVFIGTGAGTPKLLNIPGILLDRIYSANEFLTRINLMKAYEFPEYDTPIAVGKKVIVIGAGNTAMDAARSALRLGAEVTIAYRRGREDMTAREEEIKHAEEEGVKFEFFLQPVEFIGDENGRVKAVKFERTKPLEERDSKGKRKIVGTGEYVTLEADTVIIAIGLEPNKIITEDGRLKTNPDGTIVVDENLMTSIPGVFAGGDAIRGEATVILAMGDGKRAAKAIDEYIRRKRGQNS

SEQ ID NO: 13799 - protein, 333 aa, Vibrio campbellii AND4
MTIKVGINGFGRIGRLALRAAFDWPELEFVHVNDVAGDAATLGHLLEFDSVQGRWSHAVQVDGTDMMINGKRISTSQESDIDAVNWGQCDVVIEATGVHRTTSFLNKYLEQGVKRVVVSAPVKEDGVANIVVGVNDHIFDPVLHRIVTAASCTTNCIAPVVKVIHEKLGIEQSSFTTIHDLTNTQTILDAPHKDLRRARACGMSLIPTTTGSAKAIVEIFPELKDKINGHAVRVPLANASLTDIIFDVKRDTTAEEVNALLKEASESELQGILGFEERPLVSIDYKGDQRSTIVDAQSTMVVGSRMVKIYAWYDNEMGYATRTAELVRNVGMA

SEQ ID NO: 13800 - protein, 381 aa, Bacteroides fragilis NCTC 9343
MGQTMKPFDVYPVFDINIVKGERCSVWDDKGTKYMDLYGGHAVISVGHSHPSFIDALTKQAGKLAFYSNSVKNELQQELAERLGRMSQYEDYKLFLVNSGAEANENALKLASFYNRRTRVIAFKNAFHGRTSLTVEATDNPKIIAPINQNGHVTYLPLNDTESLVRELSKGDVCAVIIEGIQGIGGIQLPTSQFMQILQQECNKTDTILILDEIQSGYGRSGKFFAHQYDGIRPDLITVAKGIANGFPMGAVLISPQFTSIYGQLGTTFGGNHLACAAAISVLDIMEKEELVVNAKQVGDFLIDELRKMPYIKEVRGRGLMIGLEFDVAVREIRQRLLFEQKVFTGVAGNNVIRILPPLCLTMDEAQEFLSRLSAILHITI

SEQ ID NO: 13801 - protein, 397 aa, Bacteroides fragilis NCTC 9343
MNQVSSHVTRLSPSATLLMSQKSAELKAKGVDVINMSVGEPDFNTPGHIKKAAIEAIEQNYSYYSPVMGFLSLREAIANKLNNENGVNYSASQIICSNGAKQSVCNAILAVVNPGDEVIIPAPYWVSYPEMVKLAEGVPVVVPTEIEQDFKITPSQLEAVITSKTRAIILSSPNNPTGTVYSRQELQELANVLSKHEHVLILSDEIYEHVNYVDKHESIAQFPTIKERVIIINGVSKAYAMTGWRIGFVAGPEWVVKGCSKLQGQYTSGPCSISQKAAEAAYRGLQNCVEEMRLAFERRRDLVVRLGKEIAGLEVNIPEGAFYLFPKCSSFFGKRYKDWVINNSTDLVMYLLEVGHVAAVSGDAFGAPGYFRISYATSDENIVEAMKRIKSALELLV

SEQ ID NO: 13802 - protein, 324 aa, Archaeoglobus fulgidus DSM 4304
MKVSIIGCGYVGLVTGLGFAELGNPVVFVDSNGSKIKSINDLIPPIYEPGLEELIKKNEGKFYATNDYFEALDNSEVSFICVGTPSKEDGSLDLRQVEEASSKLGKALAEKEFHVIVVKSTVLPGTTENFVKPIIEKESGKKAFDDFGLAMNPEFLREGNAVEDFFNPDRIVIGVKDERTKSVLEELYKPFDCPKLITEIKTAEMIKYASNAFLATKISFANEIGNICKKLGIDVYKVFEGVGLDHRINPSFFRAGIGFGGSCFPKDVRALIRKSEELGEDLQILKAVIEVNEKQPLKMIELLKKHIPDLRGKISVFCPFLGLK

SEQ ID NO: 13803 - protein, 194 aa, Buchnera aphidicola str. APS (Acyrthosiphon pisum)
MQLIEKAMLPTPWGNFLIFGFEEKKNGKNHVALVYGDIKTNTPTLSRVHSECLTGDAFFSLRCDCGSQLEMSMKRISQEGSGVLIYHRQEGRNIGLLNKIKAYALQDRGLDTVQANQKLGFSADERDFSLCADIFNILNIKKIRLLTNNPFKVQMLSDAGINIVERVPLIVKKNPKNAYYLKTKAEKMGHLLSE

SEQ ID NO: 13804 - protein, 259 aa, Bacillus sp. SG-1
MRLPIYQIDAFTDQQFKGNPAAVCPLEHWIEDELMQKIAAENNLAETAFFVKKDNDYELRWFTPKEEIDLCGHATLASAFVIFNYMDTTLEQINFYTKSGVLEVSKEGALLSLLFPSRPGKPCEVPHELIKGLGREPKEVYKARDYLAVFETEQDIVDLAVNVEELKKLDALGVIVTARGTEVDFVSRFFAPRAGIDEDPVTGSAHCTLVPYWSEVLNQSKLTALQLSQRGGKLYCKDLGDKIKMAGEAVAYLEGYINV

SEQ ID NO: 13805 - protein, 287 aa, Magnetospirillum magnetotacticum MS-1
  misc_feature (32)..(32): Xaa can be any naturally occurring amino acid
  misc_feature (34)..(34): Xaa can be any naturally occurring amino acid
MVASNDAPLGTAFTVTVDVRHGLTTGISAEQXAXNTVRALANGNMGAGDFVRPGHVFPLIARDGGVLMRSGHTEAAVDLCRLANLPPVGVICELANDDGTVMKGPQIDAFSEQHGLKRVSVADLIAYRQARDRLVERVGSFPVKTEFGAMTGYAYVTPFEPIQQFAFVHGAIGDGRNMPVRLHRSNVVADVIEGGGQIEAVMRRFAKEGRGILVYLRDGTAGVPLNRYADEGAEAQRVRQWREVGLGAQILRDLGVVSIRNLSSSSRSYVGLSGFGIELVGEEPLEG

SEQ ID NO: 13806 - protein, 126 aa, Rubrobacter xylanophilus DSM 9941
MNRNTEEDRILLEGMTFFGRHGTLEAERELGQPFVVDVEMRLDLRPAGLSDDLSKTVDYSAVHRLARRIVEGEPVGLTETVAERIAAKVLEEHPAVEAVRVKVRKPHVRLEGTVLAGSAVEIVRRR

SEQ ID NO: 13807 - protein, 271 aa, Glycine max
MASLIESGWQYLITHFSDFQLACLGSFFLHEGVFFLSGLPFIWLERAGWMSKYKIQAKNNTPAAQEKCIVRLLLYHFGVNLPVMIFSYPVFTYMGMRSSLPLPSWKVVLIQIIFYFILEDFIFYWGHRILHTKWLYKHVHSVHHEYATPFGLTSEYAHPAEILFLGFATIFGPAITGPHLITLWLWMVLRVLETVEAHCGYHFPWSLSNFLPLYGGADFHDYHHRLLYTKSGNYSSTFTYMDRIFGTDIGYRKLKALKSIGVEDSGEQKKQ

SEQ ID NO: 13808 - protein, 536 aa, Xanthomonas campestris pv. vesicatoria str. 85-10
MSVIDSQLQVSGESFQHNAAAMRAVIDDLRHTLARTARGGSDAARVKHTARGKLLARERIDALLDPGSPLLEIAPLAAHGMYDDQVPCAGVVAGIGRVSGVECVIVANDATVKGGTYYPMTVKKHLRAQEIAQQNRLPCIYLVDSGGAFLPLQDEVFPDRDHFGRIFYNQANLSANGIPQIACVMGSCTAGGAYVPAMSDETVIVREQGTIFLGGPPLVKAATGEEVSAEDLGGADVHTRISGVADHFADNDLQALARVRAIIAQLNWRKPAASLALQAPLPPRYAADELYGVIPADTRKPFDVREVIARIVDDSRLDEFKPRYGSTLVTGFAHLHGYPVGIIANNGILFSESALKGAHFIELCTQRGIPLVFLQNITGFMVGRKYEHGGIAKDGAKLVMAVACAKVPKFTVVIGGSFGAGNYGMCGRAYSPNFLWMWPNARIGVMGGEQAASVLATVRRDGIEAKGGAWSGEDEDAFKAPIRAQFEQQGHPYYASARLWDDGIIDPADTRRVLGLGLSAALNAPIEPTRFGVFRM

SEQ ID NO: 13809 - protein, 472 aa, Salmonella enterica subsp. arizonae serovar 62:z4,z23:--
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLHDEFGAVTIGNIERYINDKAFEMGWRPDMTGVRQTDKRVAIIGAGPAGLACADVLTRNGVKAVVFDRHPEIGGLLTFGIPAFKLEKEVMTRRREIFTGMGIEFKLNVEVGRDIQLDDLLKEYDAVFLGVGTYQSMRGGLENEDADGVFAALPFLIGNTKQIMGFGETSDEPYVSMEGKRVVVLGGGDTAMDCVRTSIRQGATHVTCAYRRDEENMPGSRREVKNAREEGVEFQFNVQPLGIEVNANGKVSGVKMVRTEMGEPDAKGRRRAEIVAGSEHVIPADAVVMAFGFRPHNMEWLAKHSVELDSQGRIIAPERSDNAFQTSNPKIFAGGDIVRGSDLVVTAIAEGRKAADGIMNYLEV

SEQ ID NO: 13810 - protein, 504 aa, Agrobacterium tumefaciens str. C58
MDSSSSGVSYKKADASYFEKRGLSRYAGVWSLWALGVGAVISGHFSGWNFGFSTGGWGGMLVAGIIIAIMYLGLTFSIAEMSPALPHTGAAYSFARTAMGPWGGFVTGLCENVEYVLTPAVVVTFITAYVNSILGLDPAYSPFVWIVFYAIFLALNVFGLELSFKVTLVITLISLAVLVFFWISAIPNIDFSRFALNIGVGPDGKAVELPEGGGSFFPFGFSGVLATLPFAVWLFLAIEQLPLAAEESVDPKRDMPKGIILGMVTLMVSAFMIVLLNPSLPGVGAFHLSSSLEPLLDGFKAIYGDGGVVLLGLVALTGLIASFHTILYAQGRQIYSLSRAGYFPTVLSITHSKYRTPYVANITGAIVGLAVMLVIWFSLGAEQGGSIIGSVLLNMAVFGAMFSYIMQAISFILLRKNLPNIERPFRSPFGIPGALLTIIIAIVTLLYQIQDPNFTKGVLWVAVWFAVAIAYFAFVGRHRLILSPEEEFALEHKQAAVAAAAAKA

SEQ ID NO: 13811 - protein, 80 aa, Zea mays
  misc_feature (52)..(52): Xaa can be any naturally occurring amino acid
MADWGPVVIAVVLFVLLSPGLLFQLPGRSRVVEFGNMQTSAISILVHTIIFXGLITIFLIAIGVHIYTWLGLFYSFFGKV

SEQ ID NO: 13812 - protein, 347 aa, Agrobacterium tumefaciens str. C58; identical to SEQ ID NO: 942

SEQ ID NO: 13813 - protein, 96 aa, Oryza sativa
  misc_feature (50)..(50): Xaa can be any naturally occurring amino acid
MVTTRTGRSYPHLPPDDATRLEADALGYFHSMTRRPPSKPARSDPSDASXGGAEGYANSKLNELRRLWDLEVKTQKLVLDRGDFNGEDVLRTKYFK

SEQ ID NO: 13814 - protein, 610 aa, Vibrio angustum S14
MSTPLETPQLSQLNVFPVKSIAGISQSKVWVEKQGISFDRRFMVATLSGDMITARKSPKMVKVKAALIADGIVLSYEDKACLVLKYAQFDMAEASSTVWGDTFIAYTTTEQANAWFSDVLGQPVQLLFTGEQSNRLRPKISQNVSFADGYPLLVISEASLQALNERSSEHHTMDQFRTNLVVSNTEAFAEDGWKRIRIGEVEFEAVKPCARCILTTVDPKSATFSESKEPLVTMAKFRADEKGNVYFGQNLVARNEGIISVGDTIEILETKPKEIYADNSEQKLQLTCVEREDIAQDFTTFWLESHQENQALPTYLPGQHLPIQLEVNGEYISRRYTLSSSPSRPGRYAISVKRVNDGRISNWLHEHFQVGDTLVSESPSGDFHLGVHTDKLLLLSGGSGVTPMMSMLRYLSDHDLVRDVVFYHQCRTEADIPYLEELRAIEEKHPSLDLRIVLTQPKRDWQGESGRLSIGHLAMMSDLDKRQVFVCGPDAFMSSAKKLLLNMGMAASRYHQEAFGPVRHALEEKKSVELSIDGQLFQGNNQATLLEQAETAGINMDYSCRAGFCGACKVTVKSGEVEQPEVPALSSQERAEGKVLACCCVPRSDLEIIK

SEQ ID NO: 13815 - protein, 382 aa, Aeropyrum pernix
MARLLMIPGPTPVDPGVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGIYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIAAIERSLVELGYREARLGQGLEAAQKELSSLGL

SEQ ID NO: 13816 - protein, 232 aa, Oryza sativa Japonica Group
MAAVVRCKPTRLTPIAGLSSSSGGGRRKKAGRRGEAKPPPPPPPQLRGGETKKKKKPDARTAAEAAQGLQRHEVERRKKPPPRPPPPKQEKAKRVVRWKCAAGCGACCKLDKGPDFPSPEEIFAEHPEDLKLYKSMIGADGWCINYDKSTRTCNIYEERPVFCRVEPKVFEEYFGVPSRPSTFDREACSACVDTIKMVYGEESAELTNFKRVIREESKKHEASLNQDKLLDT

SEQ ID NO: 13817 - protein, 432 aa, Streptococcus mutans UA159
MSIITDVYAREVLDSRGNPTLEVEVYTESGAFGRGMVPSGASTGEHEAVELRDGDKSRYGGLGTQKAVDNVNNIIAEALIGYDVRDQQAIDKAMIALDGTPNKGKLGANAILGVSIAVARAAADFLEIPLYSYLGGFNTKVLPTPMMNIINGGSHSDAPIAFQEFMIVPAGAPTFKEALRWGAEIFHALKKILKERGLETAVGDEGGFAPKFDGTEDAVETIIKAIETAGYKPGEEVFLGFDCASSEFYDNGVYDYTKFEGEKGAKRSAAEQIDYIEELVNKYPIITIEDAMDENDWDGWKALTARLGDRVQLVGDDFFVTNTDYLARGIKEGAANSILIKVNQIGTLTETFEAIEMAKEAGYTAVVSHRSGETEDSTIADISVATNAGQIKTGSLSRTDRIAKYNQLLRIEDQLGEVAEYRGLKSFYNLKK

SEQ ID NO: 13818 - protein, 382 aa, Aeropyrum pernix
  misc_feature (16)..(16): Xaa can be any naturally occurring amino acid
MARLLMIPGPTPVDPXVLLAMARPVISHTSPEFDEIHSETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVSLTGSQKALSTPPGLAIVAFSSEYSVELEKKEPSGIYFDFLSLSREMESTRNYHITPAVNLVFALNASLKRILSEGLENRFERHRILARAFTSAMEALGLRLVAEEPFRAWTVTAVYLPQGIEWSRFYSVMRKRGVEIAGGLGGLKGKIFRVGHMGEVDANDLIATIAAIERSLVELGYREARLGQGLEAAQKELSSLGL

SEQ ID NO: 13819 - protein, 585 aa, Candida albicans SC5314
MKTCYYELLEVSSTATDTELKKAYRKKALLLHPDKNPDNVEEANHKFSLVRAAYEVLSDPQERAWYDNHKQSILNDEDEIIEGESYLPSISTEEIYRFFNPSMYTEINDSISGFYQVVTRIFARLAHEEIQHGKYSKIPGYEKYHDDDDKNINAIDPSLLKYPRFGNSQSSYIDQIRPFYNVWGSFQTCKTFNWKDEYRYSVAPDRRTRRMMERENKKLRDEARKEYNETIKKFVSFIKKRDPRVKLGQEELNKLNKRKQLQEYENQIRQQQQLNKLKNNNNGGDAKFTEQDWQKLTPEELQELEQMLQEEYEEEEEADSTDSEFGHDDNENFEVHEFECIVCDKIFKNEQQFQIHEDSKKHKKNVRQLQWEMKQEGIELGIDKHDGDDLSEFETASSEFHDDDDDDDDDTDVSEELEEEDLEDQDNELKTGEDNLVEKSTDNIDLDNLEVDDEIDEDIVANITATPKKESKPTLNEVEEDLAQLLGQTSLSSSKDIDESDDDWSDNKRKHTKKGKKTKKKSQTNSKESTPNTENKPIINNIEKCSVCGTTFESRNQLFNHVKSEGHAAPPPKSKSKSKKKNKRK

SEQ ID NO: 13820 - protein, 252 aa, Mesoplasma florum L1
MAVTIKSPQEIEKMRVAGQVLAEAIDMLKSMIKVGVNCLDLDKEFEKFITEKGCKSNFKNYHGYPKTICISINEQLVHGIPQDRILEEGDLVSVDTGCVFEGYHADSAFSMIVGIAKDTKHDILLKVTEECLDLAIEALAPGVRIGTIGSIIQNHAESFGFGVPRDYTGHGIGTEMHEDPFIPNYGKKDTGMRLQAGMVICIEPMIQMGTFKTKLAADNWTVLSADKSMTAHFEHTILITDSGYEVLTKSKR

SEQ ID NO: 13821 - protein, 409 aa, Bacillus pumilus SAFR-032
MVKTYTCQNGVRIVLENNPTVRSVAIGVWIGTGSRHETPEINGISHFLEHMFFKGTKTRSARDIAESFDRIGGQVNAFTSKEYTCYYAKVLDSHAGYALDVLSDMFFHSAFDEEELKKEKNVVYEEIKMYEDTPDDIVHDLLSKAIYGDHSLGFPILGTEETLSTFNGDSLRAYMDEFYTPDRVVISVAGNVDDTFISEVEKLFGSYETKGKKQPVEAPQFHYDKLTRKKETEQAHLCMGFNGLPAGDKGIYDLIVLNNVLGGSMSSRLFQDVREDKGLAYSVFSYHSSFADNGMLTIYGGTGAKQLNLLSETILQTLDVLKREGITQKELENSKEQMKGNLMLSLESTNSKMSRNGKNELLLGKHRTLDEIIDEINKVTLDGVNNLSKRIFTEDYALSLISPTGDQPS

SEQ ID NO: 13822 - protein, 517 aa, Pisum sativum
MAKLLALSLSFCFLLLGGCFALREQPQQNECQLERLDALEPDNRIESEGGLIETWNPNNKQFRCAGVALSRATLQRNALRRPYYSNAPQEIFIQQGNGYFGMVFPGCPETFEEPQESEQGEGRRYRDRHQKVNRFREGDIIAVPTGIVFWMYNDQDTPVIAVSLTDIRSSNNQLDQMPRRFYLAGNHEQEFLQYQHQQGGKQEQENEGNNIFSGFKRDFLEDAFNVNRHIVDRLQGRNEDEEKGAIVKVKGGLSIISPPEKQARHQRGSRQEEDEDEEKQPRHQRGSRQEEEEDEDEERQPRHQRRRGEEEEEDKKERGGSQKGKSRRQGDNGLEETVCTAKLRLNIGPSSSPDIYNPEAGRIKTVTSLDLPVLRWLKLSAEHGSLHKNAMFVPHYNLNANSIIYALKGRARLQVVNCNGNTVFDGELEAGRALTVPQNYAVAAKSLSDRFSYVAFKTNDRAGIARLAGTSSVINNLPLDVVAATFNLQRNEARQLKSNNPFKFLVPARESENRASA

SEQ ID NO: 13823 - protein, 593 aa, Hyphomonas neptunium ATCC 15444
MRHLPALTAALILAACAPAAKAPPASSITPVSDETPEALGDLSWTKGAMVAAADPRAVEAGLRVLSEGGNAVDAAIAVHAVLGLVEPQSSGIGGGAFMVYYDRASDEITVFDGRETAPAAAGPDWFSKDGKPMDFLTAWQSGRSVGVPGQIALYKTAHDAAGQGDWASLFQPAIELAEVGFEVSPRLAEVLASERLRAVIRLDDNPVTAAYFYPDGQPLAAGYRRTNAAYAATLAAVANEGPAAFYTGALAAEIVNATNEGPDGGNMTLDDLAGYEVKVRSALCGTLQSGYKICSAPPPSSGGITQNMIMGLYEHLRPGPTVNADESLLLKAFVDAQRLAYADRDHYVADADHVTVPSAELINPDYLEARAKEAFAPDGKVFPGDPGVVLGGEPMRPMWGEDPTTPGAGTTHISIIDLEGNAVSMTATVEAAFGSSRMAGGFLLNNELTDFSLIPEMGGKPVANAVAAGKRPRSSMSPTLVFDEAGDLFMVTGSPGGNSIVAYVSKTLMGVLEWGKTAQEAAALPNIIARGNTVGVEVDIDGGPEAAEALRGMGYTVEERTGENSGLHVIVVRDQGLEGGADPRREGVALSLR

SEQ ID NO: 13824 - protein, 403 aa, Oryza sativa Japonica Group
MPPRQWRPMLASATKCCAAEDAVVAVDGSGGGGGLARCRPARSEFSRRLASFRKLSSMTNSPASSVAGAAEGGKDDGEEGGCGGGGVSGPLQLYSFSFSELRSITHDFSSSYLLGEGGFGAVHKGFVDAGMRPGLLPQPVAVKQLDIAGLQGHREWLAEVIFLGQFRHPHLVKLLGYCCEDEERLLVYEFMPRGSLENHLFKRISATVPWGTRLKIAIGAAKGLAFLHGASTPVIYRDFKASNILLDSEFTAKLSDFGLAKMGPEGSETHVTTRVMGTHGYAAPEYVMTGHLNIKSDVYSYGVVLLELLTGRRAMEHVRGRSLHADQCTSPQPRDRPRMAAVVDALERLQGFKDMAVTVGLWPTNAPVAGRNAISAKIRAEVRGAGSGGGAASRRRSASAKLP

SEQ ID NO: 13825 - protein, 333 aa, Kluyveromyces lactis NRRL Y-1140
MGIVVVGSLNFDLVTYTERVPVAGETFVADSFETHAGGKGLNQCISLAKLTKPSDDQTSNIRMVGHVGSDSFGNQLLSKLQYHNINTEYVEEVDDESTGVAVIIVEKAKGQNRIMITAGANSKTMYSDKQLEVMFQNNAKEFIVFQHEIPDPPSIMNWIKANRPNFEVVFNPSPFHALKVEDWKSVDILIVNEIEAIQIGESLYGEAVVENYKSRIAESFKLGYLELAQYYQSNLINTSNSSVVIITLGEFGAVFTSKQNVKGGHVPSIAVEKVVDTTAAGDTFLGAVVSQLYQKRDLEKAIQFATVASSITITRKGAAETIPLYDEVINKIE

SEQ ID NO: 13826 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTDHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPAAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 13827 - protein, 577 aa, Desulfovibrio desulfuricans G20
MSHASLTAKYRPQTFADVAGQETVKAILSRAAAENRVAPAYLFSGTRGVGKTTIARIFAKALNCTRGPAAEPCNECEQCRKITQGMAVDVVEIDGASNRGIDDAKRLKEAIGYAPMEGRYKVFIIDEAHMLTREAFNALLKTLEEPPANVTFVMATTEPHKFPVTIVSRCQHFIFKRLTENGLAAHLVRILEREGTGYESEAVKLIARRAAGSVRDSMSLLGQVLALGSDSLTVADARGILGLAGQELFFRVADAIRRQDCVGVSTVLRDVLDQGLDLGFFLRELTGMWRNLFMLRQAGESALPLLDLPEEEARQWLEWAPQFALSHIHACWQMTLEGQRRVLNSLEPAMALELLLLNLAFMPRLLGMQQVSQTAPAPVPVAGDGPAPSGGSSGTPPAGGHAAPPRSAPSVPSVPDPAGTSGRVADAAKPQQQAQADSTAPPPAEDAPPGQSEPSGPATWEGFAQFCLQQNGQDGKSLRLLRQIKGELRDGVLHITPAYQMQRDRLTQPEMAAALETLARSYWGAGVTVAVGEPTEQRKAISDLRKELDDHPAVQLLKEELGARVLAVRYMEKNNND

SEQ ID NO: 13828 - protein, 293 aa, Ustilago maydis 521
MTLATRTSTLRSAARYAAAFSNSSNLARVAPLARRTMITTSSATTLLRSRTASPCVATIRSTSASQIQKRTMFIQTESTPNEDSLKFLPGRQVMESGTHEFLDTRSSMASPLAKKLFNIPGVVSVFYGPDFVTVSKDAEHQWSILKPEIYSSIMEFFTSGHPLFTDPESAAGSQDTVILDTDSEVVAMIKELLDTRVRPAIQEDGGDLEYRGFGEDTDGIVKVKLKGSCRGCDSSTVTLKSGIERMLMHYIPEVKGVEQVLDPEEEIALDEFAKLEQKLEKDRKKERDMGFSL

SEQ ID NO: 13829 - protein, 266 aa, Buchnera aphidicola str. APS (Acyrthosiphon pisum)
MHPMLNIAIRAVRKGGNFIIQNYERRKFVKEDVEKNKVFLNNIIYKTNKIISEIIHKSYPYHTILKKHENILVKKNEKNTVWIITELDGKTNFLKYFPYFCVSIAVVVKNKTEISVIYDPIKNDLFTAVKGQGSQLNGYRTRCSAINTLNYSTVAVNPSNKIHNLTSSYFEIYKKLIISGISFRCTGSSILDSAYVAAGKIDCLFDFNLDPNKFVASKLQVREAGCLINNFMGEYEHNNNNYSGNITSSSKFIRLINEKIRECYLI

SEQ ID NO: 13830 - protein, 139 aa, Desulfovibrio desulfuricans G20
MPTILIVEDDPITRGILRDIVTSYGHKVLDVADGRTAWERLQNDPDIDLMITDVRMPGLDGMELVGMLRSNDRLQGLPVIITSGVVGLRQIARLLRRGASSFIAKPIDPKELQHCIQNTLAAGTGVPHSSRPDDVSARS

SEQ ID NO: 13831 - protein, 174 aa, Crocosphaera watsonii WH 8501
MANAYPLVTKKVFMDISIGGEKAERIVIGLFGEVVPKTVDNFYQLCTHEKGFGYRQSSFHRVIKDFMMQGGDFTRGNGTGGKSIYGEKFPDENFTVKHNGRGWLSMANAGPNTNGSQFFITFTQTPWLDGKHTVFGKVLEGLEVLDKVENCDTDGRDRPQQDIKIEDSGSLPVE

SEQ ID NO: 13832 - protein, 544 aa, Arabidopsis thaliana
MASLQLYGVKTPGLALSSKRLEFASKGACFSVTLPSSSAVFRDVEHSCRNIGLRVSCEALRVDLLQRKEPETCDSSGTGKELTCVMKFGGSSVGSAERMKEVANLIFSFPDERPVIVLSAMGKTINKLLKAGEKAVTCGVTNVGSIEELSFIKELHLRTAHELGVETTVIEKHLEGLHQLLKGISMMKELTLRTRDYLVSFGECMSTRLFSAYLNKIGHKARQYDAFEIGFITTDDFTNADILEATYPAVSKTLVGDWSKENAVPVVTGYLGKGWRSCAITTLGRGGSDLTATTIGKALGLREIQVWKDVDGVLTCDPNIYPGAQSVPYLTFDEAAELAYFGAQVLHPLSMRPARDGDIPVRVKNSYNPTAPGTVITRSRDMSKAVLTSIVLKRNVTMLDIASTRMLGQYGFLAKVFTTFEDLGISVDVVATSEVSISLTLDPAKLWGRELIQRVNELDNLVEELEKIAVVKLLQRRSIISLIGNVQKSSLILEKVFQVFRSNGVNVQMISQGASKVNISLIVNDEEAEQCVRALHSAFFETDP

SEQ ID NO: 13833 - protein, 518 aa, Oryza sativa Japonica Group
MLPRSRTLPPRIHDGVVVVERDVRRYQQLPQQVEMEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMDAVKANLGGAKVKVCGCIQYLNLLGVAIGYTIAASISMMAIQRSNCFHARGEQDPCHASSNVYMIMFGIVQVFFSQIPDFDQVWWLSILAAVMSFTYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 13834 - protein, 401 aa, Agrobacterium tumefaciens str. C58
MTETAPWTTRKPTAMLVLADGTVIEGTGIGATGKVQAEVCFNTALTGYEEILTDPSYLGQIVTFTFPHIGNVGTNEEDIEDLTPAARRGAVGVIFKADITDPSNFRAVKHLDAWLKARGVIGLCGIDTRALTAWIRENGAPNAVIAHDPNGVFDIEALKAEAKAWSGLVGLDLAIEATSGQSSTWTETPWVWNKGYGTLGEADAKYHVVCVDFGVKRNILRLFAGLDCKVTVVPAQTSAEDILALKPDGVFLSNGPGDPAATGEYAVPVIQNLIKSELPIFGICLGHQMLGLAVGAKTEKMHQGHHGANHPVKDFTTGKVEIVSMNHGFAVDTKSLPEGVEETHTSLFDGTNCGLRIVGKPVFSVQHHPEASPGPQDSHYLFRRFVNLLRENKGEAALAER

SEQ ID NO: 13835 - protein, 404 aa, Bacillus pumilus SAFR-032
MKIIVQKFGGTSVKDDQGRKRALAHILSAKEKGYKSVVVVSAMGRKGDPYATDTLLGLLYGSAQHMTNREKDLLVSCGENISAVVFSSMLNENGLKAVAMTGAQAGFVTDKEHTSAKIIDMKCERLEAALSEHDVVVVAGFQGAAKNGDVTTIGRGGSDTSAAALGAALQADFIDIFTDVEGVMTADPRIVENAKPLRVVTYTEICNLAYQGAKVIHPRAVEIAMQAKVPMRVRSTYSDEEGTLVTSHYSDKMSHDVYDRLITGIAHVNDVTQIKVPAKEGQYSVQTEVFKAMANAQISVDFFNITPSEIVYTVTGAMTEKATSILKDLGYTPIVTTNCAKVSAVGAGIMGVPGVTSKIVSALSEQNIPILQSADSHTTIWVLVNEENMRAAVNALHEVFELSR

SEQ ID NO: 13836 - protein, 790 aa, Candida glabrata CBS 138
MIALSLLVSQLVLYLSLADASRLEKYQNYKRDEDSSRALSDYPLGCSPLLGTKLTPGLSMELYEYPLDNHGIGPHCWDPAYLNPEYPRTGFESHKLIGTAQNVMSLNFEHRTQDCHVEFSNLPASFNFPDQITLTNFTMLLYGYFKPKESGRYRFHMEADDLLLMNLGAGNAFDCCAHEATRNNLGDYIAYDIWAGTRKDVEVFLEKEVFYPLRLFFNNRDGRAALDFSYYLNGATEPGTDIPELLFSLPDGESCPAYIGYENSCRSINTTTTYSTSYITTMQAPNVLPITSTIYYVATPCADVPETPSCQIGFWDPINSSCYTPTPPGLSSSPSPSPSPKPSPSPSPSPSPSPSPSPSPSPSPSPSPSPSPSPSPSPSPSPSPSPKPSPSPSPSPSPSPSPSPSPSPSPSPSFSPGPKPSPSPKPSPSPSPSPSPSPSPSPSPSPSPSPSPSPSPSPSPSPSPSPSPSPSPSPSPSPSPSFSPGPKPSPSPKPSPSPSPSPSPSPSPSPSPSPSPSPSPYPSPNPFPISNSSTSLSPSNISMHSYSSLYTGDPESPTNTKSIPTSIDLAVGNSTTITTTVVTNDKTQTIIIVCQPTTISDGRIITASHTWTYTEPTTSSHKTIDRVNSAGNNEGMNKLTSSATVSSNYSNSNSFHSSARPPSPIVTDSKPNAGVHSASKENSPSNVSNAETQPNNNEHSGSGTNLAPASSREDSKSVTNTSSRGNSGSISTANVVASSPSRNAVNSISNSRPVNPTVIGTVYQGSAVNRVSSIVMSAVAGLLFALVEVL

SEQ ID NO: 13837 - protein, 440 aa, Hyphomonas neptunium ATCC 15444
MSDAPPAADGLKRNVGLFGVVSLGLGTAVGVSIFSILAPAAAVAGPAMLVSMVIAIVPMIVFALIYSFMGAAAPATGASFEWPRRFVHPFAGFIISWMRIAGSTAALIVLTMVLVSYMSSLIALPTKLVMFGIFAAIFLINLAGVSFVARSQAVMLVILLATCAVFVFGGAGHVEPANFQPFADKGILGILAAIPLLISLFLGIESATEVGGEVRNPRRNIPLGIGISVALTAAIYFGVAVIAIGILGAAALGASSAPLLDAALVSLGEGGRALILVCAFVAIGSSINATFVIMTRFLYAMSRAGMLPSFLGKTNEARGIPQNAVFLAFGLCCLGLFMPQNLVFLFLAVNIPTILKYAATCLAAIGLCRREPELRAAASFSLPANIVYALAGAGIVLGFLIILLGISADWRPYVLLGGWATLGIAYYLFYLRPRGAGTAP

SEQ ID NO: 13838 - protein, 386 aa, Nocardioides sp. JS614
MDLMEYQAKELFAKHDVPVTLGIVAHTPDEAQAAAEQLGVVVVKAQVKAGGRGKAGGVKLAKTPEEARTHAEAILGMEIKGLRVNRVLIAPAASIEEEYYFSFLLDRANRRYLCIASVEGGVEIEEVAKTNPDAVRQIPIDPGAGVDEAKAREIVADAKFPEALTEQAVQTVLALWKVFVEEDATLVEVNPLARLAGDKLEALDGKVSLDENAEFRHEEHASFVIREEEDPLESAAKDKGLNYVKLDGSVGIIGNGAGLVMSTLDVVAYAGEKHGGVKPANFLDIGGGANAQVMADGLHVILGDEQVKAVFVNVFGGITACDEVANGIVGALDILGEDATKPLVIRLDGNNADEGRRILTEAAHPLVTMVDTMDGAADKAAELANA

SEQ ID NO: 13839 - protein, 350 aa, Arabidopsis thaliana
SPEMEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 13840 - protein, 378 aa, Arabidopsis thaliana
MKKLLVTKLLGPQALERSRGIRADELERFHSSLLDKAVKKEIVEIGKEATKLSNNSLWRMSIGRSFSEKNGEAERVRGLVTELDGLTKKVLFATLLHRPLEKLGISLFKKEIMCVSDSFDEVLERVLVEHEQKLDDHQDRDMMDVLLAAYGDENAGHKISRNHIKAFFVELFFAGTDTSAQSIQWTMAEIINNPNILKRLREEIDSVVGKTRLIQETDLPKLPYLQAVVKEGLRLHPPLPLFVRTFQEGCKIGGFYVPEKTTLIGNAYVMMRDPSVWEDPEEFKPERFLSSSRSTQEEERREQALKYIPFGSGRRGCPGSSLGYIFVGTAVGMMVQCFDWSIKGDKVQMDEAGGLNLSMAHSLKCTPVPRNRPLLADQ

SEQ ID NO: 13841 - protein, 515 aa, Cryptococcus neoformans var. grubii
MFQKVSDKFHRKQQSSTSPGKTQQVPNSPSSVLAKANSQAQQAYSSQDHSPMEGIQSDSTHIQQPMATQKAPIVGPSTSTSLSTVPVQDGTLPLTPGAQGMLAGTTDGHRQVQSPVSRSSSAGEDKMREKARDAQEQAAQAQANLHRVTQQARVAAINAAATQAALETATQLPATARVPTSGTGAEPGQARRKTAGRYALSDFLIERTLGTGSFGRVHLVRSRHNGRFYAVKVLNKEKVIKMKQVEHTNSEREMLVRVRHPFLVNLWGTFQDVNNLYMVMDFVAGGELFSLLRKSQRFPNSVAKFYAAEVALALDYLHSLDIIYRDLKPENLLLGADGHVKVTDFGFAKYVPDITWTLCGTPDYLAPEVVQSKGYNKSVDWYALGVLIFEMLAGYPPFFTEDGNPMKLYEKIIAGKVRYPTYFDVLAKELLKNLLIGDLTKRYGNLRAGSSDIFAHGWFAEVDWDKLYRREIPAPYVPKIDGEGDASQFDRYQEADVSAYGKVGNGPYDHFFVEF

SEQ ID NO: 13842 - protein, 99 aa, Medicago truncatula
MLLRPIYKQVAENQNAEIFSANTLLVILGTSLLTARAGLSMALGAFLAGLLLAETEFSLQVESDIAPYRGLLLGLFFMTVGAEYKKFANLLTVLFYLFM

SEQ ID NO: 13843 - protein, 330 aa, Medicago truncatula
MQTLQVGMSIDPKLFVSNFPVVTGTLALLICGKTLLVSLMGRIFGISVISALRAGLLLAPGGEFAFVAFGEAVNQGIMSSQLSSLLFLVVGISMAITPWLAAGGQLIASRFEQNDVRSLLPVESETDDLQDHIIICGFGRVGQIIAQLLSERLIPFVALDVRSERVAVGRALDLPVYFGDAGSREVLHKIGAERACAAAITLDTPGANYRTVWALSKYFPNVKTFVRAHDVDHGVNLEKAGATAVVPETLEPSLQLAAAVLAQAKLPASEISATINEFRCRHLAELSELCEASGSSLGYGFTRIMSKTKSQSPDALDLDDAQVSEGTLAV

SEQ ID NO: 13844 - protein, 292 aa, Kineococcus radiotolerans SRS30216
MSTGTATAPLGTLVPGTISPRRPVPPRIDRPEYVDQQAPLPYKGSHVIDPEGIERIRRAGKLAAQAMALVGEHVVPGTTTDELDRIGHEFLCDHGAYPSTLGYRSFPKSLCSSLNEVVCHGIPDSTVLADGDIVNIDITAYLDGMHGDTNATFLCGDVDEESRLLVERTREATRRGIKAVAPGRAINVIGRVIEAYAKRFGYGVVRDFTGHGVGPAFHSGLIVPHYDAAPAHATVMEVGMVFTIEPMLTLGTHEWEMWEDGWTVVTKDRKRTAQFEHTLVVTETGAEVLTLP

SEQ ID NO: 13845 - protein, 611 aa, Medicago truncatula
MWKVTRFAASSRSRLFSTAIPAPCMVHKRGADILHDPWFNKDTGFPLTERDRLGLRGLLPPRIISFQEQYDRFTITYYYFNFPVSSYRSLEKNTHGQSDKIVSLSKWRILNRLHDRNETLYYRALIDNIKEFAPIIYTPTVGLVCQNYCGLYRRPRGMYFSAKDKGEMMSMIYNWPAPQVDMIVLTDGSRILGLGDLGVQGIGIPVGKLDMYVAAAGINPQRILPIMLDVGTNNQKLLDDRLYLGLRQPRLEGEEYLSIVDEFMEAVHARWPKAIVQFEDFQMKWAFETLKRYRHKFCMFNDDIQGTAGVALAGLLGTVRAQGRPLSDFAKQKIVIVGAGSAGLGVLNMAVQAVSRMSGCSETAAKSQFFLIDKNGLVTTERSNLDPAAVPFAKNPRDLEGLAEGASIIEVVKKVKPHVLLGLSGVGGVFNEQVLKAMRESVSTKPAIFAMSNPTMNAECTAIDAFNHAGENIVFASGSPFENVDLGNGRAGHVNQANNMYLFPGIGLGSLLSGAHHITDGMLQAASECLASYMTEEDIQKGILYPSIDCIRNVTAEVGAAVLRAAIAEGLAEGHGGVGSKELEHMSEDDTVEYVRGNMWYPEYCPLVHEK

SEQ ID NO: 13846 - protein, 481 aa, Salmonella enterica subsp. enterica serovar Typhi
MTIWENAMQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 13847 - protein, 474 aa, Legionella pneumophila str. Paris
MANKIKTDVVVLGSGPGGYTAAFRAADLDKKVVLVERFDSLGGVCLNVGCIPSKALLHIAKVVDEAHEMSEQGVAFGKPKFDNKKLVAWKNSVVAKLTGGLKALAKQRKVEVITGTGKFSGTHQILVETKEGTVEIEFDNAIIAVGSESIKLPFIPEDKRIFSSTGALELADIKGDLLVLGGGIIGLEMATVYSSLGVNVTVVEFMDQLIPNADTDLVNILQKRMTKKGIKFLLKTKVTAVEAKKDGIYVSMEGEHATDKPLCFQQVLVAVGRKPNGGAINAEKAGIKVDERGFIPVDNQLRTNVPHIFAIGDVNGQPMLAHKAIPEGKVAAEVIAGKKHYFEPKCIPSVAYTDPELAWAGLTEKEAKEKGINYEKASFPWAASGRALSMGREEGMTKLLFCPETNRILGAGIVGVNAGDLIAETALAIEMCCDVEDIALTIHPHPTLSETIAQSAEAFEGTITDLYLPKKKKK

SEQ ID NO: 13848 - protein, 118 aa, Triticum aestivum
  misc_feature (94)..(94): Xaa can be any naturally occurring amino acid
  misc_feature (100)..(100): Xaa can be any naturally occurring amino acid
  misc_feature (110)..(110): Xaa can be any naturally occurring amino acid
HSRVYKVQSGDCVLVHAAAGGVGSLLCQWANALGATVIGTVSNEEKAAQAAEDGCHHVIIYTKEDVVTRVKEFTAGKGVNVVYDSVGKDTYKGXVECLAXRWYLVSFGAXSSKPDSIR

SEQ ID NO: 13849 - protein, 544 aa, Legionella pneumophila str. Paris
MTKESEIKIPDIGGANQVDVIEILVKEGDQIEVDTPLITLESEKASMDIPSPISGTVTQILVKVGDKVSEGDLIVKAKSDTTTNISSSQEQKTELEKQNSQTRPEEQSVDTKATASTPDSKDIEISIPDIGGANDVDVIDILVKPGMEVEKDQALITLEGDKATMDIPSPYAGKVIEMKIKLGDKVSQGTPILSLKTSGKTETPEIEKSQIKNISEQSIKEIEKPYEELKSEPISINNLEIAESKSILISAGPAVRRLAREFGVDLSLVQGSGRKSRITKEDLQNYIKVRLNEKTTSGGFSLPSNPAIDFSKFGSIETKPLNKIKKLTGANVHRSWITIPHVTQFDEADITDLEAFRKSESESTKNQDYKLTLLAFVCSVVCKALHAYPQFNASLDASGENLIYKKYYNIGIAVDTPNGLVVPVIKNVDKLSVIDIAKEMSRLSTKAREKGLTPIDMSGGCFTISSLGGIGGTAFTPIVNSPEVAILGLSRSTIKPIYDNKEFKPRLMLPISLSYDHRVIDGAEAARFTRFLCDCLGDIRRVLL

SEQ ID NO: 13850 - protein, 540 aa, uncultured marine bacterium 581
MSSIMNIDPELQSLANQIATRRVTECFEDDANRASDFRCTSNGLVLDYSKHHIDAPSRQRLLEIAQQSALAADFEALTRGDAINITEERAALHTLLRGTRKEESPELYAEVHATNSKLAQLVAKIHSGAWSGFGANRFTDVVNIGIGGSDFGPKMVCRALRTETDLMKSHFVANVDPQDLDETLASLDPQSTLFIICSKSFTTEETLTNALRARAWLLAAGAKDTDVNKHMVAVTTNLEGASRFGISPENCFPMWDWVGGRYSLWSAVGLSIALQSGWETFLRLLTGAHEMDIHTLGSHDKNNLPLMMALLEFWNTVYLKTDTHVVLPYAQALEKLPDFLQQLSMESNGKRVDLSGSALTLPSAPVLWGSAGTIGQHSYYQLLHQGNRRFTADIILPLSHKEKDLDAQRKLAANALAQSRALLVGRDKSAAQRLAAERGQPESFAPHYEMPGNHSHSLIYFESLTPEILGALIAAYEHKTFFLSRLLGINAFDQWGVELGKVIGRQILTMLEHGEGLEVIDPATAIAVEAWRSANAKNTS

SEQ ID NO: 13851 - protein, 449 aa, Arabidopsis thaliana
MRPKAVWEPEYHRVFVDLCVEQTMLGNKPGTHFSKEGWRNILISFQEQTGAMYDRMQLKNHWDTMSRQWKIWRRLVETSFMNWNPESNRFRATDDDWANYLQENPDAGQYRLSVPHDLKKLEILFAGCNVEVKNDEVSGVRKRRRSCYEEEDEDNQSMCSSSNPQTKGYWSPSTHKLFLDLLVQETLKGNRPDTHFNKEGWKTILGTINENTGLGYTRPQLKNHWDCTRKAWKIWCQLVGASSMKWDPESRSFGATEEEWRIYIRENPRAGQFRHKEVPHADQLAIIFNGVIEPGETYTPPSRSRKKLLHNRSESPQWRDTTPLSKMHVDEAETSRQNGCYAESQEDRIDSENAQPLDDMKLMNDVMLQESPVFVEIESAKPMYSIGECIKSLNAIEEVEQGSELYMFALDLFLKREYREIFLELKKPSLRIAWLQRLQSTSFPIPTTT

SEQ ID NO: 13852 - protein, 416 aa, Salmonella typhimurium LT2
MESKVVVPVEGKKITLQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLKCSEFGDAIIANM

SEQ ID NO: 13853 - protein, 277 aa, Rhizobium leguminosarum bv. viciae 3841
MVAKTDIRAFETGHPLKVMDPIWDSLREEARLAAERDPVLAAFLYSTVINYHSLEECVIHRICERLDHPDMQANLLRQTFEEMLLDWPDWSSILRVDIQAIYDRDPACLRFMEAVLYFKGFHALQTHRLAHWLLNRGRRDFALYLQSRSSSVFQTDINPAARIGKGIFLDHATGLVVGETAVIGDNVSILHGVTLGGTGKEGADRHPKIGSGVMIGAGAKILGNIEIGYCSRVAAGSVVLKAVPPKKTVAGVPAKVVGEAGCSEPSRNMDQVIGADI

SEQ ID NO: 13854 - protein, 271 aa, Oryza sativa Japonica Group
MSSPMHVRKAIHFVSMKAKLQSFGGLRLLLVGCLAALLLLFAVRTLSFTTSSATATAAREAAEAGCGKLPAAVAQAMVHYATANVTPQQTAAEIGVSLRVLQLRAPCNFLEDASWIASVKAGHPGLESYHVAYDTRVTDADELIALRHEPACTSQPDLAAAAAASCRLALRGLPPVFHEVEWDLIMVDAPTGWTPESPGRMGAIYTAGMAARARTPGAGATEVFVHDVDRHVEDTFSKAFLCDGYLVEQVGRIRRFVIPSHRDKDGTPFCP

SEQ ID NO: 13855 - protein, 82 aa, Brassica napus
MSDKGRPLPKFGEWDVNDPASAEGFTVIFNKARDEKKTGGKPGSPGKSSDGHAKSGGGGGGDPSKPHPKKWLCCMQSPAVDS

SEQ ID NO: 13856 - protein, 193 aa, Bacillus pumilus SAFR-032
MFNLPNKITLSRIALIPVFMIIMLAPLDWGVARFGHVSIEVTHLVGAILFIVASTTDWIDGYYARKLNLVTNFGKFLDPLADKLLVSAALIILVQYNLTPAWMAIVIISREFAVTGLRLVLAGGGEVVAANMLGKVKTWAQIIAISALLLHNLPFELVSFPFGDLAMWVAVFFTVVSGWDYFVKNWEALKNSN

SEQ ID NO: 13857 - protein, 207 aa, Bacteroides fragilis NCTC 9343
MNAMVLDDVIKSQAGYLNPYILEERQLNVTQLDVFSRLMMDRIIFLGTQIDDYTANTLQAQLLYLDSVDPGKDISIYINSPGGSVYAGLGIYDTMQFISSDVATICTGMAASMASVLLVAGAKGKRSALPHSRVMIHQPMGGAQGQASDIEITAREIQKLKKELYTIIADHSGTSFDKVWADSDRDYWMTAQEAKEYGMIDEVLIKK

SEQ ID NO: 13858 - protein, 109 aa, Zea mays
  misc_feature (77)..(77): Xaa can be any naturally occurring amino acid
  misc_feature (83)..(83): Xaa can be any naturally occurring amino acid
SLWQPCICALFPSWIYYSLTDSKIHNIVASCDVKFPINLDARAYSRGVFTSYDPELFPVLIYRMQRPAIVLVITAAXKIAVTXAQEREDTTLSSKHLVCTDSVYRTLTC

SEQ ID NO: 13859 - protein, 399 aa, Bradyrhizobium sp. ORS278
MASMTKFRTLDDVDPKGKRVLLRVDLNVPMENGHVTDATRLERVAPTINELATKGGKVILLAHFGRPKGRDAKDSLKPVADALSKVIKRPVAFADDCIGEPAAKAIAAMKDGDVLCLENTRFHKEEEKNDPAFVAELAKLGDIWVNDAFSAAHRAHASTEGLGHKLPAYAGRTMQAELDALDKALGRPAKPVIAIVGGAKVSTKIDLLENLVTKVDALVIGGGMANTFLHAQGVQIGKSLAEKDLAATALRIMEKAEAANCAIILPVDATVSYHFAANSPSFAYGLDAIPPDSMILDVGPQSTARIHAAIDDAATLVWNGPLGAFELNPFDRGTMVAAKHAAERTKAKKLISVAGGGDTVAALNQAGVAGDFSYVSTAGGAFLEWMEGKPLPGVEVLKA

SEQ ID NO: 13860 - protein, 260 aa, Oryza sativa Japonica Group
MSAAATAGTYSPASAAGEKRRERKEELRRHLAEDADWPRADGRSFHDCRPAFMQTGPTTAASGSAYAEFGKTKVIVSVFGPRESKKAMLYSDTGRLNCNVSYTTFATPIRGQGTDNKEYSAMLHKALEGAVMLHTFPKTTVDVFALVLESGGSDLPIIISCASLALADAGIMMYDLVTSVSVSCFGKNIIIDPTSDEEAWQDGSLMVAYMPARKEITQLTLTGEWSDGKITNAVELCMDACSKLCDILRERLKDASSLAE

SEQ ID NO: 13861 - protein, 335 aa, Bradyrhizobium sp. ORS278
MAVRVGINGFGRIGRNVLRAIAESGRKDIVVVGINDLGPVETNAHLLRFDSVHGRFPHTVTVDGDTIDIGQGKIKVTAERDPSKLPWKDLGVDIALECTGIFTSKDKASAHLTAGAKRVLVSAPADGADATIVYGVNHATLTKDHLVVSNGSCTTNCLAPVAKVLNDTVGIETGFMTTIHAYTGDQPTLDTMHKDLYRGRAAAMSMIPTSTGAAKAIGLVLPELKGKLDGVAIRVPTPNVSVVDLKIVAKRNTEPKEINEAIKRAAEQELKGVLGYTNAPNVSIDFNHDPHSSTFHMDQTKVMNGNLVRVMSWYDNEWGFSNRMADTAVAMGKLL

SEQ ID NO: 13862 - protein, 185 aa, Brassica napus
MMKPTAKSIERVGRFLRKSLGSIKSTICFGKHHTVPKNNNSPLLSPFSCSLHRSCPQDSQTEETYSVFSSESTAVAETRDESLINKVQHKKKPKKKKVAEPLEEAKRRGETLAQKMKDFNMVDLRDVEHASDVQEALRCYSSIRSPVYLDIVDNFFTDMYYEFSDPLTITSSIKGSRRKAGSLRL

SEQ ID NO: 13863 - protein, 402 aa, Solibacter usitatus Ellin6076
MHATAMVVGIIIGASIFVQPSEINRHVPTIPGVLSVWTVAGILTLFGALVCAQLSTVFPRTGGVYVFLKETLSPAFGFLWGWAMFWSAHSGIIAASSVVLARYVAYFVPLGDTGIRAVAIAGILVLSFVNYLGVRQGSLLQTIVTATKLVAILLLLILVLLWGKPAGLSSAPPAPAAPFREFVLAVSAALFAFGGWHMVTYTAGETRDPVRNIPRALLIGTLTVTGVYLLLNAAYLYLLPIDRVIASTRVAADAAQAVAGPPGASLISALVILSATGVLNGVILAGPRTYYAMAREKLAFQWLGSMRHAIVLQAAWSCILVATGTYRALFTRVIYTEWLFFALMAIGLMRLRRRIAFVPAVFAFAAVVVAVIQIAADPLQAGTGLLIVVLGLPVYHYWHAHH

SEQ ID NO: 13864 - protein, 366 aa, Kineococcus radiotolerans SRS30216
MGRRLRVEADGGSRGNPGPAGYGAVVKDAATGEVLAEVAESIGRATNNVAEYRGLVAGLRAAQAVDPEASVEVRMDSKLVVEQMSGRWQVKHADMRALAQEARSLVRPGLVDFGWIPRAQNSHADRLANEAMDAAAAGRAWQRAGASGTASPAAAAPPAAEADPDAPPTVLVLVRHGSTALTEQRRVSGRYGEDPELSDRGRAEAAAAATCWDVQDADVVVTSTLRRSQQTARIIAEALGADVVVDPQWDETDFGEWDGLTAGEVVKRWPREFAAWNDSPEAAPPGGESIATVERRVLAARDDLLRRWAGRRVVLVSHGDPLRVLLRSVLGVDGRMQRRIHVDPGSRTLLRYRADGTGEVLAVNRV

SEQ ID NO: 13865 - protein, 417 aa, Neptuniibacter caesariensis
MSFVSLGLSDFFTSTLSSLGYKEPTAIQDKAIPAVLKGHDLIAAAETGSGKTAGFVLPLLEKLHSIPAPGNNLTHALVLVPTRELAVQVSQSVDRYSENCPRKIRSVAIYGGAAINPQMQSLSKGCDIVVATPGRLLDLMRKNALDLRGLKALVLDEADRMLDLGFADELDDILDQTPGNVQTLLFSATFPDKVKELTEELLRNPVEISVKQEATLPDQLHQRAIEVDRNNRTMLLKHLIKQEKWQQLLIFVGSKRTANNIELKLYRSGIQSSTLHGDLTQKERLGALEDFSKGRCKILIATDLAARGIDIPSLPCVLNYDLPRATSDYVHRAGRTARAGEAGLAISFVDHESDAHFKLIEKRIRMKIPREQIPGFERAQEPPKEVTQKKGQAPVKGKRKSKKDKLREAAALAAKNS

SEQ ID NO: 13866 - protein, 321 aa, Populus trichocarpa
MAPEPVMEVKIPPRDDLAEITRSTRDLPPAHYTFKIENFSLLANAKIDNFESGDFEVGSYKWRLRLYPNGNKKNNGDGHISLYLAFSNSNALPFGWEVNVNFRLFVYNQIQDKYLTIQYAKGRVRRFHGMKTELGFDQLIPLTIFNDESKGYLIDDRCIFGAEIFVIKPTGKGECLTLVNQPVSDTFTWKIQNFSALDQESYKSQVFSFGGYKWALLVYPKGNSTEKGKSLSIYLKMEDFETLPCGRTTYAEYMLRVKDQLFGKHIEKKAYSHFSYSIKDWGHLNFMSLDDVNALPKGFLVNDTLAVEVQIHVITVVKEFS

SEQ ID NO: 13867 - protein, 263 aa, Nocardia farcinica IFM 10152
MNRMQDKVAVVTGAAGGMGRAHCRRLAEEGADIIALDVAGADLDGTAAAVTELGRRCVTAVADVRDQTALDTAIAAGVRALGTLDVVVANAGVYTDLGPSWELTDAAWQRTLDVNLTGVWHTVRAAAAHLAESAAIVIVGSTNGVRGGANAAHYAASKHAVVGLARTLANELGPRGIRVNLVHPGSVATPMILNETVYAKLRPDLAQPTIDDAAAVLAQRTLLPVPWVDPVDVANAVLFLASDEARTVTGTELVVDAGLTQKV

SEQ ID NO: 13868 - protein, 165 aa, Bdellovibrio bacteriovorus HD100
MDLKSLIRDVPDFPKPGIIFRDMSPLLQNAEALSFVSHNLLKHVDLTHVDYFAGIESRGFILAAHMAATHKKGFLPIRKAGKLPPPTRKVSYALEYGTAEIELPPGRGNVVIVDDVLATGGTLQAAIDLCLLAGYSVESVAVLVNLTFLNKMTYNDQKVASLVQY

SEQ ID NO: 13869 - protein, 598 aa, Brachypodium sylvaticum
MAAAAADDDAAAAADPMALVRGLYDADELAIAGEFLTTWLPFLSAGLCPSCVASLRGRVASLLPREDEPPGPPPPPPRVDRVEPSGWDSDPPPPQHLPFEATGWDSDPAPPPQQQQQRPAPAEKPRMSWADMAQEDELAAAAEEDAAAMAADDREEEAGRPRAHLTREQREQRRFRNVVPRKDFMCYERVKGRLVNILAGLELHAGVFSAAEQRRIVDCVYGLQEQGKRGELGDRTYTEPEKWMRGKGRVTIQFGCCYNYATDKNGNPPGIIRTFASDPIPDLFKVMIKRLVRWCILPPDCVPDSCIVNIYDPGDCIPPHIDSHDFVRPFCTVSFLSECNILFGSTLKIAGPGEFTGSFAIPLPVGSVLVINGNGADVAKHCVPAVPAKRISITFRKMDPAKRPFGFKDDPELLDITPMEAASEETSRSSDEGKGKQLDVQNKNLGSKTSRSKRSKARASAGKAGYGGILGDQPSQHPQAPISSPNSERERESVGRSREPRYPRGEPGVLPHMGDARERLNMLPQERKPGSGVYFVNNGAQSHERTQRMEHRQLLMINRTINDDMDSLSVGSYESSDQPRVSVRTVSNKPRTRVYLDG

SEQ ID NO: 13870 - protein, 354 aa, Bacillus pumilus SAFR-032
MCGTMKAIVKKESAYGAVLMEMPIPEINDHEVLIQVKATSICGTDVHIYNWDDWAKGRVKAPYIFGHEFTGEVVKTGKQVSRAKVGDFVSAETHVVCNQCSMCLTGQQHLCNETKILGVDIDGCFAEYVKVPEQNVWHNPAQMPVELASIQEPLGNAVHTVLHTPVSGKSVAIFGCGPIGLMAIAVAKASGAVQVFAVDQNQYRLDLARKMGADHIVDIGKGDPVEVIKQFTRMEGADVICEMSGHPVAINQALESCANGGKVNILSLPERPVTIDITNQIVFRGLTVQGITGRKMFETWRQVSELLRTNTIDVQPVVTHTLPFEQFEKGFELMRNGTCGKVVLMMPSNQRGKK

SEQ ID NO: 13871 - protein, 895 aa, Brachypodium sylvaticum
MLSAAHARRRAASAAARLLLPIPPPPAPYTTSASNASSSSSTPEDPDAVAAEVATLLSRCAGDWKLAIAASDIPSRLSPDAVSSLIFGGRSHSLHPKLLLDFFYWSRPRIAPPSADAFARLAASLCAASLFPQANGLLHQMILAHPHPPLVLASIQRAIQDTDHRSRSPSPSTAVLDVLVDTYKKTGSVRNAAQVVLMMADLGLAPTRRCCNGLLKDLLRADAMELLWKLKGFMEGAGILPDVYTYSTFIEAHCKARDFDAAKKVFEEMRRRDCAMNEVTYNVMISGLCRSGAVEEAFGFKEEMVDYGLSPDAFTYGALMNGLCKGSRLKEAKALLDEMSCSGLKPNIVVYGTLVDGFMKEGKTAEAFDILKEMISAGVQPNKIMYDNLIRGLCKIGQLGRASKLLKEMIKVGLRPDTFTYNPLMQGHFQQHDKDGAFELLNEMRNSGILPNVYSYGIMINGLCQNGESKEAGNLLEEMISEGLKPNAFMYAPLIIGHSKEGNISLACEALEKMTKANVHPDLFCYNSLIKGLSTVGRMEEAEEYYAQVQKRGLVPDEFTYSGLIHGYCKTGNLEKADQLLRQMLNSGLKPNADTYTDLLEGYFKSNDYEKVSSILQSMLGSGDKPDNHIYGIVIRNLSRSENMEVAFMVLTEVEKNGLVPDLHIYSSLISGLCKIADMEKAVGLLDEMAKEGLEPGIVCYNALIDGFCRSGDISRARNVFDSILAKGLVPNCVTYTALIDGNCKNGDITDAFDLYKEMLDRGIAPDAFVYNVLATGCSDAADLEQALFLTEEMFNRGYANVSLFNTLVHGFCKRGKLQETEKLLHVMMDREIVPNAQTVEKVVSEFGKAGKLGEAHRVFAELQQKKASQSATDRFSLLFTDMINKGLIPPKCDA

SEQ ID NO: 13872 - protein, 478 aa, Mesoplasma florum L1
MNKKELQARVKRTKIITTTGPSTNEPEQIRELFENGMTTIRLNFSHGDYEEQGYRIAGAKKVREELGKPVSILLDTKGPEIRVGKFVDGKQEVTANQSITIYTDAESFKNKECLSGEMTVAYDMSVDLKIGDTILIDDGKLEMTVEEVKPGVVKAIAFNNHLVKTNKRVNLPGVDFSMPFLAQKDINDIKYGVEQGVDYIAASFVNSAENVKEIRDILAEANGSDIQIISKIESQVGIDNIDAIIEASDGIMIARGDLGLEIPYYDVPYWEKIMIRKCREAGKVVIVATQMLETMTENPAPTRAEVTDVYFATELGADATMLSGESAAGDYPFITVNTMATINKRAEIEFYKKAYYQTQLENAKNSTSGPRADIAMDLAERTRDGQYEFAVVLSRTGALLKTISKFRPNVTILGVSESERLWTAFGVWHSIFMNKTANLLELEENVAQISEIAKLWGAKSGSKILVVRNKDIREITVA

SEQ ID NO: 13873 - protein, 415 aa, Oryza sativa Japonica Group
ARGSGTDSLSDDGARQVAAALPSARLARLKLRGLRQLSDDGLASLAGATPVIRKLSVASCSFGPKAFVAVLRSCPLLEDLSVKRLRGLPDTAGATTAITEEILFPPASSLRSVCLKDLYSALCFVPLVASSPNLRSLKILRCSGSWDLPLEVIAARVPGLVELHLEKLQVGDRGLSAVSACANLEVLFLVKTPECTDAGIISVAEKCHKLRKLHIDGWRTNRIGDHGLMAVARGCPDLQELVLIGVNPTVQSLRMLGEHCRSLERLALCGCETVGDPEIICLAERCAALKKLCIKGCPVSDRGMWALNGGCPSLVKVKLKRCRGVSYECIENLKVVRGGSFSISLDIVLERDAGGAIENGGQEAGQVQITELTDQMAAMDLPTNASNAQSSAQASSRMRSVMSALRRRFGNPPAL

SEQ ID NO: 13874 - protein, 418 aa, Brachypodium sylvaticum
MGSVSLKLPASRRRQGPRVLSCLCSPAPLNLLMLLSLVSTNLLALLAFFSTPGVPPATQTPSSYNLSAHVAAIAREIGTGASPSPNLPADPPELFLFLTPHALPLGRDARSGLTHMPASVGSVCLRSPSALSLLSQFMSYAPHAACPLNATASTLPRRLVSKGCEPLPRRRCLTRRPPLRPSSITALDPRRWVTPARSSNNRHEFLIDDVIRLAQIRIGLDVSGGGGDFAARMKERNGATVVTTVLEPTTSELVAARGLFPLQLSPAHRLPFYDGVFDLVHAAGTAALDGAGAPAMGLAGTPEALEFFLFDVDRVLRVGGLLWIDSYPCPERRQKAGTCEAHREVRVQEAQVGRRREARRKGVGLPLRRVAEAGEELMTGSLELYGRIGLLLAPLIIKGTNVCTCQLFVVQRILMRGM

SEQ ID NO: 13875 - protein, 464 aa, Pyrococcus horikoshii OT3
MKALILAGGKGTRLWPLSREAMPKQFIKVFSDRSLFQKTVERALIFSKPKEIFVVTNKEYRFRVLDDLNELGLKVPEENILLEPVGKNTLPAIYWGLKVINDNYGDSVVAVLPSDHAIEVNESYMEAFKKAEKLAEKYLVTFGIKPTKPHTGYGYIKPGEKIEVEGKVLGYLVDEFKEKPDLETARKYVENGYYWNSGMFMFKVSVFMEEARKHSPDVVKAFEEGKSIEEIYELAPEISVDYGIMEKTNKAAVVPLNTYWNDLGSFDAVYEALEKDENGNAVHVTGFKAKYINVDSRNNLVLTERLTATVGVEDLVIIDTGDALLVAKRGETQKVKEVYKKLKEENDERAIVHRTAYRPWGSYTVLEEGERYKIKRLTVLPGKRLSLQIHYHRSEHWVVVRGTAKVKVGDKEFILRPGESTFIPAGVPHRLENPGKVILEVIETQIGEYLGEDDIVRLQDDYGR

SEQ ID NO: 13876 - protein, 588 aa, Ralstonia eutropha JMP134
MEDSSSPDTQRGAAAAGSWQTWFPPAQWLLHYRSEWLRHDAVAGVTLAAYGIPVSLAYASLAGVPPQYGIYCYLAGGLAYALFGSSRQLAIGPTSAISMLVGVTIAGMAQGDPSRWASIAALTALLVAAMCILAWLFRLSSLVNFISETILLGFKAGAALTIALTQLPKLFGVKGGGEFFFERIAILAQQLPLTNLAVFGFGAVAIAVLLLGEKFLPGRPVALLVVVASIMLLSLTPLGALGFKVVGALPQGLPELHWPGLRPSDVDGVISLAFACLLLSYVESVSAARALAQAHGAEIDARQELLGLGAANLATGLFQGYPVAGGLSQSSVNDKAGARTPLALVFASATIALCLMFLTGLLANLPNVVLAAIVLVAVKGLVDIRELRHLWRVSRFEFIVSMVAFGAVLLLGILKGVIVAVLVSMLMIIRRAAHPHVAFLGRIPGTRSFSDMDRNPDNEAVPQILIFRAESSLLYFNVEHVRSVVWRAIRSSALPLRLVVCDLSVCPVVDLAGARMLATLHKELQAAGIELRLVAAHAVVRDMLRAEGLEERVGYFGRRISVADVIEEFRTSTAQETPIASITALAAT

SEQ ID NO: 13877 - protein, 103 aa, Glycine max
  misc_feature (63)..(63): Xaa can be any naturally occurring amino acid
EQPSHDEARPLLHQSQPIFERPTPPDTPEFLLGWTADGLPLDHGNAMGHTMGRAQGNSSICAXLGRTDHFCSSDLEVCLLGNEAPCVLHGNNVERLESAPGTF

SEQ ID NO: 13878 - protein, 328 aa, Bacillus thuringiensis serovar konkukian str. 97-27
MKAIILTSFGGPEVMKYTDVDIPAISEDQVLIRVVATSVNFADIKSRYGKKGNKALPFIPGIDAAGIVERVGSHVKNIYPGQRVIAFPQNGSYAEYVVANENLTFVLPDEVDFQTAAACPIVSFTSYNLLANVARIQQGESVLIHAAAGGIGTTAIQLAKLLGAGTVIGTVGSETKKEIALDAGADYVIGHQDEDFVEKVNELTNGEGVDVILDSISGTVSERSLKCLAYYGRLIHFGNASGEIGNFQTKDLHASCRSILGFSFGTTRKKRPELLQETANEVFRYLRDGRLQIKATKSFPLQDAGKAHEWVESRKSTGKVILTVQSSS

SEQ ID NO: 13879 - protein, 520 aa, Isatis tinctoria
MESSISQTLSQVLDPTTAILTVVSLFIFIGLIVRRRRPPYPPGQRGWPIIGNMLMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNIGKPINVGEQIFALTRNITYRAAFGSACEKGQDEFIRILQEFSKLFGAFNVADFIPYFGWIDPQGINKRLVKARNDLDGFIDDIIDEHMKKKESQNTVDDGDVVDTDMVDDLLAFYSEEAKLVSDATDLQSSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKKSRVMVNAFAIGRDPDSWVDPETFRPSRFLEPGVPDFKGSNFEFIPFGSGRRSCPGMQLGLYALELAVAHILHCFTWKLPDGMKPSELDMSDVFGLTAPKATRLFAVPSTRLICAV

SEQ ID NO: 13880 - protein, 397 aa, Xanthomonas campestris pv. vesicatoria str. 85-10
MGPGPVNAHPRVLRAMAADLLGQFDPEMTAYMNEVMALYRPLFGTENRWTFLVDGTARAGIEAALVSLVSPGERVLVLNFGRFGLLLTEILGRLGAEVHTVDASWGQVLPLSAIAEAIERVAPKLVATVHGDTSTTMAQPLDGLGALCRAAGALSYVDATATIGGMPVASDRWEVDVVTGGLQKCLGGPSGSAPITVSERAAEAIFARRHVERGIVRADIANGSGPRIASNYFDLAMIMDYWSDKRLNHHTEATTMLYGARECARVALQEGLDARFARHAAAGRAVSAGIRALGLEVFGDDAHRMRNVTGVVIPPGIDGEAVRRRMRENFEIEIGTAFGPLQGKIWRIGAMGYNAMKHKVLITLAALEAVLRAEGDACTHGLAVEAALAAWHAEAQA

SEQ ID NO: 13881 - protein, 176 aa, Triticum aestivum
MVFLSNAISNARIEESHSKGELHHDAVETTIYGTRWASEDIPRFDLPEDEMPSNVAYRLIKDDLALDGNPALNLATFVTTYMEEEAEKLMAENLSKNFIDYEEYPQSVELCNRCVNMIARLYHAPMHSADEEALGCSTVGSSEAIILATLAMKRRWQNARKEKGLPTDKPNLIFGA

SEQ ID NO: 13882 - protein, 452 aa, Neptuniibacter caesariensis
MAEYDFDLFVIGAGSGGVRAARMAAGMGVKVAIAEDRHLGGTCVNVGCVPKKLFVYASHYAESFEEAAGFGLTHNGVNFDWPTLRDNKTKEIERLNGIYQNLLVNSGCELINGRAVLVDPHTVAVGDKQYTAERILVAVGGWPNIPDIPGKEHIISSNEVFYLEEFPKRALVVGGGYIAVEFAGIFAGLGAETKLAYRGDLFLRGFDREIREFTAQEVAKKGVDLLFNNNIESIEKQSDGSYLAKMTDGSTIETDLIMYATGRNPKVEGLGLEAVGIEQGKNGAIVVNDDFQTNVPSVYAVGDVIDRVQLTPVALAEGMALVRNLYAGMNQKVDYDLIPTAVFCQPNIGTVGLSEEQAREQYENIEVYKSEFRAMKHTISGSEERTFMKMLVDADSRKVLGVHMVGPDAGEIIQGIGIALKAGATKEVFDSTIGIHPTAAEEFVTMREPSSN

SEQ ID NO: 13883 - protein, 506 aa, Teesdalia nudicaulis
MTSVNVKFIYHYVITNFFNLCFFPLSAILAGKASRFTTNDLHIFYYSYLLQNIITLTILFSLTAFGLVLYIVTKPKPVYLVDYSCYLPPPHHRVSVSKVLDIFYQVKKADPLRNGSSDDSSWLDFLRKIQERSGLGDETHAPEGFLQVPPRTSFGAAREETEHVIIGAVKTLFENTKVNPKDIGILVVNSSLFNPTPSLSAMVVNTFKLRSNIRSFSLGGMGCSAGVIAIDLAKDLLHVHKNTYALVVSTENITRSIYAGDNKSMMVSNCLFRVGGAAVLLSNKPGDQSRSKYKLAHTVRTHTGADDKCFQCVQQEDDESGKTGVSLSKDITTVAGRTVQKNITTLSPLILPFSEKFLFFVTFIGKKLFKDKIKSYYVPDFKLAIDHFCIHAGGRAVIDVLEKNLGLSPVDVEASRSTLHRFGNTSSSSIWYELAYIEAKGRMKKGNKAWQIALGSGFKCNSAVWVALRNVKASKSSPWEHCIDKYPVNIDSDSVKSETRVQNGRS

SEQ ID NO: 13884 - protein, 504 aa, Novosphingobium aromaticivorans DSM 12444
MNDMTTISRTQREYSEAAKAFLARKPQLFINNEWVDSSHDAVIEVEDPSNGRIVGHVVDASDKDVDRAVAAARAAFDDGRWSNLPPMVRDRTMNRLADLLEANADLFAELEAIDNGKPKGMAGAVDIPGAISQLRFMAGWASKVAGETTQPYTMPNGTVFSYTVKEPVGVCAQIVPWNFPLLMASLKIAPALAAGCTLVLKPAEQTSLTALKLADLVVEAGFPAGVINIITGNGHTAGDRMVKHPDVDKVAFTGSTEIGKLINRNATTTLKRVTLELGGKSPVVVMPDVDVAQTAPGVAGAIFFNAGQVCVAGSRLYAHRSVFDSVLEGMTQTAPFWAPRPSLDPEAHMGPLVSKEQHDRVMGYIEAGKRDGASVVMGGDCPSADGGYYVNPTILADVNPQMSVVREEIFGPVVVAQRFDDLDEVAKMANDTCFGLGAGVWTRDVAVMHKLASKIKSGTVWGNCHALIDTALPFGGYKESGLGREQGRAGIDAYLETKTVIIQM

SEQ ID NO: 13885 - protein, 247 aa, Triticum aestivum
MAPRKFFVGGNWKCNGTGDDVKKIVTVLNEAEVPSEDAVEVVVSPPFVFLQQATGLLRPDFAVAAQNCWVRKGGAFTGEISAEMLVNLQVPWVILGHSERRALLNESSDFVADKVAYALAQGLKVIACIGETLEQREAGTTMEVVAAQTKAIAEKISDWTNVVLTYEPVWAIGTGKVHDGLRKWLQANVGPAVAESTRIIYGGSVNGANCKELAAQPDLDGFLVGGASLKPEFVDIIKSATVKSASA

SEQ ID NO: 13886 - protein, 116 aa, Brassica napus
MAGEGEEDVPRDAKIVKSLLKSMGVEDYEPRVVHQFLELWYRYVVEVLTDAQVYSEHASKSTIDCDDVKLAIQSKVSFSFSQPPPREVLLELAASRNKIPLPKSIAGPQGISRSPP

SEQ ID NO: 13887 - protein, 109 aa, Arabidopsis thaliana
  misc_feature (99)..(99): Xaa can be any naturally occurring amino acid
MKIIVSILVLASLLLISSSLASATISDAFGSGAVAPAPQSKDGPALEKWCGQKCEGRCKEAGMKDRCLKYCGICCKDCQCVPSGTYGNKHECACYRDKXLSSKGTPKCP

SEQ ID NO: 13888 - protein, 300 aa, Bdellovibrio bacteriovorus HD100
MSSRKNFSILDLRSLEKTKIDFLFSIADSVAASKSAPIQGFGKTGALLFFEASTRTRMSFETACARLGIHPLRLDGSAGSSLEKGETLEDTVLNVEAMKPAFLVIRCGDDLDLKDLSEKISTPILNAGWGKKGHPTQALLDAYTLRKHLGTCSGQKLLIVGDVRHSRVAASHFELAEKLGYEVALCGPKEFLPAQPPCRVFATLKEGLQWSTATMALRVQLERHENKYSLADYRDQYGFTAKNLQSLSDQALIMHPGPINQGIELDSDVLKDPRCKVLDQVSNGVLIRQSLIQMTLKEGE

SEQ ID NO: 13889 - protein, 301 aa, Chlamydomonas reinhardtii
MKSKRDREEPCFICNHYHDVENGEPCTVCGHVMSQAERKQLEPSVLPTAVIPGSLYLGSYDTASRSELLRAMGITHILNTWPSNAELFKNSFKYHTVTSTPVDFQECHDFLDMVLNKEQKVLVYCMTGVSRSPSVVIAYLMKKRGWRLAESYKWVKDKRQTINIKEEDVKRLQEYEVQLHGSCSAPMGLAILNNGPAFGQQPQAGPSGQQQEQSQEASAPSTSGPVFGSAGAAPAWSLSNVTAPQGFRFGTAAMPGPAGQSTQQERQQASAQGQQFGSAGPNPFAPRPAAAGDGGGNDMEM

SEQ ID NO: 13890 - protein, 155 aa, Cytophaga hutchinsonii ATCC 33406
MKLQLWTIGKTNDAYLKEGCAQYTKRLPHYLPFEYLEIPEPKNTKLSSDVLKKEEEKLIFDRLQDSDQLILLDEKGNEFTSTEFGQYIQKKMNSVAGNLIFLIGGPYGFSDAVYKRANGKIALSKMTFSHQMVRLFALEQLYRACTIIKGEKYHH

SEQ ID NO: 13891 - protein, 354 aa, Bdellovibrio bacteriovorus HD100
MRGYLVLEGGEVYTGQWQGGEDRAGEVVFNTSHSGYEEIATDPSYFSQIVVMTAPMQGNYGVEDAVWESRKLWIEGFICLEVQDSERDHAWKKRLTDNKIPMLTELDTRALALRLRQGGTPWGALVQAGSEAEALKKADSLIAAKKTVDKDWVYIVSRKEAETRRGENMVGPKVAVLDFGSKENILRELQNRCSEIKIFNSRSSVQEILAYNPDGIMLTNGPGDPADVKVAIGTVRELLGVKPIFGICMGHQILGLALGAKTYKLKFGHRGSNHPIRDTLLNQIYMTSQNHGYAVEEASLPSDVKVTHVNLNDGTVAGFYSEKRKCLGIQYHPESCPGPHEASGLFSYFVERMI

SEQ ID NO: 13892 - protein, 122 aa, Clostridium thermocellum ATCC 27405
MDKIVLRDMKFYGYHGVFPEEREKGQNFYIDVEAYLDLRRAGETDELEDTVDYSKIYDIIKYINENNKFRLIETFAHIISREILSTFRQIDRIVVRVRKPEAPIEGEFKWVGVEVERFSNEL

SEQ ID NO: 13893 - protein, 390 aa, Pyrococcus horikoshii OT3
MSYIFDLSILLVVAKSLEWLLKKKGIHPIIAHILTGIILGPFGLSIVLPTSELKVLGEFGLIMMMLYMGLTSNFSAISRNKVKASVVAMFGVAFSFILGFLTVYFLEKSLIAALFVGITLGNTAIEVTSGVLVRERVKKDISSVLMGAAFADDIIAVYLIGILTGITQGGISGLSLVFLTIKIVIFILGVLMLSEFVFKRSTRFYNIIRDLHIFFTFTIVLTFTLAFIAQDIGLNQIIGAYLAGLTISRLRERKDPMVITRIKLNELIEELEIVLVEFFIPLFFVYVGLMFNPNVRDISILLILLLYASAVLGKLIGCGLGMKIFGSSIRDAIIVGIGMGGRGSLELAILKLGLEKGLIDEGIFATVVIVSMLTALSTPVLFRYTVRKLS

SEQ ID NO: 13894 - protein, 321 aa, Brassica napus
VRLHALRQRQPGKHFSEYAARFYAAEVLLALEYLHMLGVVYRDLKPENVLVRDDGHIMLSDFDLSLRCTVSPTLIKTFDSDPSKRGAFCVQPSCMMEPTTSCFSPRSIFSNKSKKNNKTRSKTQTDVSRSHSGSLPELVAEPNTRSMSFVGTHEYLAPEIIKGEGHGSAVDWWTFGIFVHELLYGKTPFKGSGNRATLFNVVGEQLKFPESPATSYAGRDLVQALLVKDPKNRLGTKRGATEIKQHPFFEGVNWALIRCGTPPEVPRQMEVEPPPKYGPIDPVGFGSNSKRMMGPPPVSAASVGAGGDTKAGGKFLDFEFF

SEQ ID NO: 13895 - protein, 383 aa, Pyrococcus horikoshii OT3
MKFPRIGLPKEKVIELINEKTKKDLTFSSGKILGSMCTMPHDLAIEVYTKYIDRNLGDPGLHPGTRKIEEEVIEMISDLLHLEKGHGHIVSGGTEANILAVRAFRNLSDVEKPELILPKSAHFSFIKAGEMLGVKLVWAELNPDYTVDVRDVEAKISDNTIGIVGIAGTTGLGVVDDIPALSDLARDYGIPLHVDAAFGGFVIPFAKELGYELPDFDFKLKGVQSITIDPHKMGMAPIPAGGIVFRRKKYLKAISVLAPYLAGGKVWQATITGTRPGASVIAVWALIKHLGFEGYMRIVERAMKLSRWFAEEIKKINNAWLVREPMLNIVSFQTKNLKKVERELKSRGWGISAHRGYIRIVFMPHVTREMIEEFLKDLKEVLS

SEQ ID NO: 13896 - protein, 911 aa, Brachypodium sylvaticum
MPLRLEIKRKFAQRSERVKSVDLHPTEPWILSSLYSGSVCIWDYQSQTMVKSFEVSELPVRSAKFVSRKQWVVAGADDMYIRVYNYNTMDKVKVFEAHTDYIRCVAVHPTLPYVLSSSDDMLIKLWDWDKGWMCTQIFEGHSHYVMQVTFNPKDTNTFASASLDRTTKIWSLGSPDPNFTLDGHQKGVNCVDYFTGGDRPYLITGSDDSTAKVWDYQTKSCVQTLEGHTHNISAVCFHPELPIIITGSEDGTVRIWHSTTYRLENTLNYGLERVWAVGYMKGSRRMVIGYDEGTIMIKMGREVPVASMDASGKIIWAKHNEIQTVNIKTVGAGFEATDGERLPLAVKELGSCDLYPQNLKHNPNGRFVVVCGDGEYIIYTALAWRNRSFGSALEFVWSSEGEYAIRESTSRIKIFNKSFQEKKTIRPTFSAERIFGGVLLAMCSSDFICFYDWADCRLIRRIDVTVKNVYWADGGDLVAIASDASFYILKYNVYVVAAYLEGGKPVDEEGVEDAFELLHEVNERVRTGIWVGDCFIYNNSSWRLNYCVGGEVTTMYHLDRPMYLMGYLANQSRVYLIDKEFNVIGYTLLLSLIEYKTLVMRGDLERANEILPSIPKTQYNSVAHFLESRGMLEEALEIATDADYKFDLAVQLGRLEVAKDIAVEAQSESKWKQLGELAMSTGKLEAAEECLLQAKDLSGLLLLYSSLGDAIGIEKLASLAKEHGKNNVAFLCLFMLGKLEDCIQLLVDSNRIPEAALMARSYLPSKVSEIVATWRNDLSKVNPKAADSLADPSEYPNLFEDWQVALTVEKNIAPQRGHYPSADEYLNYADKSDSTLVEAFKRMQVIEDEEPVDELDENGEPDEEVFEENKMVENTDEAVQVDGDEPEETVLVNGNEGEEQWGTNNEGTSPA

SEQ ID NO: 13897 - protein, 513 aa, Saccharomyces cerevisiae
MSLSTKREHSGDVTDSSFKRQQRSNKPSSEYTCLGHLVNLIPGKEQKVEITNRNVTTIGRSRSCDVILSEPDISTFHAEFHLLQMDVDNFQRNLINVIDKSRNGTFINGNRLVKKDYILKNGDRIVFGKSCSFLFKYASSSSTDIENDDEKVSSESRSYKNDDEVFKKPQISATSSQNATTSAAIRKLNKTRPVSFFDKYLLGKELGAGHYALVKEAKNKKTGQQVAVKIFHAQQNDDQKKNKQFREETNILMRVQHPNIVNLLDSFVEPISKSQIQKYLVLEKIDDGELFERIVRKTCLRQDESKALFKQLLTGLKYLHEQNIIHRDIKPENILLNITRRENPSQVQLGPWDEDEIDIQVKIADFGLAKFTGEMQFTNTLCGTPSYVAPEVLTKKGYTSKVDLWSAGVILYVCLCGFPPFSDQLGPPSLKEQILQAKYAFYSPYWDKIDDSVLHLISNLLVLNPDERYNIDEALNHPWFNDIQQQSSVSLELQRLQITDNKIPKTYSELSCL

SEQ ID NO: 13898 - protein, 526 aa, Xanthomonas campestris pv. vesicatoria str. 85-10
MVHTLRARRGMVVAPHHLAAQAGRDVLRDGGNAVEAVVATAACLAVVYPHMTGIGGDGFWLIHEPDGRVHAIDACGRAAQAATLDFYRGHAHVPWRGPGAANTVAGTVSGWALALQQANGSVSLQRLLSDAIHHASAGVPVTLGGAQIAASKGAELRLQPGAYAEIFEPHGVPLGEGALLHQAQLARTLQRLADEGLESFYRGAIAHDIAADLQALDSPLSAHDLAIHRADVSVPLSVVIQGARLYNHAPPTQGLASLLILALFDRLKVEDADSYAHLHGLIEASKQAFLIRDAHLGDPAWMTLDAQALLDDSTALDALAARIDMSAALPWPQPSQAGDTVWFGAIDAHGRAVSCIQSTYFEFGSGLVLPRTGITWQNRGCSFRLAPDGWNALAPGRKPFHTLNPALATFDDGRVMAYGTMGGEGQPQTQAAVFSRYARFGMPLQQAVSAPRWLLGRTWGEDSTALKLEDRFDPAVVQALRNAGHAVELLPAYSAVMGHAGALVREVDGVISGASDPRSDGVVAGW

SEQ ID NO: 13899 - protein, 652 aa, Brachypodium sylvaticum
MVVNNTKANTPPPPAAAMGTEHHRAINMPAMGVERHKVSAPERRTTCQALRQRLAEVFFPDDPLHRFKNQPPAKKLVLALQYFFPIFDWGSQYSLRLLRSDAVAGLTIASLAIPQGISYAKLANLPPIIGLYSSFVPPLIYALLGSSRDLAVGPVSIASLVMGSMLREAVAPEQQPIVYLQLAFTATFFAGLFQASLGFLRLGFMVDFLSKATLTGFMGGAAVIVSLQQLKGLLGIVHFTTHMGFVDVMASVVKRHAEWEWQTIVMGVAFLAVLLGTRQISARNPRLFWVSAAAPLSSVIISTVISYLCRGHAISIIGDLPRGVNPPSMNMLAFSGPFVALSIKTGIMTGILSLTEGIAVGRTFASINNYAVDGNKEMMAIGVMNMAGSCASCYVTTGSFSRSAVNYSAGCKTAVSNIVMAAAVLVTLLFLMPLFHYTPNVILSAIIITAVVGLIDVRGAARLWKVDKLDFLACLAAFLGVLLVSVQVGLALAVGISLFKVLLQVTRPNTVVMGRIPGTQSFRNMAQYKDAVKVPSFLVVGVESAIYFANSTYLVERIMRYLREEEEGGQGVKCVVLDMGAVAAIDTSGLDALAELKRVLDKRGVELVLANPVASVTERMYSSVVGDAFGSDRIFFSVAEAVAAAPHKTTMP

SEQ ID NO: 13900 - protein, 250 aa, Archaeoglobus fulgidus DSM 4304
MGLSRLGIETAYIGKVGSDEEGRILLADFEREGVSTDFVIRAEGRSGTAMIFVDEKGNRAILVDPGVNDTIAYDEIDVDSARKYDLIHLTSFICKNGLDSLNSQKRIVEEFDSVSFDPGMPYAERGLGDMEKILKNTTIFLPNRQEIEMLFSEDYRTAAERCIEMGIEIVAVKLGSEGCWIKKGDREVTVKPVSTKVVDTTGAGDAFNAGFLYGYLKGKDIEECGRLGNFVAAKCIEKYGAREGLPRSVD

SEQ ID NO: 13901 - protein, 391 aa, Oryza sativa
MGLCSSSSARRDAGTPGGGNGAGNKDNAGRKGIVACGKRTDFGYDKDFEARYALGKLLGHGQFGYTFAAVDRRSSERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSTKEDSSLKATDFGLSDFIRPGKHFRDIVGSAYYVAPEVLKRKSGPESDVWSIGVITYILLCGRRPFWDKTEDGIFKEVLKNKPDFRRKPWPNITPCAKDFVQKLLVKDPRARLTAAQALSHEWVREGGQASDIPLDISVLHNMRQFVKYSRFKQFALRALASTLNAEELSDLRDQFNAIDVDKNGTISLEELKQDFGDGGTNL

SEQ ID NO: 13902 - protein, 389 aa, Xanthomonas campestris pv. vesicatoria str. 85-10
MPLSIAVATPSTFHDKNAMNDPHRPSSRRRVILEDDIDGFTPAQLLLLQSPDVQVLGISAVSGNIWRDEALAHTCRLLELAGHPQIPVLPGPVHPLLNSESATERWEALYGKLVWKGAWTRHWVDGDTVQSAPRYHAHDVVPELALGNPSVVRPADEPAALFMLRMVRQYPGEVSIIATGPLTNLALAQSLDPSFATLARELVYMGGSLNPRQQRNSVSAQQFAREFVNSPRREFNIRWDPEAASIVMRAPWRQITMVPVDPSTATELTTELLARMSAADTTIGHALRRREPGFPMWDELATAVWLRPDLATRTETLYVDTNTAFDAGYGDILSWAPGYQPGLGEQAQTVVHAVDVPAFEQLLVDRLTAPQPPAVGLPLPLFPIGPRSP

SEQ ID NO: 13903 - protein, 649 aa, Salmonella enterica subsp. arizonae serovar 62:z4,z23:--
MMSYVDWPPLILRHTYYMAEFETTFADLGLKAPILEALNDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIKPSAEGEELDLETLAAALLKMAQGERPLILPPDAPMRPKREFRDRDDRGPRDRGPRGDREDRPRRERRDVGDMQLYRIEVGRDDGVEVRHIVGAIANEGDISSRYIGNIKLFASHSTIELPKGMPGEVLQHFTRTRILNKPMNMQLLGDAQPHTGGERRGGGRSFGGERREGGRNFSGERREGGRGDGRRFSGERRFSGERRESRGPRRDDSTGRRRFGGDA

SEQ ID NO: 13904 - protein, 332 aa, Dimocarpus longan
MAQFVSFLLFVVSLIAFAPLCFSAKHNNGYLFPEFYDHSCPKAQQIVKSVVAKAVAKEARMAASLLRLHFHDCFVKGCDASLLLDSSGSIISEKRSNPNRNSARGFEVLDDIKSALEKECPHTVSCADILALAARDSTVLTGGPSWEVPLGRRDSRGASLSGSNNNIPAPNNTFQTILTKFKLQGLDIVDLVALSGSHTIGNSRCTSFRQRLYNQSGNGQPDLTLDQSYAAQLRTRCPRSGGDQTLFFLDFVSTTKFDNSYFKLLLASKGLLNSDQVLVTKSKESLDLVKKYAAHNELFLPQFAKSMVKMGNISPLTGSRGEIRKNCRKINS

SEQ ID NO: 13905 - protein, 350 aa, Citrus maxima
MSPLRYLLAAAVLFAFVLDESSSQAQLTPDFYNTTCPNASNIILGVLQNAFNSDIRITASLIRLHFHDCFVNGCDGSILLDNVANDTSIDSEKFSMANNNSARGFEVVDAMKTALESACPGIVSCADILAIASEQSVNLSGGPSWTVPLGRRDGRTANRSLADQNLPTPFQTLDLLKGRFRNVGLNDNTDLVALSGAHTFGRAQCQFFSQRLFNFNGTGNPDPTLNATLLAQLQQLCPQGGNGSVLTNLDLSTPDGFDNDYFSNLQANNGLLQSDQELFSTSGADTIPIVNNFSSNETAFFESFAVSMIRMGNLSLLTGTQGEIRSNCRRVNANNLSTISSSDGGLVSSI

SEQ ID NO: 13906 - protein, 431 aa, Kineococcus radiotolerans SRS30216
MSLDAVPAPAPPDAPPRAADVEAAAERLSRVVTRTPLATSARWSAALGAHVRVKREDLQVVRSYKLRGAYNLVSQLTDEQRGRGVVTASAGNHAQGLAYACAALRVRGRIYVPRTTPRQKRDRIAALGQEFVETIVLGDTYDDSAAAALEDAERTGATMVPAFDDARTVAGQGTVAVEVFEQLEQLGEGPPDVVVVPVGGGGLLAGVLAWVRERHPQVRVVGVEPAGAPSMAAALAAGRPVRLEHLDTFVDGASVRRVGDVPHAVVAGHEVELVAVPEGAICVEMLAMYQTDGIIAEPAGALATAALAEAVRVEPGQSVVCVVSGGNNDISRYAEIIERALVHEGRKHYFLVEFPQEPGALRRFLDEVLGPDDDVTLFEYVKRNNREFGPALVGIEIPGKDDLPGLLARMEAAPPSFERISATDPLYRYLL

SEQ ID NO: 13907 - protein, 293 aa, Neptuniibacter caesariensis
MGSEVITQVVLPLALFFIMLGVGLSLHVSQFTSLWQQPRSVFAGVMLQMLLLPVLGVAVVTLFQLPAPLAVGIMILTFAPGGATSNMITYLSRGDTALSVSLTALSGLLTPFTMPLFTVFALNYWLGESAAINFPVIEATIKLFVIAVLPAVLGIAVNHHWPAFCRKIEKSVKFLACLFLILIVFGIVKSNWHSLPGLLVQLGPAVLCLVALAMLAGFAVARAIKLNESQQVSLAVEVGIQNAATALLITGGILQNAEMSASALIYGVLMNLPVFALIVYRNLPLRERLGRSA

SEQ ID NO: 13908 - protein, 363 aa, Zea mays
MAAVDLTPRTPKKAYGGDGGAYYEWSPADLPMLAVASIGAAKLSLAAGGLSLPSYSDSAKVAYVLQGVGTCGLVLPEATKEKVVAVKEGDALALPFGAVTWWHNGPAAQADLTVLFLGDTSKGHKRGQFTNFQLTGSAGIFTGLSTEFVSRAWDLPEPDAARLVSSQPASGIVKLPASAAALPAPSPQDRAGVALNCLEAPLDVDIPGGGRVVVLNTANLPLVREVGLGADLVRIDAHSMCSPGFSCDSAYQVTYIVRGSGRVQVVGPDGRRVLETRIEGGSLFIVPRFHVVSKIADASGMEWFSIITTPNPVFSHLAGKTSVWKAISPEVLQASFNTTPEMEKLFRSKRLDSEIFFAPPSSN

SEQ ID NO: 13909 - protein, 265 aa, Rhizobium leguminosarum bv. trifolii
MLRTFEKAALEAGRAIITVLREGFPVAMKADASPVTVADEEAERIILAHLARDYPEIPVVAEESVAAGKVPDIAGRGFFLVDPLDGTREFVDGRQEFTVNIAYIENGAPVAGIVYAPALGLAFSGERGHAESVVVADDFTVGARSTITVREQPDDRLALASLRHNSPETGSFLADHAIFKCTNIGSSLKFCLLAERKADVYPRFTRTMEWDTAAGDAVLRAVGGSTVTLDGTPLTYGKTGTAADFDFANPNFISWGGRKRVLEPA

SEQ ID NO: 13910 - protein, 261 aa, Legionella pneumophila str. Paris
MQNIEFYQIDAFTDKVFHGNPAAVCILDDWLNDELLKAIAAQNNLAETAFIIKDDQDFHIRWFTPNGEINLSGHATLAAGFALLESNKGPSDSIIFHHSSGQISVEKRKEKFVLNFPRIGYKKTLSPDPIVSLLDQPAIEVFETDLDYLVLLEHESQIRNLQIDLLALAKLPKRGIIVTSTTTEADFYSRCFYPKHSIAEDPVTGSAHCILAPFWAEKLNKNSLYAIQGLHRKGELYCELQRNRVLISGHCRWYLRGHLVI

SEQ ID NO: 13911 - protein, 765 aa, Nicotiana rustica
MGSALLPDLGAEIVIPVCAVIGIVFSLVQWYLVSTVKLTPESSSPSNNGKNGYGDYLIEEEEGINDQNVVVKCAEIQNAISEGATSFLFTEYQYVGIFMIAFAILIFLFLGSVEGFSTKSQPCTYNKEKLCKPALATAIFSTVSFLLGAVTSVVSGFLGMKIATYANARTTLEARKGVGKAFIVAFRSGAVMGFLLAANGLLVLYITINLFKLYYGDDWEGLFEAITGYGLGGSSMALFGRVGGGIYTKAADVGADLVGKVERNIPEDDPRNPAVIAGNVGDNVGDIAGMGSDLFGSYAEASCAALVVASISSFGINHEFTAMLYPLLISSMGILICLITTLFATDFFEIKAVKEIEPALKNQLIISTALMTVGIAIVTWTCLPSSFTIFNFGAQKVVKNWQLFLCVAVGLWAGLIIGFVTEYYTSNAYSPVQDVADSCRTGAATNVIFGLALGYKSVIIPIFAIAIAIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPQVFIGLIVGAMLPYWFSAMTMKSVGSAALKMVEEVRRQFNTIPGLMEGTAKPDHATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 13912 - protein, 257 aa, Nocardia farcinica IFM 10152
MAPGADRLRDKTVLVTGASGGIGVEIVRRLAAEGAVVIATDATAATTAACAELLAGLTEPDRHLALRLDVSDEQDWRSATETVEARFGGLDALVNNGAIGSIATVVDEELDRFQRVVEVGQLGTWLGMKHAGALVERSGGGSIVNMCSILGTVGGMGNSVAYAAAKGAVRTMTKNAALHWARRGVRVNSIHPGFIGTAQLLERYAGSERHAAMLAGTPMGRLGRAEEVAAAVAFLAGDDATYLTGAELYVDGGWTCA

SEQ ID NO: 13913 - protein, 424 aa, Rhizobium leguminosarum bv. viciae 3841
MTAITDIIAREILDSRGNPTVEVDVYLEDGSMGRAAVPSGASTGAHEAVELRDGGKRYLGKGVEKAVEAANTEIFDAIGGIDAENQIQIDNIMIELDGTPNKSRLGANAILGVSLAVAKAAAQASGLPLYRYVGGASACLLPVPMMNIINGGAHADNPIDFQEFMILPVGADSIAEAVRMGSEVFHTLRKELAAQGHNTNVGDEGGFAPGLKSAPEALDFIMKSIEKAGYKPGDDMCLGLDCASTEFFKDGKYVLEGEGRTLESGAMAEYLAELAANYPIISIEDGMAEDDWDGWKTLTDLAGKKTQLVGDDLFVTNSARLRDGIRMGVANSILVKVNQIGTLTETLDAVNTAHKAAYTAVMSHRSGETEDSTIADLAVATNCGQIKTGSLSRSDRLAKYNQLIRIEEGLGPQAQYAGRSIIRG

SEQ ID NO: 13914 - protein, 258 aa, Nectria rigidiuscula
LQVPKASWGDFFRHYSKLKNAALLLGTAGSWFCLDVAFYGLSLNNGTILKVIGYSSKDANNVYEFLYNTAVGNIIIVLAGAVPGYWVSVATIDTIGRKTIQLGGFIILTILFIVMGFAYFHIPSNGLLAIYVLAQFFFNFGPNTTTFIVPGEVFPTRYRSTSHGISAASGKVGSIIGQGAISILRTRGATEDNEAPWMDHVLEIYALFMLLGCLTTLLIPETARKTLEELSGEDDYANAHESIVDNESHNGKPERTSV

SEQ ID NO: 13915 - protein, 430 aa, marine gamma proteobacterium HTCC2080
MKLYAPKVAFAVVVANMVGTGVFTSLGFQLLGLSDTRVILLLWLIGGICALCGALCYAELGVRHPESGGEYHFLTELVHPYAGFISGFVSATVGFAAPIALAALTFGSYLQAGFLPVDPQWSATALIIGLVVVHTRTRRESSAGQVYLTVLKLLLITGFIGLALLNSPGFVGQLFNFTPLSTADMLSNEAAVALVYVTYAYSGWNAATYVLGEMEDPRRHLPRVLLAGCGFVTLLYLALNAVFLISAPVETMRGEVEIGYVVAGYLLGDTGATIVAVILAGVLISTVSAMVLAGPRALMRLGGDYPRFKWLGTLSDDGLPKNAVIFMGGIALLFLWSSTFEQILIFAGLLMAANTFVTVIALFISRRKFRRPPDDSLYQMPLYPLPALIFLGITGWTLAYSAFSFPTQVAVFAAALIAGWPLYRWARHEA

SEQ ID NO: 13916 - protein, 355 aa, Aggregatibacter actinomycetemcomitans
MLKTILVTGGAGFIGSAVVRYIIENTQDSVVNVDKLTYAGNLESLETVKNNPRYIFEQVDICDAKALARIFEQHQPDVVMHLAAESHVDRSIDGPAAFIETNIVGTYILLEAARAYWSSLNDEKKAGFRFHHISTDEVYGDLDGTKNLFTETTPYSPSSPYSASKASSDHLVRAWLRTYSLPTIVTNCSNNYGPFHFPEKLIPLIILNALDGKPLPVYGNGQQIRDWLFVEDHARALYKVVTEGKIGETYNIGGHNEKANIDVVRTICALLEELVPNKPAGVTKYEDLITYVKDRPGHDVRYAIDATKISRELGWKPQETFESGIRKTVEWYLNNQKWWSRVLDGSYNRERLGSQ

SEQ ID NO: 13917 - protein, 527 aa, Nocardioides sp. JS614
MTQPAEHDLVLVVDFGAQYAQLIARRVREARVYSEIVPHTTPVAEILAREPKAIILSGGPSSVYEPDAPSIDPAIFTSGTPVFGMCYGFQLMAQGLGGEVAHTGAREYGRTAVAVARPGTLLADIPAHHTVWMSHGDSVAAAPSGFDVLASTATTPVAAFEDVDRGLAGVQWHPEVLHTEHGQKVLEHFLVQIAHCRQTWTMVNIVEEQIEAIRAQIGDRGQAICGLSGGVDSAVAAAIVQRAIGDRLTCVYVDHGLMRQGETEQVERDFVAATGVDLKVVDAEKQFLDALAGVTDPEEKRKIIGREFIRVFEAAEADILGGSLPDDGGSKVAFLVQGTLYPDVVESGGGAGTSNIKSHHNVGGLPDDLEFELVEPLRTLFKDEVRLVGEQLGLPAEIVWRQPFPGPGLGIRIIGEVTRERLDILREADAIAREELTRAGLDRDIWQFPVVLLADVRSVGVQGDHRTYGHPVVLRPVTSEDAMTADWARLPYDVLERISTRITNEVREINRVTVDITSKPPGTIEWE

SEQ ID NO: 13918 - protein, 598 aa, Zea mays
  misc_feature (493)..(493): Xaa can be any naturally occurring amino acid
  misc_feature (509)..(509): Xaa can be any naturally occurring amino acid
MGEVVAASSLALVLLFFCSCGPASGLLSPKGVNYEVQALMMIKNYLKDPHGVLKNWDQDSVDPCSWTMVTCSPENLVTGLEAPSQNLSGILSPSIGNLTNLETVLLQNNNINGLIPAEIGKLRKLKTLDLSSNHFSGEIPSSVGHLESLQYLDLSYNNLSGPIPGSLTRTFNIVGNPLICAATMEQDCYGSLPMPMSYGLNNTQGTVIPAKAKSHKVAIAFGATTACISLLFLAVGSLFWWRCRRNRKTLFNVDDHQHIENGNLGNMKRFQFRELQAATENFSSKNILGKGGFGIVYRGQLPDGSLVAVKRLKDGNAAGGEAQFQTEVEMISLAVHRNLLRLYGFCMTASERLLVYPYMSNGSVALRLKGKPPLDWITRKRIALGAARGLLYLHEQCDPKIIHRDVKAANILLDDCCEAIVGDFGLAKLLDHRESHVTTAVRGTVGHIAPEYLSTGQSSEKTDVFGFGILLLELITGQTALEFGKSSNQKGAXKMHQEKQLDILVDKGXLGSKYDRIELEEMVQVALLCTQFLPGHRPKMSEVVRMLEGDGLAERWEALQHTESHKFKVPEFSFSRCHSDLTDDSSLLVQAVELSGPR

SEQ ID NO: 13919 - protein, 733 aa, Brachypodium sylvaticum
MSLSLPAGQKLLLLVATTLTLQHSTTADVSGSSGSISMARPGCPEKCGNISIPYPFGTGKGCFREPFNVTCNENRAYLASTGVRLLDINLNLGEVRVQNPHIAWQCNYTNGTNSSSSVGLSLDPFHKVSNTKNKLVSIGCSTLALIVGVTMGKNQLEYPIVNSCFSFCTDASTVGDSTGCLGMGCCQTSFPGNISSFYTTSLPLPGISNSTIMSFSPCSYSFVAEEDWFKFDPSYVSSTNFTSKYTDGVPLVLDWVIGNGSCSEASKMGSQYACQVMNSVCIDVSNGPGYHCNCSQGYEGNPYIQGGCQDINECDPPNQSLYPCKGNCWNTDGSYTCISISVVFLMVCIFALRAEYQKRKLAKEKEIFFDQNGGQILYHQIMSKQVDTLRIFTQDDLKKATNNFDKSRELGTGGHGTVYKGILKDSRVVAVKRSKIINLAQADEFVQEIIILSQTNHRNVVRLLGCCLEVEVPILVYEFIPNGTLFEFIHRNCRSPPPSLDTRLRVAQESAEALAYLHLSANRPIVHGDVKSMNILLDDNYMAKVTDFGASRMLPKDTVQFMTMVQGTLGYLDPEYLQERQLTEKSDVYSFGVVLLELITKKTAIYHDGPKEGKSLASSFLLAMKEENLEGILDPSIVGAGTEVLLAEVAELGRMCLGPRGEDRPSMTQVADKLKFVRTTWREKLASDHGKTERLVVHLSPAATAPWDPRLSNKSSNCSTAPYMSGIGIETPR

SEQ ID NO: 13920 - protein, 111 aa, Brachypodium sylvaticum
MSTTVSRAYLDQRLAAAKRCSKEAAMAGAKAAAVATVAAAVPTLASVRMVPWARAHLNPTGQALIISTVAGMAYFIVADKTVLSMARKHSFDAAPDHLKDTSFQGGGAFRH

SEQ ID NO: 13921 - protein, 480 aa, Nocardioides sp. JS614
MTLDRSAFFIDGGWAAPATSATLQVVSPHTEQVVATVPEGSAADIDAAVAAARRAFDDGPWPRMSPQERIEVVQAFSNLYAGKLAEMAELITIEMGSPTSFANLAQSPAPWMQIESFLAVARAFPWEEARPGALGADVIVRREPVGVVAAIPPWNVPQFTTMSKVVPALLAGCTVVVKPAPETPLDTYLMAELLAEAGVPAGVVNIVAAGREVGEHLVAHPGVDKVAFTGSTAAGRKIAAVCGEQLKRVSLELGGKSAAIVLDDADLAATMEGLKFTALMNSGQACVAQTRILASRSRYDEVVDALAATVSGMQVGDPMDPATEIGPLVAQRQQERVEKYIALGQEEGARVVVGGNGRPDGLDAGWYVRPTVFADVDNRMRIAREEIFGPVLSVIPFDDVDDAVRIANDSDYGLAGTVWTGDVEAGLDVARRVRTGTYGVNTYTMDFAAPFGGYKSSGIGREFGPEGLAQYTELKAIYTP

SEQ ID NO: 13922 - protein, 133 aa, Brachypodium sylvaticum
MSTVTGAYLDRKLALAKRCSREATLAGAKAAAVATVASAVPTLASVRMLPWAKAHLNPTGQALIVCTAAGMAYFVAADKTILSLARRHSFEEAPEHLRDTSFKLHGAAAAPVTAARPRPSSSDIVQAIMAMSP

SEQ ID NO: 13923 - protein, 281 aa, Bacillus sp. SG-1
MNQNILTRNNVKVKGNGKQPMIFAPGFGCDQTVWTLVSESFENDYQVILFDYVGLGDSDVKAFDPDKYSKLSGYAQDVLDVCSALDLRGAIFVGHSVGSMIGMLASLRKPEYFSHLIMVGPSPCYLNDPPEYFGGFSKEDLIGLIDMMAKNYIGWANVFSTTITNNPDRPEVAKELEDRFCSTDPIIARQFAEACFFADNRQDLPRVTVPSLILQCSEDVIAPTAVGQYMKEHLPYSMIKYMNATGHCPHMSHPEETIELIRDYLEENSIKAVTVDTGELL

SEQ ID NO: 13924 - protein, 584 aa, Nocardioides sp. JS614
MSQPSALSPQARDRALAAMRSTGGQPAGVRPELDVLVVGGGVTGAGTALDAVTRGLSTGLLEQRDLASGTSSRSSKLIHGGLRYLEMLDFGLVREALQERGLLLTRLAPHLVRPVPFLYPLTHRGWERPYVAAGLTLYDGMAALGALRSQGDMGLPRHKHLLRRHVARIAPDFRAETITGAIQYWDCQVDDARLVVTLARTAAAHGAHVATRVKVTGFLREGERVVGVRALDLETQEELEVRARVVVNAAGVWTDEIQEMVGGRGALHVQASKGIHLVVPRDRIRSEAGFIVRTAISVLFVIPWGRHWIIGTTDTPWDLDKAHPAASRADIDYVLEHVNAILREPLDHDDVQGVYAGLRPLLSGESEPTSRISREHTVVTPVPGLVMIAGGKLTTYRVMGKDAVDAAAHSLRTTANLTVRDSITDRVPLVGAADWETRANQRVLLSRRSGLHVARIDHLLGRYGGLVDDLLDLVATRPELAAPLDGADDYLAAEVVYAVTHEGARHLDDLLTRRTRISIETFDRGVRVASEVARLMAGELGWDDARTADEIDHYRRRVEAERQSQLQLTDQEADEARVSAPDIV

SEQ ID NO: 13925 - protein, 576 aa, Glycine max
MVTMGLKALFVWCIIWLAFAQLSLGGRVRHYKFDVEYMIRKPDCLEHVVMGINGQFPGPTIRAEVGDILDIALTNKLFTEGTVIHWHGIRQVGTPWADGTAAISQCAINPGETFQYRFTVDRPGTYFYHGHHGMQRSAGLYGSLIVDLPKGQNEPFPYDGEFNLLLSDLWHTSSHEQEVGLSSKPFKWIGEAQTLLINGRGQFNCSLASKFINTTLPQCQLKGGEECAPQILHVEPNKTYRIRIASTTALASLNLAISNHKLVVVEADGNYVTPFAVDDIDIYSGESYSVLLRTDQDPNKNYWLSIGVRGRKPNTPQGLTILNYKPISASVFPTFPPPITPLWNDFERSKAFTKKIIAKMGTPQPPKRSDRTIFLLNTQNRVDGFTKWAINNVSLTLPPTPYLGSIKFKIKNAFDKTPPPVTFPQDYDIFNPPVNPNASIGNGVYMFNLNEVVDVILQNANQLSGSGSEIHPWHLHGHDFWILGYGEGKFKSGDEKKFNLTHAPLRNTAVIFPYGWTALRFKADNPGVWAFHCHIEPHLHMGMGVIFAEAVQKVGKIPRDALTCGLTGKMLGNRHY

SEQ ID NO: 13926 - protein, 266 aa, Bradyrhizobium sp. ORS278
MAVTESPELTDKVALITGAARGIGLATAKRFLHEGWRVALLDIEAKLLADSAAALKCPDRTLALHCDVADAAMVADALERIATRFGRLDALVNNAGVARFASVMETSETDWQRILDVNLTGPFLCTRAAVPLMREHGGAIVNITSISAVRASTLRSAYGTSKAALAHLTKQLAVELASAGIRVNAVAPGPVETAMARAVHTPEIRADYHDAIPLNRYGLEEELAEAIFFLSSERSSYITGQVLAVDGGFDAAGIGLPTLRGQRRNA

SEQ ID NO: 13927 - protein, 180 aa, Neptuniibacter caesariensis
MSYDECYVKSVIRTIPDWPEPGVQFRDITPLFKDPKALRMISDAFIQRYIDSEITHIASIDARGFLISSIMAYHLNIPLVLVRKKGKLPGETIHQEYKLEYGTAAVEMQLDAVTEGDKVLVFDDLIATGGTILAACSLIKELGAEVYEAAALIDLPDLQGSSKIQDAGVPVHSLLAFEGI

SEQ ID NO: 13928 - protein, 247 aa, Solibacter usitatus Ellin6076
MSIRTQAELEKLRVIGRIVRLALDRCAANVRPGITTRELDEIGARVLAEQGAESAPPKVYGFPGALCISVNDEAIHGIPGDRTLAEGDLVKLDLVAEKDGFFADAAVTVAVGAVSTAATALMRCAESAFHRAARVARAGNRVYEIGHEVESETHRCGFRVLRDLCGHGVGRTIHEAPSVPNYHDPRYKTRLTEGLVITIEPILAESTRIGELQDDGWTIRTADRSLSAHYEHTIVITKGAPLLLTAA

SEQ ID NO: 13929 - protein, 257 aa, Lentisphaera araneosa HTCC2155
MISKFWQEILTQAEAVKQDEHRLAKLIDEAILSKSSIEQVLTSRLAESLGEKYVSAEDLEHIFTELYAEDPFLAKAAKKDLKAICDRDPACNCYVIPMLYYKGFQALQASRLAHILWNKGRAHLASHIQSRNAEIFGVDIHPGARFGTGILLDHASSFVAGETAVVGDDVSILHEVTLGGSGKECGDRHPKVGNGVLIGAGAKLLGNICIGAGAKIGAGSVVLDDVEGHTTVVGVPARPVGKPLHQSPSKYMDHHVE

SEQ ID NO: 13930 - protein, 309 aa, Zea mays
MAENTGARGAKEAVVTSGKRVALGNLTNVFRGSWGSGAANSASDAKLSSTKPDDVKKGSYACLRNVNTERGSSRRLASEQFDQAVSLLQKNTSLPSVPDVVSTGCSSPGLSQDCSVSMEDAMSTCNSTESSDVEYLNNNDDPSMTSSSHWWASDRPHFSDSMDVAEFNWRKHSPNHYTYKDPRLSTTLACEIYESLREAETRKMPPTNFLETTQTDMSKTMRAILIDWLVEVTEEYRLVPETLYLTVNYIDRYLSVKEISRHRLQLVGVACLLIAAYMGVEQENLKGNEGEERMLPYPYHGKSVDIIEK

SEQ ID NO: 13931 - protein, 110 aa, Citrus limon
MTSNRGQGGIQQLLAAEQEAQHIVAAARNAKMARLKQAKEEAEREIAEYRAQVEREFQRKLAESVGDSGANVKRLEQETEVKIHHLKAGAEKIQYDVVQMFLKHVTTVKN

SEQ ID NO: 13932 - protein, 331 aa, Lentisphaera araneosa HTCC2155
MAIKVGINGFGRIGRNVFRAAAKRDDIQIVGINDLLDVDYLAYMLKYDSVHGRFDGSVEVVDGKLVVDGSEVRVSAERNPADLAWGDVSAEVVVESTGFFLTDETARGHIAAGAKKVVLSAPSKDATPMFVYGVNTDKYAGQDIVSNASCTTNCLAPISKVLNDKFGIKRGLMTTVHAATATQKTVDGPSAKDWRGGRGILENIIPSSTGAAKAVGKVLPELNGKLTGMAFRVPTSDVSCVDLTVELEKDASYEEICAEMKRASENELAGVLGYTEDAVVATDFRGCELTSIFDAKAGIALDGTFVKLVSWYDNEMGYSNKVLDLITVITA

SEQ ID NO: 13933 - protein, 339 aa, Rhodococcus sp. RHA1
MYFDFRDKPDRLCVKEMVHGYNISSCLFVAVELELADLLAAGPMALADLAQRSGTDPDALKRILRLLMSAGIFSVDEQDRCALTPRAEFLRRDNPESIASEVELFAGAETYLAWSELLQCARTGQTGFGQFFGKSLFEYLAEHPDSAQRFHLGWHEISIRAGLETAEAIDFTDNRHVVDVGGGYGIVTAQLLHKHDHLRGTIYDLEFSLARAGHTLREYGVDERCGIVPGDGFTEVPGGGDVHLLKSVLHTMNDDDSVRVLINCANALEPGGRILVLERVISGDGGYVWGNVVDVAMLVMTGGRERTIQDYARLYERAGLELTGSTLLPCGFSVIEGRK

SEQ ID NO: 13934 - protein, 269 aa, Chlamydomonas reinhardtii
MPLPPHYKDLEIDPKELTLGQRIGIGSYGEVYKGSWRGTEVAVKRFLEQNLSPPTIRDFRDEVLIMSKLRHPNIVLFMGAVTQSNQLAIVTQFVARGSLFRLLHRTKEVLDPRRRLNMSLDIAKGMEYLHNCKPVLVHRDLKSPNLLVDRDWTVKVCDFGLSKVKMDTFLTAKTQGGSPAWMAPEILRSERCDEKSDVFSFGVILYELVTGREPWEELNPMQVVGVVGFNGQRMDLPPDLDPGVTALITACWADKPADRPSFSQILATL

SEQ ID NO: 13935 - protein, 345 aa, Triticum aestivum
  misc_feature (8)..(8): Xaa can be any naturally occurring amino acid
GPHRFSYXDLFRATEGFKNKNLLGVGGFGKVYRGVLPASKCEIAVKRVSHSSKQGMKEFVAEIVSIGRMQHPNLVRLLGYCRRQGELLLVYEYMPNGSLDRYLYSQPQEADDKHNGTLNWVQRLGIIKGIASGLIYLHDEWEKVVVHRDIKASHVLLDSGMNGRLGDFGLAMLYDHTADPETSHVVGTIGYLAPEIGRTSKATILTDVFAFGIFVLEVTCGQKPIMQGSKDDQLMLADWVVEHWNRGSLVETVDTKLQGEYDVDEACVVLKVGLLCSHPFPEARPTMRQVLQYVNGDMPVPELVPAHLSLQMLAFMQNEGFDSYIMSYPSSVESINSLTSLVHER

SEQ ID NO: 13936 - protein, 331 aa, Rhodococcus sp. RHA1
MSDVNHRVRKQIMGYIVSQSISAVCELGVPDRLADGACLLGDLAASVGADADALGRFLRVLVAEGLFAEVGGGRFALTEAGELLRADAPGSLRHLVGLMSNEAYLVWGHAAHSIRTGKESFSTAFGNPYFEWLSENPSAADEFARGQAGLVELRLLPLLDHDWSDVGTVVDVGGGTGALITRLLDRHAHLRGVLFDLPHVVAEAPSTFGSAGIGERTTVVGGSFFDDVPGDGDVYVLSQILHDWDDASAGKILGSCRQAIPPGGRLMIVEQVLPESATTHPMALLDLHMLVLLGGRERTITEWRRLLTDHGFTLDSITQGPRSSVIEAVPV

SEQ ID NO: 13937 - protein, 137 aa, marine gamma proteobacterium HTCC2080
MTESDSALEFTTHEGGCHCGNVQWQIQAPAHLQTHTCNCSICDINHYQHLIVPKQRFHLLKGSEDLSDYRFGSGQAQHYFCKSCGVKSFYVPRSNPDGVSVHARCLNLATVLSITDTPFDGQNWEKNAASLAHLSKA

SEQ ID NO: 13938 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGFVNVAGMTPDNMAPLCEAIVAVL

SEQ ID NO: 13939 - protein, 268 aa, Glycine max
MAEHLASIFGTEKDRVNCPFYFKIGACRHGDRCSRLHNRPSISPTLLLSNMYQRPDMITPGVDPQGQTLDPRKIQQHFEDFYEDIFTELAKFGEIESLNVCDNLADHMIGNVYVQFREEDQAAKALHALRGRFYNARPIIADFSPVTDFREATCRQFEENSCNRGGYCNFMHVKLIGRDLRRRLFGRNHRGGSGTYHRVSRSRSRSRSASPRYRRERRESDSRGGRRSRERDGSGGRRRQHGSPPAREGSEERRARIEQWNREREENK

SEQ ID NO: 13940 - protein, 440 aa, Magnaporthe grisea 70-15
MEGMKEPKPQCGGNKEKGEYDLPLHVAALFLVMAASIFGCGFPVVAKKVKWMKIPPKVFFACKHFGTGVLIATAFVHLLPTAFQSLNNPCLPDLFTENYPPMPGVIMMGSMFALFVVEMWINSKLGGHSHGGVMGYEEHDSHAHAHGPMVAAAPPPRPPRYNASSFEADDIEFEKRMAQQMYEQEAKINPFADPGARRQNPNEPPNVGDSEMPAWFVVFYEQYVRQRLEMMNMIRASERAQGQNTLAAPVGEKGPNNAVAVQDSPFIDEEGQQVDPAVYRKMSLNITMLEGGILFHSVFVGITISLTIDGFIILVIAILFHQMFEGLGLGSRIAAVPYPKNSIRPWLLIVAFGTTAPIGQAIGLAVRDSYDPDSAIGLITVGVFNAISSGLLIYAALVDLLAEDFLSEEAQKTLTKSLRIQAFSWVLLGAAGMSIVGAFA

SEQ ID NO: 13941 - protein, 183 aa, Archaeoglobus fulgidus DSM 4304
MQDYKIKIENVVASTQIGENIDLNKISREIKDSEYKPKQFPGLVLRTKEPKAAALVFRSGKVVCTGSKSVEDARRAVKQIVKMLKEIGISVIDEPEVKVQNIVASADLGVDLNLNAIAIGLGLENIEYEPEQFPGLVYRLDNPRVVVLIFGSGKMVVTGGKSPEDARKAVERISEELRTLGLM

SEQ ID NO: 13942 - protein, 634 aa, Leptospira interrogans serovar Lai str. 56601
MQQELTLLDRINYPAELRNIPLEKLPQICKEVRNYIIDTLSGIGGHFASNLGVVELTVALHYVFDTPKDRLVWDVGHQTYPHKILTGRKDKLNTVRKFNGLSGFPKREESPYDLYNTGHAGTSISQALGEAAARDLVKENYNVVAIIGDASIATGMALEAMNHAGHLKKDMIVILNDNYMSISKNVGSISNYLNNIITSHFYNHWKRVFYTFLKWLPIIGPATERFFKKVEKGFKDVLTPGGLFEDLGFGYIGPEDGHDVIRLVKMLEKVKKMKGPILLHIITQKGKGYDPAERDPIKYHGVTPFRKEDGAMDSGDTSKIAYSKIVGKMLAILTETNPKIAAITPAMIEGSGLKEYAEKYPEHLFDVGIAEQHSVAFAGAMTNGNIIPYMCIYSTFLTRAMDQLVQDVSLMNLPVRFVIDRAGCVGPDGETHQGLFDLGYLLGLPNMDVFVPSNGQDLIDALRWMEKYDKSPVAIRFPKSSVDLKTLDFYKETELQPGTFRVFKRGTDVALISIGSMIDEAKKASERLENEGLSVTLIDLVWLRPLGAEALNEELVNVRCFVILDESYIDSGVTGYLLNRMTRENLSKYIKTFGFPPEPIHHGERKEVFQKYRLDGESIAEQVAAVLKKNLIKP

SEQ ID NO: 13943 - protein, 609 aa, Saccharomyces cerevisiae
MNSSYTQRYALPKCIAISDYLFHRLNQLNIHTIFGLSGEFSMPLLDKLYNIPNLRWAGNSNELNAAYAADGYSRLKGLGCLITTFGVGELSAINGVAGSYAEHVGILHIVGMPPTSAQTKQLLLHHTLGNGDFTVFHRIASDVACYTTLIIDSELCADEVDKCIKKAWIEQRPVYMGMPVNQVNLPIESARLNTPLDLQLHKNDPDVEKEVISRILSFIYKSQNPAIIVDACTSRQNLIEETKELCNRLKFPVFVTPMGKGTVNETDPQFGGVFTGSISAPEVREVVDFADFIIVIGCMLSEFSTSTFHFQYKTKNCALLYSTSVKLKNATYPDLSIKLLLQKILANLDESKLSYQPSEQPSMMVPRPYPAGNVLLRQEWVWNEISHWFQPGDIIITETGASAFGVNQTRFPVNTLGISQALWGSVGYTMGACLGAEFAVQEINKDKFPATKHRVILFMGDGAFQLTVQELSTIVKWGLTPYIFVMNNQGYSVDRFLHHRSDASYYDIQPWNYLGLLRVFGCTNYETKKIITVGEFRSMISDPNFATNDKIRMIEIMLPPRDVPQALLDRWVVEKEQSKQVQEENENSSAVNTPTPEFQPLLKKNQVGY

SEQ ID NO: 13944 - protein, 329 aa, Arabidopsis thaliana
MKLDHVDSTADITKQHEKENTHDHPNANPNPNPNPHPHPHPQLTKTTSSRSKTSRHGTPSVRSESSCNSQTFLMRINNHNENKQRKMNDTSISFGGFRCYGPCSGVKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 13945 - protein, 380 aa, Bacillus sp. SG-1
MNLPLFLGLFLLVLFITAYFGNKVLRIPDIVIYILLGAGISLAGLLNEAKTIEVAGEIGLILLFFLLGMKYPLKEIVSKGKKVWKPGLLDLVLGVGVTAGISALFGQGLFNSLLIGGLVYATSSSITIKLLEHNKKLDRKESGYVLTLLIFEDMVAPILITVLIGLSGDGFSVMDFLLIFLKVALLVGIAVTISRFIQKKGYTLIEKFLHEDYLLVYIIGLALAYGGFAVLLGLSEVIGAFLAGLMFAGTNFKDKIQEVALPVRNLFLPFFFLNFGISLEFTSEIPAFSLLFTIILWSIFHKLIVGFIGGQWYGLNKQESLETGFTLAPRGEFSVIIAGLASGTLQIFAGVYILIAALIGMLMCQLSSKIAGRIYRRKGS

SEQ ID NO: 13946 - protein, 435 aa, Nicotiana tabacum
MLINGFIYLKDWANAFAIFEDVIRDGLKPDVVLYNNIIRAFCGMGNMDRALRIVEQMKKERHRPTSRTFMPIIHAFAKAGAIRKALDVFDMMRRSGCIPTVQTYNALILGLVEKRQMDKAVEVVDEMLLAGIRPNERTYTTIMDGYASLGDTGKAFEYFSRIKDEGLELDVYTYEALLKACCKSGRIESALAVTKEMNAKNIPRNTFVYNILIDGWARRSDVWEAADLMQQMRQEGVQPDIHTYTSFVNACCKAGDMQKAMNTIQEMKRVGLNPMLKPIPLSYTVGHASLPEKALKCFEEMKKSGLKPDKAVYHCLMTSLLSRATVAEDYIITGIHRVCEEMVESGLTVDMGTAVHWSRCLRKIERTGGDITEALQKTFPPDWNSHRNLNAASYDTGNNEGLNDRVTTMVLCMRLTVTATVTMIQMPPRCNQKVA

SEQ ID NO: 13947 - protein, 65 aa, Oryza sativa Japonica Group
MQSRDCSSPVMCQWHSSSNASMPASDKFILHMLDPTHMFVQPHVADMIRSKISEFRDQNSYEKPS

SEQ ID NO: 13948 - protein, 475 aa, Burkholderia vietnamiensis G4
MSTQPQIVPTILCGGAGSRLWPVSRESHPKPFIRLEDGESLLQKAFKRGAQLPGVTEVVTVTNRELYFKTSDEFSTVNTGHLSTSFILEPFGRNTAVAIAAAALRVAATLGGNAILLVLPADHLVTDDAAFATAVQEAAALALKGALVTFGITPTFAETAYGYIEADGTRVKRFVEKPTVDVARQYVESGSFLWNSGMFCFTAAFLLAEMAKHCPEVLEATRACIAQSRQSEGGGVSLVELNGDQLNRTPDISIDYALMERSDKVAVVRCDIGWSDIGSWNALGDLLKPDDHGNRVDGEALLHDVSNCYIRSDNRLVGAVGVRDLLVVDTPDALLIADRNRAQDVRHVYAALKSQGHETFRVHRTVGRPWGMYTVLEESTRFKIKRIEVKPGASLSLQLHHHRSEHWIVVSGMALVVNNDEEFYLRTNESTYIPAGHKHRLTNPGVVDLVMIEVQSGDYLGEDDIVRFDDNYGRS

SEQ ID NO: 13949 - protein, 139 aa, Oryza sativa
  misc_feature (13)..(13): Xaa can be any naturally occurring amino acid
  misc_feature (36)..(36): Xaa can be any naturally occurring amino acid
  misc_feature (46)..(46): Xaa can be any naturally occurring amino acid
  misc_feature (96)..(96): Xaa can be any naturally occurring amino acid
ELGISGGSNNAAXDETNAEKKGSNHTGVEDAPSPSXSHCSSKKKAXKAKAAKESQGPAYGTEETATPEPYEGSTSVYVKERLKKVSSIKKKESGEXSAPAAKIATDEVAARSVRLGAANNKEKIPFIQATCAVNVRQSF

SEQ ID NO: 13950 - protein, 428 aa, Solibacter usitatus Ellin6076
MTSSNNPLRDIEMTTLANGVRVITEAMQHVRSVSVGIWIGAGSRRETTEQNGISHFIEHMLFKGTTTRSAEDIARAVDALGGNLDAFTAKELVCFNTKVLDQHLSQAFEVLADLVLNPMFREEDIEKEKGVILEEIKMEADSPDYLVHEIFSSNFWKDHPLGKPILGTPQSVRRFDSTMIRDFYRSVYSPANMVVTAAGHMTHEGLTALVQQYFASLPPGPAAPPDLQPSTHARIALRNKKSLEQVHLCLGVPSYPLPHEERFACYVLNTLLGGGMSSRLFQNIRERQGLAYAVFSELNPYRDTGCLSIYAGTSAESARQVVESITTEFRQLKGDRVGDEELRRAKDHLKGSLMLGLESTASRMSNLARQEMYFGRFFTLDELVESIEAVTAEDVRRIAQTFFDSRQIALTILGNLENFRITREELGC

SEQ ID NO: 13951 - protein, 289 aa, Prunus persica
  misc_feature (206)..(206): Xaa can be any naturally occurring amino acid
MEGKEEDVKLGANKFSERQPIGTSAQTQDEGKDYKEPPPAPLFEPGELTSWSFYRAGIAEFIATFLFLYITILTVMGVVKSPSKCSTVGIQGIAWAFGGTIFALVYSTAGISGHINPAVTFGLFLARKLSLTRAVFYIAMQTLGAIAGAAVVKGFEKSRNFELLGGGANSVAHGYTKGSGLGAEIVGTFVLVYTVFSATDAKRSAXDSHVPILAPLPIGFAVFLVHLATIPITGTGINPARSLGAAIIYNKKHAWDDHWIFWVGPFIGAALAALYHVVVIRAIPFKSKS

SEQ ID NO: 13952 - protein, 432 aa, Lentisphaera araneosa HTCC2155
MRKSILGMILAGGEGTRLSPLTTKRAKPAVPFGGKYRIIDFVLSNFVNSGIHSLFVLTQFRSQSMSEHIINGWNMSSLMKGQFVVPVPAQMQGGDKRWYEGTADAIWQNIHLLQDFTPDLVAVFGGDHIYKMDISQMAKFHAKRDALATIAALPIPIDEGSRFGIIQVDEDWRITGFQEKPDHPTEIPGMPGYCLASMGNYVFDSKWLYKSLKADSQNPDSHHDFGHDILPPAVESGRLYAYNFFENKIPGSDVSKDNYWRDVGTLKSYYDSNMDLKEADPQLDLYGSGWPIHTYNSPLPPAKFVHDEHHPDGRTRIGHATNSIVCDGCIVSGSSVKESILSSEVHVHSFSSIDSCIILNSVEIFENCKIKNAIIDKHVILPPGTVIGYDRQADESRYHVVDLCEEQGTWLTVIEKNHSRVSKDTKTTVLTI

SEQ ID NO: 13953 - protein, 914 aa, Solibacter usitatus Ellin6076
MTKYVYSFGNGTADGDGKMKDTLGGKGAGLAEMCRAKLPVPPGFTISTQVCNIYFDNKFSVPKEIHQEMLGSLAILEERMGQKLGDTDNPLLVSVRSGAKFSMPGMMDTILNLGLNDKTVKALEAKSNNARFAYDCYRRFIQMYGAVVLEVPKHDFDEVFEGQKKKAKAKLDTELTAKDLQEVIEGYKKLVQKKTGKPFPQDPLEQLAGARDAVFRSWFNDRAKYYRKMNQIPDDLGTAVNVQGMVFGNLGETSATGVGFTRNPATGENVFYGEFLENAQGEDVVAGIRTPHPISELEKWNKAVYDQLREITTMLENHYRDIQDFEYTIQDGKLYMLQTRNGKRTGPAAVRIAVEMVEQGLIDKKEAILRVDPQQLDQLLHPVLDPKQIKTLTTLAKGLPASPGAAVGTIVFSAEDAVEQSTKAPVILVRKETVPDDIHGMEVAKGILTARGGMTSHAAVVCRGMGTPCVAGAETVTVNEHKKEVSVTVNGKVMTLKEGDWVSLDGSTGMVYAGKANTLEADPKSGVLAKFMGWADEFRGKFGVRANADIPRDAKVARKFGAEGIGLCRTEHMFFAEDRIEHMQAMILAREEKARRKALLKLLPMQRKDFAGLFTAMDGFPVVIRTLDPPLHEFLPKREDLMVDVAILPYADIKKKKELAAKYVKFGAEVKNLKTIIPDLLKRVEELHEFNPMLGHRGCRLGVTYPEITEMQARAIFEAAVQVAKKGIKVIPEVMIPLIGGVKELENQKKIVVEVAEEVLAKAGMKKLKYMVGTMIEIPRAALTAGEVAKEAEFFSFGTNDLTQTTMGLSRDDYTKFQQDYQDRKIFANDPFAVLDQEGVGQLVKLAVVNGRKTRPDLEVGICGEHGGEPSSVQFCYRVGMDYVSCSPFRVPIARLAAAQAAISGDKNEMSRTA

SEQ ID NO: 13954 - protein, 141 aa, Legionella pneumophila str. Paris
MAKELTLSIIKPDAVAKSVIGEIYTRFEKAGLDIVAAKMIQLSREQAESFYDIHRARPFFKDLVDFMISGPVMIQVLKGDNAVAKNREIMGATNPKEAAPGTIRADFADSIDANAVHGSDSLENAAREIAFFFEPHELCNR

SEQ ID NO: 13955 - protein, 320 aa, Rhodococcus sp. RHA1
MPKVAIVTTGGTIASMRDGQGVSRPVVAGPDLLGNAWTGTELRVVDVMSKDSSSITFADMDRVRDAVTAELRDPDLDAVVVLHGTDTMEETAFLVDLHHADPRPVVFTGAQRTFDHPESDAQTNLADAVAAGSDPALRGAGVLIAFGGALHPASGTRKVDTTSLDAFRSVHPAGVTPRRRLDPLPWHPISGTRVDIVAAYPGADRVQIDACRAAGAQGLVLDGLGSGNANPAIVEAVRDCASAGIPVVVTTRVPNGPTSATYGGGGGGHDLVSAGALFSTDLRAGQARILLAALLADPEHTDLDKEFDRRSRIDPAPRIS

SEQ ID NO: 13956 - protein, 180 aa, Arabidopsis lyrata
IIDPGLYSLNKSEIWWVSNQRSLPTSFKLFTGSAWTFLSRPFSEYCIIGYDNLPRTLLLYYTNFVSSPEGYFQTLICNSDEFKSTTVNHDLHYIAWDNPPKQHPKILGTRDYRKMVTSNRPFARKFKSNDPVLNRIDREILRRTRKRGSKPDLGPGPGARRLKSLLMRLLLRRNFVNRQC

SEQ ID NO: 13957 - protein, 603 aa, marine gamma proteobacterium HTCC2080
MTTLYKRLKALALRFARLTTITLLWFLSCSINAQSLGPGARPVGADWSRSPVYGAQGMAATAQPLASQIAIDILKQGGTAVDAAIAANAALGLMEPTGNGIGGDLFAIVWDPKTQQLYGYNGSGRSPVGRDLDALLSAIEAMKSGGQLPKDYRGIPSHGSLAVTVPGTVDGWFALHERWGALDMDEVLAPAAEYAEIGFPMSPVIAAAFAANQRRFEQRESMIEELDNARALYFPEGVAPAVGTMFRNPDLAKTLRTLGAEGRASFYQGRLAEQMADYFEAIDADLTAADLANHVGEWVEPRGVDYHGATLWELPPNGQGFAALMMLNIIKQADVAEMERGSAELFHLMVEAKRLAFEAMAQTFADPVFAQIPVDQLLSDKFAEAQYARISTDKVLTAEALAVPLEGEGDTTYLTVADASGMMVSLIQSNYRGMGSGLVPTGLGFMLQDRGELFSLDPKHPNVYAPGKRPFHTIIPAFVTREGKPWMSFGLMGGGMQPQGHVQVLVNIVDFNMNLQEAGDAARFLHDGGSSPDGGDPTAYGTLYVEPGVPVETVSSLRELGHNVVFDDTAGPFGGYQAIQRDQHTGVYSGATEMRKDGTVAAW

SEQ ID NO: 13958 - protein, 481 aa, Rhodococcus sp. RHA1
MTIEKDDTSGADIFVEEDLGYRKALGPRQIQMIAIGGAIGTGLFMGAGGRLQQAGPALVLVYALCGFFAFLILRALGELVMHRPTSGSFVSYSREFFGEKMAFAAGWLYWMNWAMTAVVDVTAVALYMNFFKKYWAPLGNVDQWVFALAAVVLVLGLNLVSVKVFGELEFWFALIKVVALAAFLGFGIYFVLFGTPIEGHSSGFSMITDNGGLFPNGILPAVVVIQGVVFAYASIELVGTTAGETKNPQKVIPKAINTVIIRILVFYVGSVLLLSLLLPYTEYHAGESPFVTFFGSINVQGADAIMNLVVLTAALSSLNAGLYSTGRILHSMAMAGSAPSFAARMNKSGVPYGGIALTGFVILLGVGLNAVVPAQAFEIVLNLAALGIISAWAVIVLCQLKLWKFAKEGKLTRPGFRMFGAPYTGLLTLAFLGCVVILMAFDHPVGTWTVGSIAIIAPLLVIGWFGARNRIRSLASDRPTG

SEQ ID NO: 13959 - protein, 464 aa, Clostridium thermocellum ATCC 27405
MATENVGTVVQIIGPVIDIRFERGKLPSIYNAIKINSEGIDIVAEVMQYTGNDTVRCVSMNSTDGLKRGMKAVDTGEPIKVPVGKEVLGRVFNVLGEPIDGKGDVKATTYLPIHREAPGLDEQKPVTEILETGIKVIDLLAPYAKGGKIGLFGGAGVGKTVLIMELIRNIATEHGGYSVFTGVGERSREGNDLWNEMNESGVIEKTALVFGQMNEPPGSRMRVGLTGLTMAEYFRDELGQDVLLFIDNIFRFIQAGSEVSALLGRIPSAVGYQPTLATEMGALQERITSTKKGSITSVQAVYVPADDLTDPAPATTFTHLDATTVLSRHIVEQGIYPAVDPLDSTSRVLDRRIVGDEHYTVARKVQEILQRYKELQDIIAILGLDELSEEDKLIVFRARKIQRFLSQPFFVAEAYTGYKGKFVRIKDTIRGFKEIIEGKMDDIPEAAFYMAGTIDEVYERAKKM

SEQ ID NO: 13960 - protein, 477 aa, Streptomyces coelicolor A3(2)
MTQSDSLTYDVVVIGAGPVGENVADRTRAAGLSTAIVESELVGGECSYWACMPSKALLRPVLARADARRLPGLAQSLQEPLDATAVLARRDEFTSHWKDDGQVQWVEGIGADLYRGQGRLAGPRTVEVAGPDGTRRTLSARHAVAVCTGSAAALPPLPGLAEVRPWTSREATSAERAPGRLIVVGAGVVAVEMATAWQALGSRVTMLVRGDGGLLARMEPFAGELVAEALTEAGVDIRTGVSVESVTRENGTVVAVTDTGDRLEADEILFATGRTPRTGDIGLDTVGLKPGSWLPVDDSLRVEGSDWLYAVGDVNHRALLTHQGKYQARIAGAAIAARASGVPILESDPWGAHAATADHDAVPQVVFTDPEVASVGLTLAEAEQAGHRVRAVDVPIAVAGSSLYGDGYKGRARMVVDLEDEIVRGVTFVGPGVGEMIHSATIAVAGRVPISRLWHAVPSYPTISEVWLRLLETYRDN

SEQ ID NO: 13961 - protein, 658 aa, Triticum aestivum
  misc_feature (10)..(10): Xaa can be any naturally occurring amino acid
  misc_feature (25)..(25): Xaa can be any naturally occurring amino acid
  misc_feature (74)..(74): Xaa can be any naturally occurring amino acid
  misc_feature (126)..(126): Xaa can be any naturally occurring amino acid
  misc_feature (425)..(425): Xaa can be any naturally occurring amino acid
  misc_feature (571)..(571): Xaa can be any naturally occurring amino acid
  misc_feature (586)..(586): Xaa can be any naturally occurring amino acid
  misc_feature (604)..(604): Xaa can be any naturally occurring amino acid
  misc_feature (606)..(606): Xaa can be any naturally occurring amino acid
MASISGAAAXPPPPPRAGSGCGGSXHAPLPPPPPRAPFHRGPLPLLLLLLRLLPLPRPGPAARVQGAGPGRRRXVEKDPIKLWDRYVEWLYQHKQLGLFVDVSRMGFTDDFLLQMEPLMQRAFVAXMGELEKGAIANPDEGRMVGHYWLRDPGLAPNSFLRTKIEKTVDHILAFSQVIVSGKIKPPSSQAGRFTQILSIGIGGSSLGPQFVSEALAPDNPPLKIRFIDNTDPAGIDHQIAQLGEELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGDRVNQGLTVYGNIXSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLGTNPXRCHCPEDIEMIYKIXQHMATNDRALYSGRYCGXPXNVKVTLGEFMTTYDYPSLALGPNGWPGIKEHTMAGPCIPCILMVWWTMSCPR

SEQ ID NO: 13962 - protein, 266 aa, Xylella fastidiosa 9a5c
MRGNQMTALSVKYAADLIRGLQTLTVEDIRSNLTKVYSRIIAACQRVDRHPSSVTLLPVSKTVDEVHIRLSYEAGCRKLGENKAQDAYHKWEAMSDLTDLHWSVIGHLQTNKAKLVARFASEFQALDSLRVAEALERRLQIEGRSLDVLIQVNTSGETNKYGLPPEEVVRFVQALSAYPALRVRGLMTLALLSGDTSRVRQCFTQLRILRDRIQQASPQGHHITELSMGMSGDLEIAIEEGATVVRVGQAIYGARALPNLHFHHTV

SEQ ID NO: 13963 - protein, 1136 aa, Gibberella zeae PH-1
MATLDALRIALRQQIPSEASTKALSDIEYQHGFDLFLHHNGWGNYRDFVIPKLSQLLHSQFSSRKEVSVLEVGSGPKSVFGYLPNFMRQKITSYSAYEPNHLFAEKLKTWLHPTKETSPFPSLCTSYINIEPFTQETVVHEKQQIILFCHSLYGVSSKDQVVRHALDMLSEESEEGILVVCHRDTALFLNDLVCQRSAIFPDGTFRIANSNDTINRFASFVAGCSIQSDTMRNAIHDNWRNVCRSLARYDNNHPDTLTFASPEVIMTFTRHSTALPELTAIVPLASKDYKVKNKEAQSHVPAAVVRPADVGQVQRCVTWALKHRFCLTVVGGGHSGHCRWRNVVSVDMGAFNQVHIVRKTGGSNEGHPLVVAGTGCKTGDIIQAAQSEGLTVPLGARPSVGSGLWLQGGIGHLLRPHGLACDAIVGAVLVSVESGQVLCVGEVPCEHQPIDAIRPNNEDDLLWSLKGAGNNFGIIISVTFNAYPARSFLVKDWSIRLKDDEHAKYILQKFATTLARPLDRESSVDAYLYYVNTQLMLGVTLFESMETTTGKCPLPETPESFIQVIGESDCTKTVDAVGLFDTEMYMSLMHGGHGGGKTSSFKRCVFLKDIEHINITNILLTAIDSRPSAMCYFHLLHGGWPVQEVASDVTAFGCRDWDFACVVTGVWPREDDDSATARATVRWVYDVVEALLPVSQGVYGADLGPDPRDAILATKAFGPNLRKLVKMKQIFEPHGVLTYACPLSKDMLSQKMVVLVTGEHGAGKDYCANVWAAAVKGHGYSTTVIGIGDVTKREYASQRGADSERLLGDRVYKEQHREALAAFFNQQLEHRPHLAEEHFVESVRSANVDVLFITGMREEAPVANLWHLVSDVRLVDIHVNASHKTRGLRRQIFTNGHSISRGSFNCTETLVSNYRPNFVFDNDIASDDQVKAFAKYSLFPFLGNDLRRLAGMVPSVPEFPRPGIKFRHVLEICQQKGGYKLCASLFKQHFADDWRKVDAIVSCGVGGHISAASLVLEVNVRSSLVHLTGKLPPPTISAEKSPSHVSSHVNGVKVEGIEMRADTLRKGARVVVIDDVLATGNTLLSMLELINRAGINMEDISVMVVAEFPIHRGRQRLRQGGFGRVGIQSLLVFDGE

SEQ ID NO: 13964 - protein, 574 aa, Zea mays
MATAARSLHLPGPTPPKSSTPSSHRLPVPCHLRPQRRRLAASSSDLTSFPEPPPAPNGVYVPWAAASSVAAAAASIVVDAATEAELRENGFRSTRRTKLVCTVGPATCAAAELEALAVGGMNVARVNMCHGDREWHREVIRAVRRLNDEKGFAVAVMMDTEGSEIHMGDLGGAPSAKAEDGEVWTFSVRSSDTSLPDRIIHVNYDGFAEDVKAGDELFADGGMARFEVIEKLGPDVKCRCTDPGLLLPRANLTIWRDGSVVRERNAMLPTISSKDWIDIDFGIAEGVDFIAVSFVKSAEVINHLKSYIAARSRGSDIGVIAKIESIDALKNLEEIIRASDGVMVARGDLGAQIPLEQVPSIQQRIVRMCRQLNKPVIVASQLLESMIEYPTPTRAEVADVSEAVRQRADALMLSGESAMGRYPEKALSVLRSVSLRIERWWREEKRQEALELQGVSSSFSDKISEEICNSAAKMANNLGVDAVFVYTKDGYMGSLLSRCRPDCPIFAFTSSTSVRRRLNLQWGLIPFRLSESDDMESNLNRTFSLLKARGMVQSGDLVIALSDMLQSIQVVNVP

SEQ ID NO: 13965 - protein, 175 aa, Zea mays
  misc_feature (106)..(106): Xaa can be any naturally occurring amino acid
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISXKGGKVGPNRCSACRKRVGLTGFNCRCGNLYCALHRYSDKHDCKFDYRTAARDAIAKANPVVKADKLDKI

SEQ ID NO: 13966 - protein, 1508 aa, Yarrowia lipolytica CLIB122
MDNGPIDPNRDVEQEHPVQVDHTEKHESSSSGAPLTQMSETSEDNTYTATPVPLTDVENMDPDSRDVNDLQRVLSNPESLHKLQSYTEQISRRMTQDERESLKNNEDTFDLARILDGFVQKSHEQGVHMRSAGVGWRNLTTDGIDQSTVFVPSVDELLRALATLPVQIAKAFKKKQTRHIIQNNNGVLKAGEMCLVLGRPGSGCSTFLKTITGQVGGYTGVEGDISYDGLSQKDMLEYFKSDIIYNGELDVHFPHLTVEETLNFAVGCRTPRQRLDGLTRDQYIKNYVQLLATVFGLRHTYNTKVGNDFVRGVSGGERKRVSIAEALATRASIFAWDNATRGLDASTALEYSQAIRATTNILNNASFVAIYQAGEHIYNLFDKVTVLYSGRQIYYGPADHAKDYFQRMGYECPPRQTTAEFLTAVTDPLGREPYPEMVGKVPTTADEFEKYWLASPEFRVVQAEYDDYVGSHNAEETFQNMQDSLSKDKMKRQRKKSPYLISFAMQMRLLTQRGFERLKGDMAYQTINVCANIIQALVIGSLFYNITESTAGAFSRGGVLFFTLLFNALASMAEISHSFSQRPIIVKQKSYSFYHPAGEALQALLTDIPGKLVTMICFTLIVYFLTHLNRTAGQFFAHLFILFVTTQCMTAFFQVLASATPSVEVANSLAGIGILIIVVYSGYMIPTPTMHVWFKWLNRANPVAYGFEALMANEFHNRVMTCEQIVPAGPDYSGMPESNKVCSFSGSTPGSLVVTGDNYIKNSYNYSFSHMWRNLGILFAFWMGFVFFNVTFSEYIQYHSSSGDVLLFKRGHIPEELQKEGADIDEVIADKAQADDSEKKMDRLLSLDEERDVFTWQNVDYVIPIAGGTRKLLDNVQGYVKPGTITALMGESGAGKTTLLNVLSQRINFGVITGDMLVNGRPLDRTFQRRTGYVQQQDLHLAESTVRESLIFSARLRQPSFVPDQEKIDYCDKIIKLLGMEAYAESLVGETGRGLNVEQRKKLSIGVELVAKPSLLLFLDEPTSGLDSQSAWAIVQFLKNLAAAGQAILCTIHQPSATLFEEFDRLLLLKKGGQTVYFGDIGKNSNTLVSYFERQGGRKCAPDENPAEYILECIGAGATATADGDWHDKWKNSEEYRQTTDEIAKLQQELAQRPQKELDPSLQRKYAAPYMTQLRWVLRRTQIQFWRSPGYIMAKFMLLIVGGLFIGFSFWDIKFTLSGMQNAIFAVFMITTLSVPLINQIQSFAFQSRELFEVRESSSNTFHWSCLLFSQFISELPYALIGGTIFYCCVYFPTKLGTSARVAGYFYFIYAILFNLYYLSFGLWILYFSPDVPSASIITSLMFSFVIAFCGVMQPASLMPGFWTFMYKLSPFTYIIQAYVGDVMHDRKITCLPREFSRFNPPSGQTCQEYAGKFLSQATGYLEDPNATTQCGYCPYSVADEFIATVGIKYHYRWRNVGFICAYIIFNICAMVLCYYLARVRVWRTGAAIADWKAKRANKKKAASSEKA

SEQ ID NO: 13967 - protein, 222 aa, Hordeum vulgare
MAGEKGLVLLDFWVSPFGQRVRIALAEKGLPYEYVEEDLIAGKSDRLFRSNPVHKKIPVLLHDGRPVNESLIILNYLDDAFPDAPALLPSDPYARAQARFWADYVDKKVYDCGTRLWKVKGEPQAQARAEMLEVLKTLDGALGDKPFFGGDKFGFVDAAFAPFTAWFHSYERYGEFSLAEVAPKIAAWAKRCGERESVAKSLYSPEKVYDFIGLLKKRYGIE

SEQ ID NO: 13968 - protein, 365 aa, Nocardioides sp. JS614
MQQVKAVIARGKGQPVEVTTINVPDPGPGEALVQVQACGVCHTDLHYREGGINDDFPFLLGHEAAGVVEAVGPDVTAIAPGDFVILNWRAVCGECRACERGEPWYCFATHNATQRMTLAEGPDAGTELAPALGIGAFAEKTLVAAGQCTKVDPSARPAAVGLLGCGVMAGIGAAINTGAVTRGKSVAVIGCGGVGVAAIAGSALAGASPIIAVDIDAQKLEAARRMGATHVVDSSRTDPVAAIQELTGGFGADVVIEAVGRPETWKQAFYARDLAGTVVLVGVPTPEMKVPDLPLIDVFGRGGSLKSSWYGDCLPSRDFPMLVDLYQQGRLDLDAFVSEEIGIGDVEAAFERMHEGGVLRSVVIL

SEQ ID NO: 13969 - protein, 188 aa, Erythrobacter sp. NAP1
MGIIGSTIKPFTATAFKAGEDFYEVSEKDLEGKWSVFFFYPADWTFVCPTELEDLGEKYEMLQSMGVEVFAVSTDTHFSHKAWHDTSEKIGKLKFPFLGDQMHVLSNNFGVLREGVGLADRATFVVDPDGVIQIMEITCEGVGRNANELTRKIKAAQYVRDNPGQVCPAAWEEGSETLAPSLDLVGKI

SEQ ID NO: 13970 - protein, 157 aa, Zea mays
MDREHESDEPNLPSVRPSAKCHYAIYRVTQRTFSPLVLQHSPYHTEPTRGARGSYSSLAHTTTHHRHRATELPRVCCALLIDRPIDLGMADWGPVLIGLVLFILLSPGLLFQIPGKGRIIEFGNFQTSGLSILIHAVIYFALLAIFLLAVGVHIYLG

SEQ ID NO: 13971 - protein, 784 aa, Bacillus thuringiensis serovar konkukian str. 97-27
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSKGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGAKIGAGAVIEPYSIIGKNSIVSSYSHLQKSIVFANAHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQVENEKEVIIKLYGQDGAQLTYKQQKAIEQVYMSESFYYVCEKEMGRNKLVHVSLHDYIEAVLERIDIEKIQKQKFHLLINKRNDMLQHLLMLFLQRLGCTVTWIYAGEQKDHVKALMKSSKANMALMFSEQGNYFELYDNHSNIYQGTDFEEVDIPDLLLESAGNIYPMSLKLGECYLLFYTQDEKKSFQARWKRDILYRIGKLFELIALQGKTFLSIVEQSPPLYLLCDEVVCPWNEKGKVMRKLLADMERKEEGIFEGVQFKYTEKEWSYIVSDTKQPKFLVYSHARNPVIARENMKNLIEKIRQYQKV

SEQ ID NO: 13972 - protein, 340 aa, Burkholderia vietnamiensis G4
MTAKGTILVTGGAGYIGSHTAVELLDNGYDVVIVDNLVNSKVEAVRRIERITGKTPAFHQVDVCDEAALAKVFDAHPITGTIHFAALKAVGESVAKPLEYYQNNLGGLLAVLKVMRERNVRQFVFSSSATVYGVPERSPIDESFPLSATNPYGQSKLIAEQILRDLEVSDPSWRIATLRYFNPVGAHSSGLIGEDPAGIPNNLMPYVAQVAVGKLEKLRVFGSDYPTPDGTGVRDYIHVVDLAKGHIAALDALATRDASFVVNLGTGQGYSVLEVVRAFEKASGRPVPYELVARRPGDIAECYANPQAAADIIGWRATLGIEEMCVDHWKWQEGNPRGFV

SEQ ID NO: 13973 - protein, 285 aa, Escherichia coli O157:H7 EDL933
MFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLRRLADPLEVGELAAFLASDESSYLTGTQNVIDGGSTLPETVSVGI

SEQ ID NO: 13974 - protein, 148 aa, Ralstonia eutropha JMP134
MKVSDILQIKGNTLYTVTPDTALLVAVHTMAEHDIGSLVVMEYGDLVGMLTFREIIETLAKNGGSVGTTSIRKVMDDAPLTCTMETDVNEVRRMMLERHTRYLPILDNRTLMGVISFYDVAKAVVEDQSFENKMLKAYIRDWPEERAD

SEQ ID NO: 13975 - protein, 391 aa, Enterococcus faecalis V583
MLFSIKKSEWLGNERNDLFAGLVSSVAILPEVIGFAIIAGVHPLSAVFASAVTLLVITFTGGRPAMVSASAGSMALVLAGLIQAHGLSYMLAATILTGFLQFILGYLGIHKLMRFIPKTVMYGFVNALAILIFMAQVQQLPHQTLWSYGMIICSILLIYLLPKFITIVPPALIVILFMTILSYFLKGHLQTVGDLGEMSQFHPAIRWPNVPVNLETLWIILPSSVALAMVGLIESLLTIPIVDKMTASQSDSQREVKAQGFANIITGFFGGQAGCAMIGQAVINVKSGGRKRLSTLISGITLLLFIFVFKSVMVAIPTAALIGIMMTVAVDTFDWESLQLFRTFEITEIVILLVTVGVIVYTHNLAIGIILGVLLSGLLYHFFKKEPKKSC

SEQ ID NO: 13976 - protein, 337 aa, Solibacter usitatus Ellin6076
MSEHPTPDSILQVGLGFWPSKVLLSAVEMELFTDLAKGPQSLETIQGRMGLHARAARDFLDTLVALGFLQRADGQYSNTAATDLFLDKHKPSYIGGILEMANQRLYGFWGHLTEALRTGQPQNEVRNGGSALFESLYADPARLKSFLAAMSGISHGANMKIASQFPWSGYTSFVDAGTAQGDLAVQIALANPHLSGIGFDLAEVGPIFEEYAERNGVSGRLRFHGGSFLEQPIPHADVVLMGHILHDWGLPEKRMLIRKAYDAVPDGGALVVYESIIDDDRSKNAFGLMMSLNMLIETRAGFDYTGADCQGWMKEAGFRETRVEHLLGPDSMVIGIR

SEQ ID NO: 13977 - protein, 264 aa, Brassica napus
  misc_feature (249)..(249): Xaa can be any naturally occurring amino acid
EEEERWLRVCSPPSSFFYLRPLHLLTSSPKLQFSPSLRRESRLIPSRSSSSFRRMESSPASSSSQTPVTASETDSLAKDLQNQNLGASVDEGGAKIKRKLEDFNWDHSFVKELPGDPRSDVTSREVLHACYSKVSPSVPVDDPQLVAWSDSVAELLELDPKEFERPDFPLLLSGAKPLPGAMPYAQCYGGHQFGMWAGQLGDGRAITLGEVLNSKGERWELQLKGAGKTPYSRFADGLAVLRSSIREFXCSEAMHFLGIPTTRA

SEQ ID NO: 13978 - protein, 365 aa, Bacillus cereus ATCC 14579
MKRQLILEDGTVLIGTGFGGEIEKSGEVVFTTGMTGYQETLSDPSYCGQIVTFTYPLIGNYGINRDDFESIHPSVNGLIVNEICNHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKNLATGKVAITSQNHGYAVEEESVENTDLEITHVALNDGTVEGLRHKKFPAFTVQYHPEASAGPEDANDLFEDFLTMIENFKKEGEELCQNA

SEQ ID NO: 13979 - protein, 376 aa, Helicobacter pylori
MGSSHHHHHHSSGLVPRGSHMASASYPPIKNTKVGLALSSHPLASEIGQKVLEEGGNAIDAAVAIGFALAVVHPAAGNIGGGGFAVIHLANGENVALDFREKAPLKATKNMFLDKQGNVVPKLSEDGYLAAGVPGTVAGMEAMLKKYGTKKLSQLIDPAIKLAENGYAISQRQAETLKEARERFLKYSSSKKYFFKKGHLDYQEGDLFVQKDLAKTLNQIKTLGAKGFYQGQVAELIEKDMKKNGGIITKEDLASYNVKWRKPVVGSYRGYKIISMSPPSSGGTHLIQILNVMENADLSALGYGASKNIHIAAEAMRQAYADRSVYMGDADFVSVPVDKLINKAYAKKIFDTIQPDTVTPSSQIKPGMGQLHEGSN

SEQ ID NO: 13980 - protein, 188 aa, Helicobacter pylori
TTHYSVADRWGNAVSVTYTINASYGSAASIDGAGFLLNNEMDDFSIKPGNPNLYGLVGGDANAIEANKRPLSSMSPTIVLKNNKVFLVVGSPGGSRIITTVLQVISNVIDYNMNISEAVSAPRFHMQWLPDELRIEKFGMPADVKDNLTKMGYQIVTKPVMGDVNAIQVLPKTKGSVFYGSTDPRKEF

SEQ ID NO: 13981 - protein, 478 aa, Aspergillus oryzae
ATPADWRSQSIYFLLTDRFARTDGSTTATCNTADQKYCGGTWQGIIDKLDYIQGMGFTAIWITPVTAQLPQDCAYGDAYTGYWQTDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGLPIIYAGQEQHYAGGNDPANREATWLSGYPTDSELYKLIASANAIRNYAISKDTGFVTYKNPYIKDDTTIAMRKGTDGSQIVTILSNKGASGDSYTLSLSGASYTAGQQLTEVIGCTTVTVGSDGNVPVPMAGGLPRVLYPTEKLAGSKICSDSS

SEQ ID NO: 13982 - protein, 422 aa, Shewanella sp. MR-7
MNSHSGTIGRWQGAGLMATTLLGTGVFILPQMTIDKAQAGALIAWSLLTLAIIPVALIFGRLASVFPHAAGPAYFVEKAFGRTAGRTIGLIFLLVVPMGAPAAILMTFQFVNALIPLDGWSKVGAEVLVIFGLFLLNLRGIQVSAKLQFGLTLCIVAIVVLLFGASSVQPGHLTSLASYGTPEIPTIMIAAGIAFWSFLGIEAMTHLADDFRRPQQDMIPAMMMGTVLVGIIYVACTLILLLVPTDKSVAMIGVFDTLLGGYGAQVIGVLGIASGLATVNVYAASAARLIWSFSNEGILPRCFAVKNRHGVPIRALAALLGVMASVIVLTHTTGQELEHLIAWSNGVFVVIYLMAMLAAAKLLPRSNLPLVVLGCGFCLALGIALGASMAYVLVLILFVAPFLWWQKTHISRKQSLAVNKAS

SEQ ID NO: 13983 - protein, 318 aa, Shewanella oneidensis MR-1
MTCPIILDCDPGHDDAIALILALAHPDLVPLAVTTSAGNQTPDKTLNNALRILTLLNRSDIPVAGGAAKPLARDLIIADNVHGETGLDGPALPNPSFSPQAITAVELMAQQIRKSHQPVTLIPTGPLTNIALLLASHSELHDKIERIVLMGGAAGVGNWTPAAEFNIFVDPEAADIVFKSGIPITMCGLDVTHQAQIMDEDIERIRAIPNPVAKCVAELLDFFMIYHRDPKWGFVGAPLHDPCTIAWLLKPELFDAQDCWVGIETQSELTLGMTVVDRYQLTGKPANATVLFGLNRQGFVDLLVHSLAAYTPTYLNRR

SEQ ID NO: 13984 - protein, 370 aa, Legionella pneumophila str. Paris
MNIFNLPDLGEGLPDAEIHEWFVKEGDTVKADQPLVSMETAKAVVDVPCPQSGTIAKLYGKPGDVIKTGEPLVAFVSTTEKPADKGTVVGNLEESTDVSEDNFIIGSQRSSHRVKTTPAVRMLAKKLGVDLSSLKGSGDNGVITREDVQNQANINSQPPAGFEPLRGVRRAMLNSMVQSHAEIVPVSIFDEADIHIWKPNTDITVRLIRAIIHASKKEPALNAWFDTKHAARRCFKEVHLGIAMDNEEGLFVPVIHDAEKYSDSELRKIIDEFKESVRNRAVSADKLKGATITLSNFGKFSGRFASPIIVPPMVAILAVGRLYKAPVINDEDKIEAHKMLPLSLSFDHRAITGGEATRFLGAVIESLQQA

SEQ ID NO: 13985 - protein, 714 aa, Legionella pneumophila str. Paris
MIKKIHRWLPLLVLIGLSVLFFSLHLDKYLSFNALRENHALLIAWTQTHYFIAPLIFIVFYTAAVAISIPGAVLFTLTGGFLFGVFWGVLFVVISATLGATILFFAVRTALGDWFAKKASGWIERMRRGFQHNAFSYLVTLRLIPLFPFWVVNIVPALLNIRAKIFITATFLGIIPGTTVYVMVGNGLSQIFAANQTPNLGIIFEPQILGPLLALAVLSLMPVLYQFSTRKHQNHHSFSDIGRVINCDLAIIGGGAGGLSLASGCSQLGLKVVLVESGEMGGDCLNYGCIPSKSLLAAAKTFYYAKHATHFGVQTEAIKINFQKVMQHVHQIIDNISEHDSVQRFESLGVQVIKQVGKFLNPDTLQAGDSIIKAKRFVIATGSSPFIPPIRGLEAISYFTNETIFDLKEQPEHLIVIGGGPIGCELAQAFAMLGSKVTLLEGLNLLPKDDPDCVAVLRTQMKSMNILIYEQIEITQINSHPDTGISVCFEFQNTQFTITASHLLIATGRRANVKPLDLEKAGVKLTSKGVEVNKYLQTSNKKIYALGDVTGLYQFTHMASYQAGIVLRNIVFKLPSKVDYRAIPWVTYTDPELAHVGIGVSDALKHPDTQIIEWPFVDNDRAQTEHTLNGKIKIITDKKARILGVTIVGPHAGELILPWVMAIREKKTLRSFTDVIVPYPTLSEISKRVAGSFYAPKLFSNKTRMLVRWLQKIG

SEQ ID NO: 13986 - protein, 158 aa, Rhodococcus sp. RHA1
MRVGIGTDVHPIEQGRPCWMAGLLFEDENGCAGHSDGDVAVHALCDALLSAAGLGDLGSVFGTGRPEWSGVSGAAMLAEVRRLLEEDDFDVANAAVQVIGNRPKIGPRRNEAQKVLSDILGAPVSVSATTTDGLGLTGRGEGIAAMATALVIPGRSAR

SEQ ID NO: 13987 - protein, 238 aa, Zea mays
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGETHTNSKCT

SEQ ID NO: 13988 - protein, 310 aa, Glycine max
MPPAGELQHQSPSKDKQPTDTQSAEAAAAAIAAAAADAEAAGLWTQIKAEARRDAEAEPALASYLYSTILSHSSLERSISFHLGNKLCSSTLLSTLLYDLFLNTFTSDPSLRNATVADLRAARVRDPACISFSHCLLNYKGFLAIQAHRISHKLWTQTRKPLALALNSRISEVFAVDIHPAAKIGKGILLDHATGVVIGETAVIGNNVSILHHVTLGGTGKACGDRHPKIGDGCLIGAGATILGNVKIGCGAKVGAGSVVLIDIPPRATAVGNPARLVGGKEKPTIHDEECPGESMDHTSFISEWSDYII

SEQ ID NO: 13989 - protein, 429 aa, marine gamma proteobacterium HTCC2080
MSEIVDVRAFEVLDSRGNPTVMAEVTLDNDVVGVACAPSGASTGSREALELRDNDPKRYLGKGVLNAVGNINGPIRELLLGYDACDQRGVDQRMIEADGTENKGEFGANAILAVSLATAKVASAARGIPLYEHIANLSGNEQMTMPVPMMNILNGGEHADNNVDIQEFMIQPVSAGTFSDALRMGAEIFHHLKKVLSARGLATAVGDEGGFAPNLPSNAAALDIIAEAVEVAGYKLDSDITLALDCAASEFYKDGLYDLKGEGRKFNSSEFADYLGDLCSQHPIISIEDGLDESDWEGWATLTQKLGDRIQLVGDDLFVTNTKILERGIRENIGNSILIKFNQIGSLSETLDAIAMARSAGYTAVISHRSGETEDATIADLAVGTGAGQIKTGSLCRSDRVAKYNRLLRIEAALGLTAPYRGRDEFSRS

SEQ ID NO: 13990 - protein, 259 aa, Burkholderia thailandensis E264
MNAPPPLKVFITGASSGLGLALAAEYARRGATLGLVARRADALAEFAQRFPKATISIHPADVRDADALALAASRFVAAHGCPDVVIANAGISKGAITGEGDLDAFREIMDVNYYGMIATFEPFIAPMTAARRGTLVGIASVAGVRGLPGSGAYSASKAAAIKYLEALRVELRPAQVAVVTIAPGYIRTPMTEHNPYPMPFLMDADRFAKRAALAISQKAAFRVIPWQMGVVAKLLHVMPRWLYDRLFEKAPRKPRAKAG

SEQ ID NO: 13991 - protein, 255 aa, Xylella fastidiosa 9a5c
MNPTYDFKGQVALVTGAAAGMGLATARGFAQGGASVVLADRDGERAAQEAAAIVAEGGTAIGLACDVSDEAQVAALVEKTVAEYGRLDFAFNNAGVMAKIAPFAEATSEEFDRVIGINLRGVWLCMKYELQQMQRQGSGVIVNNASVGALTGNVGIGAYIASKHGVLGLTRAAALEYCKKGIRVNAVNPGTIDTQIARDVVGGSDEAFAKLGASAPIGRAGRPEEIASAVLWLCSPGGSYVIGEGLTVDGGYVVP

SEQ ID NO: 13992 - protein, 369 aa, Bdellovibrio bacteriovorus HD100
MKIKAAVAWKAGAPLSIEEVDLEGPKKGEVLIRVVATGVCHTDAFTLSGADPEGLFPVILGHEGGGIVEEVGEGVTTLKKGDHVIPLYTPECKECKFCLSGKTNLCVRIRATQGKGLMPDGTSRFSKDGKMIHHYMGCSTFAEYTVVPEIALAKVNPAAPLDKVCLLGCGVTTGIGAVLNTAKVEKGATVAVFGLGGIGLSVIQGAKMAGASRIIAIDINDAKWEMAQKFGATDFVNPKKHDKPIQQVIVEMTEWGVDYSFECVGNTQLMRAALECAHRGWGQSIVIGVAGAGQEISTRPFQLVTGRVWKGSAFGGVKGRTELPGYVEQYMSGEINIDDMVTFTMPLEDINKAFDYMHEGKSIRSVIKM

SEQ ID NO: 13993 - protein, 163 aa, marine gamma proteobacterium HTCC2080
MMRIGHGFDVHAFGPGDHVILGGEKIAHSSGLIAHSDGDVVLHALCDALLGAAGLGDIGAHFPDTDATYADVDSRVLLRRVVALLDAHQWQVVNADITIIAQRPKIAPHTDAMRGHIASDIGVTHLAVNVKATTTESLGYIGREEGIACHAVALLIARAGTEV

SEQ ID NO: 13994 - protein, 353 aa, Xylella fastidiosa 9a5c
MRGYVLEAKGTAKWKDVPMPVLGPNDALVRPTAVATCTTDVHMIATAALPKTVGKVIGHEAVGVVEKVGENVKAFRPGDRVVLPCGNSDWRHPRAQRGEAKYYQTNSPYYSDDPSIGGVFSEYVRTLDADLNLARIPDKVSDLQAVMLPDMAATGFTGVERLGIQFGETVLVMGLGPVGLMAVAGAALRGAGRIIGVDSRPNTVELARAYGVTDIVDFTGGQTLEKVMALTAGQPVDSVLIASGGTASEVFTTALKAVKFGGRVACVSGFLHDESVTIPLEVWNYGFMEKFLTGVHVQDGRDWIERLLAMLECGRFDTRPLVSHVLHGWDSLEQGIELMRSRDPAVIKPVIVI

SEQ ID NO: 13995 - protein, 513 aa, Bacillus licheniformis ATCC 14580
MTKLVNEMILVLDFGSQYNQLITRRIREFGVYSELHPHTLTAEEIKKMNPKGIILSGGPNSVYDEGSFRCDEKIFELDIPVLGICYGMQLMTHYLGGKVEAASQREYGKANIHIEGEPDLFKDLPNEQVVWMSHGDLVVEVPEGFTVDATSHHCPNSAMSKKDKKWYGVQFHPEVRHSEYGNDLLKNFVFGVCECVGEWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDEAEKLKGIDFLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIAKADLEKDIWQYFTVLPDIRSVGVMGDARTYDYTIGIRAVTSIDGMTSDWARIPWDVLEKISTRIVNEVKHINRVVYDITSKPPATIEWE

SEQ ID NO: 13996 - protein, 788 aa, Saccharomyces cerevisiae
MAGHSHRSSLKNGHKSYKSKHASKGALKRLYKGKVEKEPVGTGKPDKQVSKLQRKNKAKQLRAQRILDSIENRKLFEGKNGAAKIITIVPLVNDLDPLDILYKLLKCADDEGIMVQEVDSKRIFNVHIKKFKSNLKIIIPDMTNFLNILDCAKVADFVVFGLSGVQEVDEEFGEQIIRALELQGIASYIGVISNLSAVHEKEKFQLDVKQSLESYFKHFFPSEERVYNLEKNSDALNVLRTLCQRLPRSINWRDNRGYVVADFVDFVETSPDSGDLVIEGTVRGIGFNANRLVHIPDFGDFQLNKIEKISESSQKRKIIKEKATDSLSLELDLQTVFESNMNRDTLDEYAPEGTEDWSDYDEDFEYDGLTTARYDDHGFLPGREQTSKKAAVPKGTSDYQAKWYLDDVIDANEEEEAEQTNGKDETMMEIDDEMMVEQDNEEVAGDEEYDIEDNEGFEELSPEEEERQLREFRDMEKEDREFPDEIELEPSESAIERLKRYRGLKNLYNCDWQVDEKDPSSPAEWKRLLRIGNYKNTKNRIIKETKNEAQAIAGDRIRMFIRFPKFLLEKIQDPKQLLFAVYGLLLHEHKNAVVNFSLQRWEQYDKPVPSQEPIVVQYGVRRYTIQPLFSQGSNSPNNVHKYERFLHPDTVSVATCIAPVDFTQSPAIFFKPSPTDAKNIELIGHGTFLNADHSRILAKRAILTGHPFRFHKTVVTVRYMFFRPEDVEWFKSIPLFTKSGRSGFIKESLGTHGYFKATFDGKLSAQDVVAMSLYKRMWPMPSLPWNGM

SEQ ID NO: 13997 - protein, 280 aa, Oryza sativa
VGDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 13998 - protein, 478 aa, Bradyrhizobium sp. ORS278
MRRLRRIKILATLGPASSDSAMIRKLFEAGADIFRINMSHTPHDKLRELVATIRSVEASYGRPIGILVDLQGPKLRLGTFAEGPVQLNNGQSFVLDSDKTPGDATRVYLPHPEILAALQPGHALLLDDGKVRLIAEETTPTRAVTRVVIGGKMSDRKGVSLPDTDLPVSAMTPKDRADLEAALNIGIDWIALSFVQRADDVLEAKKIIRGRAAVMSKIEKPQAIERLNDIVDVSDALMVARGDLGVELPLERVPGLQKQMTRLARRAGKPVVVATQMLESMIQSPVPTRAEVSDVATAVYEGADAIMLSAESAAGKFPVEAVSTMNRIGEEVERDIVYRSVIAAQRPEPESTAGDAIAEAARRIAENLDLPAIICWTSSGSTAVRVARERPKPPVVAITPNLATGRRLAVVWGVHCVVAEDARDQDDMVERAGSIAFRDGFVRAGQRVIVVAGVPLGTPGTTNMVRIAYVGPSNEAHL

SEQ ID NO: 13999 - protein, 443 aa, Arabidopsis thaliana
  misc_feature (218)..(218): Xaa can be any naturally occurring amino acid
RLSEEHLHHRLVFLHFIKFNTEDSMSSFNGDSMDDFKGLRITQLDDDDDDETAVEPINMDEFDDDDEEDDEDYEPVMLGFVESPKFAWSNLRQLFPNLAGGVPAWLDPVNLPSGKSILCDLCEEPMQFVLQLYAPLTDKESAFHRTLFLFMCPSMSCLLRDQHEQWKRAPEKAMRSTKVFRCQLPRANPFYSSEAPKHDGTDKPLGHGAPLCTWCGTXWKGDKLCSGCKNARYCSPKHQALHWRLGHKTECQQLRTVSETSDSGPVNNGVAPTEKQKVASKSLWKEFVLINEDESEYDTEMSGDDEVAKPLVSKREVDDQMKSLMNDFEGDADKKNWVNFQQRVDKAPEQVLRYSRSSGAKPLWPIASGRVSKSELPSCKSCGGPRCFEFQVMPQLLFFFGGKNERESLDWATIVVYTCENSCDSSLSYKEEFVWVQLYSQTT

SEQ ID NO: 14000 - protein, 621 aa, Magnaporthe grisea 70-15
MYNKTELFLFESPLNAHESPIPQAHRAMTRHTPDFLRARASNLSLRAASLANSVSSSVAAATAAAATSPMTTPTSTATDVVSMDSPVDQPSPEMRYYIAGDVGREAQRRGLQICINCMVQLPYAVHKVVTKDECAICSVGEARPEAFTKPFTDFLTENPTIFHAVDYFKGKLGAAGYTELSSRADWTGKIRPGGKYYVTRNASSLVAFAVGKAYKPGNGVAMIAGHIDALTAKLKPVSSKPNRAGYLQLGVALYAGALNETWWDRDLSIGGRVIVRDPSTGKTSTKLVKVDWPIARVPTLAPHFGVGMMGTNNKETQAVPIIGLDNSDLFSASSASVTSEDVKPYLGGGPAGSFAASQPPKLVKLITSQLGLKSSAEIVNWELELFDLQPATVGGLDKEFIFAGRIDDKLCSWAALQGLLCASDDDKSGQIKLVALFDDEEIGSLLKQGAKSNLLPIVIERAVEALTEASDGKTTFGPGVVGRTYANSFLVSADVTHAVHPNFMDKYLSGHAPRLNVGVAVCADSNGHMTTDPVSTAILDRVAQLSGCVNQTFMIRNDSRSGGTVGPSLSSAMGVRSADAGLPQLSMHSVRATTGALDPGLGVKFFRAFLDKFEEVDAEWQ

SEQ ID NO: 14001 - protein, 361 aa, Saccharomyces cerevisiae
MKGLILVGGYGTRLRPLTLTVPKPLVEFGNRPMILHQIEALANAGVTDIVLAVNYRPEVMVETLKKYEKEYGVNITFSVETEPLGTAGPLKLAEDVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIEKETFPILVEEKQLYSFDLEGFWMDVGQPKDFLSGTVLYLNSLAKRQPKKLATGANIVGNALIDPTAKISSTAKIGPDVVIGPNVTIGDGVRITRSVVLCNSTIKNHSLVKSTIVGWNSTVGQWCRLEGVTVLGDDVEVKDEIYINGGKVLPHKSISDNVPKEAIIM

SEQ ID NO: 14002 - protein, 463 aa, Enterococcus faecalis V583
MSIFRKKEITVPVNDSGGMKKNLKTMDLIFLGIGAVVGTGIFVVTGVAAERYAGPGLVLSFLVAAAAIILSGLCYAEFASRIPVIGGPYAYMYVVFGEIVAWMTGWMIICEFFLAVSSVASGWSGYVHGFLDSLGFSLPQALSGAYNPTNGTYIDLIAMLVVVAVTFWVSLEAKTALRLNNLMVFVKFGIILLFVLVGIFYVKPTNWQPFIPYGFSGVFSGAALVFFAFLGFDAVSMAAEEVKNPKKDIPKGIIGSIIISTLLYIVVTLVLTGIVPFTDLGVKDPVAFAMRFINHGAIATIISVGAILTLLTVTIAMMYSLARVIYAISKDGLLPQFMSKIDEKRHTPKNATYVAGFLAMVFAGIVPMEMLAELTNIVTLFYLMFLALGIIKLRTMKGEPQAGEFKVPLVPVLPLISIVVCAALMFQLSLATWQVFGVAVVIGLAIYFFYGRHHSIVRFETKE

SEQ ID NO: 14003 - protein, 254 aa, Streptococcus agalactiae NEM316
MDAKFDFAKLLVYKAGQFIKSEMQNTFDVEEKSRFDDLVTSLDKKTQKLLIQEIIQHYPDDNILAEEDDVRSPIAQGNVWVLDPIDGTVNFIVQKDNFAVMLAYYEEGVGQFGIIYDVMADILYSGGGHFDVYANDKKIVPFQECPLERCLLGVNSAMYAENDCGIAHLASETLGVRIYGGAGISMAKVMQGKLLAYFSYIQPWDYAAAKIMGETLGFTLLTLDGEEPNYSTRQKVMFLPKSKLNLIQSYLTKK

SEQ ID NO: 14004 - protein, 175 aa, Lentisphaera araneosa HTCC2155
MSNIREYQGIKPQLGKDVLVDETAVVIGDVAIGDHASIWPTTVIRGDVNSIRIGTGTNIQDASVLHVTHKNAANPEGYPLIIGDNVTVGHRVTLHGCHVGDYCFIGMGAIIMDGAILQERVMVGAGALVTQNAQLESGYLYLGSPAKKARPLNEEELQWLEKSADNYIRFKNTYL

SEQ ID NO: 14005 - protein, 169 aa, Pseudomonas syringae pv. syringae
MTLQYQTIADCVGNTPLVRLQRMAGNTSNTLLLKLEGNNPAGSVKDRPALSMITRAELRGQIHPGDTLIEATSGNTGIALAMAAAIKGYRMILIMPDNSSAERKAAMTAYGAELISVSKDDGMEGARDLAERMQAEGRGKVLDQFANGDNPEAHYTSTGPEIWRQTGGT

SEQ ID NO: 14006 - protein, 505 aa, Rhodococcus sp. RHA1
MTHSDGAAQTRTITHWFDNKSFTGTSGNTAAVTNPATGAVTGQVALASVEDARAVIDAAAAAFPAWRDTSLAKRTQVIFTFRELLNARKGELAEIITAEHGKVVSDALGEVSRGQEVVEFACGIAHLLKGGMTENASTNIDVSSLRQPVGPVGIISPFNFPAMVPMWFFPIAIATGNTVVLKPSEKDPTAAIWMAELWAEAGLPAGVFNVLQGDKTAVDELLTNPAIKAISFVGSTPIAQYVYATGTAHGKRVQALGGAKNHAIVLPDADLDLAADAMVNAGFGSAGERCMAISALVAVGDIADELVAKIKDRTDTLKIGDGTRDSDMGPLVTKVHRDKVASYIDAGENDGATIVVDGRTVQANGGKDGFWLGPTLIDHVTTDMSVYTDEIFGPVLSVIRVGSYDDALELVNSSPFGNGTAIFTNDGGAARRFQNEVEVGMVGINVPIPVPMAYYSFGGWKNSLFGDTHAHGTEGVHFFTRGKVVTTRWLDPSHGGLNLGFPQNN

SEQ ID NO: 14007 - protein, 462 aa, Rhodococcus sp. RHA1
MTTTVSQELLPTGQSLDAARVEGERAYALDRAHVFHSWSAQEQITPMTILASEGSYVWDGAGNRMLDFSSQLVNTNIGHQHPKVVAAIQDQAAKLCTIAPQYANDARSEAARLIAERTPGDLNKVFFTNGGADANEHAVRMARLHTGRYKVLSRYRSYHGGTDTAINLTGDPRRWPNDYGNSGVVHFHGPFLYRSQFHSENEQQETERALEHLDQLIRLEGPNSIAAIVLESVPGTAGIMVPPPGHMAGVREICDRYGIVFIADEVMSGFGRTGKWFAIDHVGVVPDLITFAKGVNSGYVPLGGVAISEKIAATFADRPYPGGLTYSGHPLATAAAVATINAMEDERIVENAARIGSEILGPGLRGLADRHPSIGEVRGLGVFWAIELVADRATKEPLAPYGASSPAMNEVIAACKAGGLLPFANFNRIHAVPPCTVTEAEAREGLAILDTVLDIADAHRNS

SEQ ID NO: 14008 - protein, 291 aa, Lentisphaera araneosa HTCC2155
MEKTIEKAALLMEALPYIQEFRDEIVVVKFGGSAMEKPEIIEAVLRDVVLMECIGMRPVIVHGGGKAISAKLETMGLEVKRTGGMRHTCEVTIDVVDDVLHNEVNSHLLELLAKHKAKAQRVSGKDILMAEKLFVKDPETGEDVDVGFVGNVSNVDAEYIHEIIEAGVIPVIAPLAKDKKGHVYNINADIAAAKIAESIQARKLVYLSDVPGLLSDPKDESTLIHTIKVHEVEEYIADGTISGGMLPKILSAVEALKVGTKKVHMIDGRMQHSLLLEIFTDSGVGTEILAD

SEQ ID NO: 14009 - protein, 564 aa, Solibacter usitatus Ellin6076
MTAVPETPLDHWMPKLVLCLRQYTWQIFVKDLIAGLTVGLVALPLAMAFGIASGVTPQAGIYTAVVAGFIISALGGSRVQIGGPTGAFVVIVSGIVLKFGISGLLMVTAMAGVLLLVMGATGLGTAVRFIPRPVTIGFTNGIAVLIASTQIRDFLGLKIAAVPSEFLLRMEKLGAHLNTIDPVTAVVGGVSLGIILLWPLVTKRVPGSIVALLAGTALAIVLKLPVETIGSKFGGIPTGLPTFHIPQFRADLILPLLPSAMTVALLAAVESLLSAVVADGMSGDKHNSNVELIAQGIANVISPMVGGLPATGAIARTATNIRSGAKTPVSGMIHALTLLMILLVAAPLAKFIPLATLAAVLFVVAYNMGEWREIVGILRLGRAERVVWVATFGLTVVADLTVAVEVGMTLAALLYIYRVSQTTTIAPVTDAYIEKGRPHVLQGKDIPQFVTILRIHGPFLFGTTEKLADATEDLSHYGHVVILRVRNMTAIDATGLYALEKLAERLHTTGRHVLVCGARRQPRTMLERADFVSVIGQENILPHVDAALARARILHHFAENQRSA

SEQ ID NO: 14010 - protein, 521 aa, Oryza sativa Japonica Group
MPSAHPLPASSQATTAWATRTLTSTRSVGRTPTLSTPHAPGPYTSSTNAEAIATQPYPLTDKWATNLHPGPITSHRIATSALHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 14011 - protein, 476 aa, Burkholderia thailandensis E264
MTYRNEGIAYVEPLHAQAHAHAHRTSAEYRALDAAHHIHPFSDMGSLNRAGSRVIVKAEGVHLWDSDGNKIIDGMAGLWCVNVGYGREELIAAGSRQLRELPFYNTFFKTTHPPVIELSALLAEIAPPAFNRFFYCNSGSEGNDTVLRIAHQYWRTQNRPQKKFVISRRNGYHGSTIAGATLGGMGYMHEQMPSKVEHIVHIDQPYYFGEASEGQTPEAFGLERARQLEAKILELGAQNVAAFIGEPFQGAGGVIFPPSTYWPEIERICRQYDVLLVADEVIGGFGRTGEWFAHQHFGFEPDLMTLAKGLTSGYVPMGAVALSDRIADALIAHGEFNHGMTYSGHPVAAAVAVANLKVLRDEKIVERVKTDTGPYFQQLLRETFANHPIVGDIAGAGLVAGIQLAREPGARKRFENGGEVGTICRDYCFNGNLIMRATGDRMLLSPPLVISRPEIDEIVEKAKRAIDATAQQLGLV

SEQ ID NO: 14012 - protein, 229 aa, Triticum aestivum
MTVVDAETRFHVLAVDDSVIDRKLIEMLLRTSSYQVTTVDSGSKALEVLGLRDEGDDSSSSSPTSSSAPAHHQEVGVNLIITDYCMPGMTGYDLLRRVKGSSSLKDIPVVIMSSENVPARISRCLEDGAEEFFLKPVKLADMKKLKSHLVRRKQPQLQPPQPQEKPQQQQKAELAPTELVEEVAAEVTATGITSDCGGGSRKRKAAMMEQDGTTNASLSGGSGGLAVET

SEQ ID NO: 14013 - protein, 590 aa, Zymomonas mobilis
MNSSLFSDSLVILGAAGLIIPAFARFRISPVIGFILAGAVLGPKALGSLVTEYPWLKHITISDPDGIEPFADFGIVLMLFSIGIELSFKRLWAMRQAVFGLGTGKLLGCGFLIGAGLYALGENWAGAIGMGTGSQRIVNRFGAASSGNNGTCRKKPFAILLFEDLALVPIIFALVPWHLMGKIIAGTDLIATIWQGGATVIAILVLGRFALPTLFAQAARTKSAEVFLSISLLVVILASVATSAMGLSPIVGALTAGLLIAETDYHVEVEMVILPFQRLALGVFLLTVGMSLDLRLIMANWQALALGVAGVVLVKTLVTSTLLRLSHVRLATAVESCLLMSAPSETTLVILATARQAQLIMPSTAAFWEIVTAIGLTITPHLAKISHKVSLKLTLREHNLTLPSNEEPIEDIQNHTIVAGIGRVGKVIADVLTSEKKPYLAIDSDIDLVINAKRDGYHATFGDISNPVFIQQLGNKINAVVLAINDPVSMVNVVHRLHTIYPDLTIIARASDSRHAAQLFRAGATDIVAETLESSLRLAEATLISLGVSTGHAVAAIHDKRASMRENVLKAAEEGNMQAIRHTPSIMPEA

SEQ ID NO: 14014 - protein, 392 aa, Prochlorococcus marinus str. MIT 9301
MKAMILAAGKGTRVQPITHVIPKPMIPILQKPVMEFLLELLREHNFKEIMVNVSHLAEEIENYFRDGQRFGVEIAYSFEGRIEDGELIGDALGSAGGLKKIQDFQSFFDETFVVLCGDALVDLDLTQAVKKHKQKGAIASLITKKVTKDQVSSYGVVVSDENGRIKAFQEKPTVDQALSDSINTGIYLFEPEIFNYIPSAEKFDIGADLFPKLVEMDLPFFALPMDFEWVDIGKVPDYWSAIRNVLQGKVRQVQIPGKEIKPGVFTGLNVAANWEKINITGPVYIGGMTRIEDGATIIGPSMIGPSCCICEGATIDNSIIFDYSKIGKGVRLMDKLVFGKYCVGKNGDHFDLQDASLDWLIADSRRSDLTEPSPQQKAMAELLGTDLINIPD

SEQ ID NO: 14015 - protein, 574 aa, Magnaporthe grisea 70-15
MSRRPPNPAAERAAQNQATIKSLLKLETNKICADCKRNKHPRWASWNLGVFICIRCSGIHRGMGTHISRVKSVDLDSWTDEQLQSVLSWGNARANKYWESKLAAGHAPSEAKIENFIRTKYELKRWVMDGPMPDPATLDAEADDDIPLSLVKEKQSIDRKESVRKASLGQSSAPTSIRRAPAPPAPEQDLIGGDPIPVRANSAGPAMSKVASKGEPAPPKTTSTKDSLLGLDFLGTETAAPPRPSSTTGTGGAGGQSRPDLKQSILSLYATAPRPQQQAQQGSFGGMNSPPLQQQQQSQGAGAFGGMNDAFSSLSFNTTSSAPKSPPANDAFASLGGLSSSRSPPPQQTSNTSAFSGLGGGSFFDTKPAQTHQQKSSFGSSSGFGGLTSPTATTASAPQAKPAGTSMPASAALGDLFDFSTPAQTSTPKPSAAPAPSSDSVFNLSASTQVKSPPATSNPTSTMGTNNWSNSDVWGANDAWSTPEAAAAPAKSTATTMPSSSSDAFGGWGSSGGGGLASQSIVPGASGGFQPKVAADEEFGGWASSTGTGNASGGTAKPAAGFGGNDDLFSNVWQ

SEQ ID NO: 14016 - protein, 133 aa, Nocardioides sp. JS614
MAYNVEKTDEQWREELSPDEYAVLREAATERAFTGEYNETETTGVYRCKACQAKLFESDTKFHSGCGWPSFYQPISDTIEYLEDTSHGMKRVEVRCSNCGSHLGHVFPDGYGTPTGDRYCINSISLTLEPNDS

SEQ ID NO: 14017 - protein, 259 aa, Erythrobacter sp. NAP1
MSENINDHANDAGSETVSFGYENVSPEEKTRRVGEVFTSVAKKYDIMNDAMSIGMHRGWKDRFVKRVKPQPGESILDMAGGTGDIAFRMADRGANITVADINQDMLDVGAERAMERAESAETGSLVFTCQNAEEVSFASGSFDAYTIVFGIRNVTYKVKALAEAYRVLRPGGRFYCMEFSTTEWSGFKEVYDVYSDLLLPRMGQMIAGDADSYRYLVESIRKFPKMAEFENMIRAAGFTNTKVESILGGAVAIHSGWKI

SEQ ID NO: 14018 - protein, 275 aa, Saccharomyces cerevisiae
MSEKPQQEEQEKPQSRRNSFAVIEFTPEVLDRCLKQVEFYFSEFNFPYDRFLRTTAEKNDGWVPISTIATFNRMKKYRPVDKVIEALRSSEILEVSADGENVKRRVPLDLTAARNARIEQNQRTLAVMNFPHEDVEASQIPELQENLEAFFKKLGEINQVRLRRDHRNKKFNGTVLVEFKTIPECEAFLKSYSNDDESNEILSYEGKKLSVLTKKQFDLQREASKSKNFSGRSRSFNGHKKKNLPKFPKNKKKNGKEESKEDSSAIADDDEEHKE

SEQ ID NO: 14019 - protein, 473 aa, Synechococcus sp. WH 8102
MAKTPQDVLRQIKDEGIELIDLKFTDLHGKWQHLTVCTDLLEEDSFTEGLAFDGSSIRGWKSINASDMAMVPDASTAWIDPFYRHKTLSMICSIQEPRSGEAYDRCPRALAQRALNHLSSTGLADTAFFGPEPEFFLFDDVRYNSSEGGAFYSVDTIEASWNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMVMAGLDGIKNQIDPGDGEDRDLFELPAEELAKIATVPPSLNGALEALNADRGFLTTGGVFSDDFIDNWIDLKYEEVQQLRQRPHPHEFAMYYDA

SEQ ID NO: 14020 - protein, 266 aa, Glycine max
MVIKSVLFSFIFPPPPSLVVWGLTVTSFLILANAFLSEIRGKHLNYSKFWNANPSAEKQVKLSSKAGMLLLYTPAFLAGLASFWVFPHQGLRFTILQSAVTLHYFKRVFEVLFIHKYSGGMTLESAIPITLSYFLSAVTMVYSQHLTKGFPEPPINLFYPGIVLFLVGIIGNFYHHYLLSKLRGKGEKEYKIPKGGFFELVICPHYFFEITVFYGIFFISQTLYSFAFAVGTTMYLVGRSYSTRKWYLSKFEDFPKHVKAVIPFVF

SEQ ID NO: 14021 - protein, 254 aa, Erythrobacter sp. NAP1
MSLSPARLDRFARHIVLPEIGGAGQVALSQKHVAVIGLGGIGSPALQYLAGAGIGRFTLVDDDAVDVSNLQRQTIFTQRDVGHGKATSARRWLANFDDALDVTLSDSRVSADNAAALLDGVDLVLDGTDNFATRLAVSDACVKAGVPLLSAAVGRFQGQVGAFAGHLPDQPCYRCFVGDAFDAEDCDTCAEDGMLGAMAGWAGSFAAMQSVRVLLEGVSRLGNPMWGKLHILDGLKPGLRTLNIAKDLACKACG

SEQ ID NO: 14022 - protein, 392 aa, Synechococcus sp. WH 8102
MTNSLLPVKDAHRQAFNAINTPDRLLLGPGPSNAHPTVLEALSRTPIGHLDPLYVELMGEVQELLRYAWQTDNRLTLPMSGTGSAAMEATLANTVEPGDTVLVAVKGYFGLRLADMAGRYRATVKTIEKPWGEWFSLEELEAALIEHKPAILALVHAETSTGVCQPMDGVGDLCRKHDCLLLLDTVTSLGGVPLYIDEWKVDLAYSCSQKGLSCPPGLGPFTMGPRAEAKMATRSGKVPNWYLDVSLLNQYWGSDRVYHHTAPVNMNFGMREALRLLAEEGLDQAWARHRRNAERLWSGLERQGLSMHVPEELRLPTLTTVRIPDGVDGKAFSQHLLNTHGIEVGGGLGSLAGKIWRIGLMGYNSTPENVDRLLNLFETELPRFSGSVAAAA

SEQ ID NO: 14023 - protein, 134 aa, Brassica napus
  misc_feature (21)..(21): Xaa can be any naturally occurring amino acid
  misc_feature (36)..(37): Xaa can be any naturally occurring amino acid
  misc_feature (54)..(54): Xaa can be any naturally occurring amino acid
MSHHPHHHHQAVDNLINVFAXASRDLDAVHFKLDKXXQQIYPDNANPMKLIQRXKKLQEDVTFLKDQCLELLSAKQDLIDKAQTTLVGNYNLIQKINASLGESTNGDADDDALADFNQIIEEWTMQVRSRTVGE

SEQ ID NO: 14024 - protein, 234 aa, Arabidopsis thaliana
MGEKEEVKLLGVWYSPYAIRPKIALRLKSVDYDYVEENLFGSKSELLLKSNPVHKKVPVLLHNNKPIVESLNIVEYIDETWNSSAPSILPSHPYDRALARFWSDFVDNKWFPALRMAAITKSEDAKAKAMEEVEEGLLQLEDAFVSISKGKPFFGGEAIGFMDICFGSFVVLLKAREKFKAEKLLVESKTPSLCKWADRFLSDETVKNVAPEIEKVAEFLQELEVRAQSAASRS

SEQ ID NO: 14025 - protein, 270 aa, Bradyrhizobium sp. ORS278
MSGAITALKWLLIVLVAIYATVIAVLFVRQRAMLFPIPPVGRTAPAAAGFQQAEEHVLTSADGEKVIAWHVPPQPGRKVVLYFPGNGDFLAGVVSRFKALTSDGTGLVALSYRGYAGSTGSPSETGLLQDAAAAYAFTRDRYEPQRIVVWGFSLGSGVATAIAAEHPIDRLILEAPYTSTVDVASDMLKVVPVSLLMRDRFHSDQRIAKVHVPLLIMHGAKDPGISIRFGERLFALAHDPKRFVRFPDGGHNDLDLFGATDTAKGFINAP

SEQ ID NO: 14026 - protein, 206 aa, Vitis vinifera
MSLITRSSRHHFLSTFCRNSAIFSRKLSQAAANKVDDESEEEVEIDQRRLPADYDPANFDPTQHRSPPTARVFRLVDEIAGLTLVEVAELSSILRKKLGMKEPPVVAIMKPGAVAAVSGGGMKAASAAKEEKKPEKTVFELKLESYEAASKIKIIKEVRSFTDLGLKEAKDLVEKAPSVLKAGVSKEEGEQLVEKLKALGAKVVLE

SEQ ID NO: 14027 - protein, 392 aa, Lentisphaera araneosa HTCC2155
MTIREKYEEYILGTYKPSILFEKGEGSYLWDETGKKYLDCSSGISVCNVGHAHPAVAKAIADQATQLLHVSNIFMTANAPLLAEKISKASFGGKVFFANSGAEANEGIIKFARKWGSEQGRNEIICMEDSFHGRTLAALAATGRAQYRVGFGPDLQGFHHVPYGDIEAIKSKLTDKTAAIMLETVLGEGGVKPAEPAFIQAVRDLCDQEGILMMCDEVQTGMGRTGKMFGYQNFGVEPDVMSMAKALGNGMPIGALEVQKKYEGILVPGTHATTFGGTPLACSAGLAVFDVFEEENVLENCNKQGAKFMQAFNEMKAKYDFVSDVRGLGLMIGIDVEIPTADVLNKATEKGLVLLTAGTKTIRLLPMLNITDAEVDQAIQIISEIFQELNHG

SEQ ID NO: 14028 - protein, 299 aa, Lentisphaera araneosa HTCC2155
MAKDLMNLLDLTKEELREVLDLAHKYREDRTLDNTSLSGKTIGLIFLKNSTRTRVSFEAGVNQLGGYPMFMDQNSLQLGRGESFADTAKVLSRYLDGIVIRGHEHENIKAFADACTIPVINALTDTFHPCQLLADMQLIEATSGKLEGIKVAFMGDCASNMALSWIYAAHLTGMELTLGGPEGYLPPQEFLDSIGNPSNIRVTTDAKAAAAGVDYIYTDVWVSMGFEEEAKDRLASFAPYQVNMDLLSVAKTDVKVMHCLPAYRDKEVSAEVIDGPHSIIWDQAENRLHAQKAVMKLKF

SEQ ID NO: 14029 - protein, 193 aa, Zea mays
MSSSSVLLVSAVLVALVTLSSCRSLGELSEQKTYSSAPSYGGSPTPTYGSGEGHEPTSTPSHHGTTPSTPAHGVPEIPKHGFVGSCDYWKSHPDMIIAVVGSLGNIGKTFGAACSLLVGKKLENLHEALSNTRTDGVGALLREGSAAFLNSIVNKKFPFTTQQVKDCIAVSVTSDDAASAQAGIFKKANEYHY

SEQ ID NO: 14030 - protein, 324 aa, Arabidopsis thaliana
MTMRSSLPSSSSAYSLASTSLSNRLETIFKKASELCTLCDIEACVIYYGPDGELKTWPPEREKVRDIALRYSQLNEALRRKKSVNLHGFLNKKKKNKGLKNTDKKRKTSLKKVNVLKYPLADHYPPDQVSPLIQSLELHVSKFHERLEFLESRKQNETQPDHHSLASSSLNHQTQSLNPSQFSLFMYNHGDNTLSQIPVSASNFNQDYFSALLEQSELKNQLMKQEICGNDQNQNMWMGNITNNNFQLPCVSVQESVNNFGLMHKEFYGCDHNMSVGNINSNSCEHPCVSSTQHYSAVEESVNNPWLNQLMQNELYGYGYADFC

SEQ ID NO: 14031 - protein, 194 aa, Clostridium tetani
MSLVPVVVEQTNRGERSYDIYSRLLKDRIIMLSDQVNDVTASLIVAQLLFLEAEDPDKDIFLYINSPGGSITSGMAIYDTMQYIKPDVSTICIGMAASMGAFLLAAGAKGKRFALPNSEIMIHQPLGGFQGQATDIGIHADRILKIKQNLNSILSEKTGQPLEVIQRDTERDNFMDANQAKDYGLIDEVMVKKK

SEQ ID NO: 14032 - protein, 368 aa, Chlamydomonas reinhardtii
MTGGIQSEDVRLARFQAELRGSTINLHALKRLAFHGIPDKGNLRATVWKLLLGYLPLAPEDWAKHCAARRTQYHVFCDELIVDPKRQQDPILFGGLGSSQSAGGGGQAPSAAAPVDDHPLSLAQTSRWCTYFKDSEVMVQVERDVMRTHPDMHFFTGDSPEAEAHREDMKRALFMYAKLNPGLRYIQGMNELIAPLYYLFKTDTQDPLSSQYAEADAFWCFMELISDFRDHFCAQLDNAQSGIKATIRRLMLVLQHYDKELWHHVEVVHKVDPQFYAFRWLTLLLSQEFAFPDTLRIWDTILSDPHGRMDCLMRICTAMILHLRPILMRGDFSVILKTLQRFPPVDVNVLLAKAASMPPCTEILATSV

SEQ ID NO: 14033 - protein, 482 aa, Salmonella enterica subsp. enterica serovar Paratyphi B str.
MQLNDSTLFRQQAFIDGDWRDARGGDVIPVSNPANGKPLGNVPKMGAEETRDAIDAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQGHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 14034 - protein, 427 aa, Salmonella enterica subsp. enterica serovar Paratyphi B str.
MNTNNALMQRRHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACAAALAVLDIFEQENLLQKANTLGKTLRDGLMEIAETHREIGDVRGLGAMIAIELFENGDPGKPNAALTADIVARAREKGLILLSCGPYYNILRILVPLTIEASQIRQGLEIIAQCFDEAKQA

SEQ ID NO: 14035 - protein, 413 aa, Bacillus cereus E33L
MGKLFFKICFFALVTVFSFAVKITYAEESQQNNYPIILVNGFAGWGREEMLGVKYWGGVHDIQEDLKRNGYTVHTAAVGPVSSNWDRACELYAQINGGTVDYGAAHAEKHGHNRFGRTYSGFALNWSEINKVHLVGHSMGGQTIRTLVQLLKEGSFEEKNYVKNHPNTKISPLFEGEKSYVHSVTTLATPHNGTTLADGSLLLPFVKDLLITAASLGGNSNLSLYDFKLDQWGLKKNAGESFFQYTDRILNSSLWKNTKDISQWDLSTDGAKELNNWVKTQPNVYYLSYSGHASQAAPITGLHLPHITMNKVLMGNTFFLGSYARYEENRPLIDTTWWQNDGVVNTSSMIAPSSNATVNNNESLQIGKWNHIETKANWDHLDMVGLSVSDTLGFSNIQEYYRTIAEKLSRLPK

SEQ ID NO: 14036 - protein, 516 aa, Oryza sativa Indica Group
MAKPAPAPAAGAREDEDAPALRRRLRRLVAAATAGAASESVFDEAAAALAALRDAEVGVGRKGVGGGEEADAAAVPALFLCPISSGIMRDPVVIESGQCEVWILYIILASQFHAICVFSVTTFLYEYRGEFLLFKYADMMKFSKNMEQNSKSTNMTYDRRSIQEWFSAGNQICPQTQQVLSHTILIPNHLVRTMISQWCTENGLTLPEIENQEEDHVTNSEEKTFDEIFVKITSSSSSGGRKQAIKDLRLVTKRNSEFRAVLGQRPDSIAQMIMARSTPGLQNDPQVLEDMVTIILNFSIHDSNKKIIGDDSEAIQFLIWALKSGDMGSRSNSAAAIFTLSALDSNKEKIGKLGAMDPLIDLLEHGSIIAKKDAASAIFSLCLLHENRSIAARSGIVDVAMRAIDDQSLVEESLAILALLSRNQEMVEIITEFNGTASMLRSIRESECKRSKENAMVVLFAICTYNRTKLKEVEADESINGSLTFLAQTGTQRARRKASGILEKMKRTMHNRHCSC

SEQ ID NO: 14037 - protein, 184 aa, Triticum aestivum
  misc_feature (86)..(86): Xaa can be any naturally occurring amino acid
  misc_feature (97)..(97): Xaa can be any naturally occurring amino acid
  misc_feature (119)..(119): Xaa can be any naturally occurring amino acid
  misc_feature (132)..(132): Xaa can be any naturally occurring amino acid
  misc_feature (140)..(140): Xaa can be any naturally occurring amino acid
  misc_feature (142)..(142): Xaa can be any naturally occurring amino acid
  misc_feature (154)..(154): Xaa can be any naturally occurring amino acid
  misc_feature (171)..(171): Xaa can be any naturally occurring amino acid
SFFLQVNYRLPLRPQTKRTYYEYTGLWHIYAILSLNAWFWSTIFHTRDIDLTEKMDYSSAVAQLGYPLTLTLAKNFPMSKDEAGQXVCFAAPILAFXVTTHTLYLTSLRTLTNGWDMKXGVAMGGVHIVPWXTWAVCDPXPXTIQVWVCHIPEXSYIFLECKIPPVQGYAXHSLWDPTHLLLGG

SEQ ID NO: 14038 - protein, 271 aa, Brassica napus
MAVPPLLLLTLLSLPSLLIHAAISDAYPTIPGTAPIDGGFSDELKPIRREVYGEGKIFDISHRYTPEMPAWESKEGIGRFLWLAASMKNGSLANNSEMKIPTHTGTHVDSPGHVYDEYYDAGFDVDSLDLQVLNGPALLVDVPRNKNITAEVMKSLNIPRGVRRVLFRTLNTDRRLMFKKEFDTSYVGFMKDGAQWLVDNTDIKLVGVDYLSVAAYDDLIPSHLAFLKGRETILVEGLKLDDVKAGVYSVHCFPLRLVGAEGSPIRCILIS

SEQ ID NO: 14039 - protein, 430 aa, Synechococcus sp. WH 8102
MELCHAVLTSLLHGPALDHWTLPNGVRCVAAEMPEAPLTCLDLWCRAGSFTEAAGEEGMAHFLEHMVFKGSERLEAGAFDLAIEALGGSSNAATGFDDVHFHVLIPPETSQQALDLLLDLVLHPALEQESFRLEREVVLEEMAQYADQPDELVLQQLLKQGCPDHPYGRPILGERSSLLAMDPEAMRTFHQRRYRGHHCCLAISGPKARELRATVESSALAQLPPDPQPSADAIDQVEPKGLRMQPGRHTMELARLESARLLMLWSGSTAHDQAWVMGADLATTLLGEGRRSRLVAQLREELRIAESVDMDLSVLEQGCLMTLEISCEPEDLEQVEATVHEQLNQAAPFTAEELSRGRQLVGNGLRYSLESVGQVAAQAASQMLWNRPQELLQPLQHLQAWTEERLSEDLMPLLQPSRACSLIATPAGQR

SEQ ID NO: 14040 - protein, 146 aa, Oryza sativa
KAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 14041 - protein, 327 aa, Enterococcus faecalis V583
MELFDSLKFKVVRRNIKIVFPEATDPRILGAAARLKSDELVEPILIGDPTDIANAAMARGINTSNFIIINPNDYEKWDEMVEAFVERRNGKATKEDAEKILKDVNYFGTMLTYMGIADGMVSGAIHSTGDTVRPALQIIKTKPGVSRTSGAFLMIRGRDQERYLFSDCAINVNPTAQELAEIAVDSAKTAELFDIEPKVSLLSFSTKGSAKAPEVTKVAEATKIAQELAPEYAIDGELQFDASYVSSVAQLKAPNSKVAGEATVFVFPDLQSGNIGYKIAQRLGNFEAIGPILQGLNKPVSDLSRGANEEDVYKLSIITAAQTLMND

SEQ ID NO: 14042 - protein, 107 aa, Vitis vinifera
MGKSWADDMILSYNDVVLRRSDLDILSGPRFLNDRLIEFYFSYLTSCYPSPDISLVPPSIAFWIMNYPDTGSLRDFIEPIMHESTMHKQTRQRKHYARTCAIARKGS

SEQ ID NO: 14043 - protein, 591 aa, Oryza sativa Japonica Group
MDQYEVLEQIGKGAFGSALLVRHKLEKKKYVLKKIRLARQTDRTRRSAHQEMQLIATVRNPFIVEYKDSWVEKGCYVCIVIGYCEGGDMAEAIKRANGTYFSEEKLCKWLVQLLMALDYLHANHILHRDVKCSNIFIARDQSIRLGDFGLAKILTSDDLASSVVGTPSYMCPELLADIPYGTKSDIWSLGCCIYEMTALRPAFKAFDMQALINKITKSIVSPLPTKYSGAFRGLIKSMLRKSPEHRPSAAQLLKHPQLQPYVLQVQLKSSPTRNILPIHQSLTDKVKKMTFPSDVVDSARRRMARRNSLGNERTVTFSKPSPERNSVSSTRSIKEYTTTQSVKGLSVDSSEAGDEVTSKAIITKTSSILRTPKSLPAKTYTARNQLEPPKTSYNRTYRSELPSKTTPNKIARPARRASLPLSTYETPTKRSISILEQLDSPDVSVNAPRIDRIAEFPLASSEDPLLPIHNKLSPGHGSCSTPPFINRSITKDKCTIQVLRTDGDNGSDSSGRNATAASSRGSNDSRQQRFDTSSFQQRAEALEGLLEFSAQLLQQERYEELGILLKPFGPEKASPRETAIWLTKSFKETAS

SEQ ID NO: 14044 - protein, 285 aa, Brassica oleracea
STEANKAAISILVRNLAHGSELAAGEIRVLTRTVTETRTLIVEAGAIPYLRSLLKSENAVAQENAVASIFNLSIDEANRSLIMEEHDCLEPIMSVLVSGLTMRAKEIATAALYTLSSVHDYKKTIANADGCIESLALVLRNGTVRGKKDAVYALHSLWLHPDNCSLVVKRGGVSALVGALGEESVAEKVACVLGVMATESLGAESIGREETVVTGLMELMRCGRPLGKEKAIATLLQLCTLGGAVVTEKVVKTPALAVLTRKLLLTGTDRAKRKAVSLSKVCKGC

SEQ ID NO: 14045 - protein, 563 aa, Brassica oleracea
MAMLETKIIIIVILLLLMVLMLFLFSLVILFACKPWRYLPLFRSSTFKLGELQRPLVSDGDGEHLNQGQTGEEGSREYDLEGACYQNEGILQGRAYKQRLPSSSPHLNQGRTLKHPADKVSLGDVETDDLQDNTSQSLQHDLEKERLSELSPGLVIVNDQRSWLCLEVISGPSIGLQFAVHSVSTSKLPLGLGRVPPSGMLLKDPEVSGKHAQITWNSTKFKWELVDMGSLNGTLLNSRSVSHPDLGSRKWGQPVGLASEDIITLGTTTKVYVLISSQNEFKTPFRVGVASDPMAMRRGGRKLPMEDFCYYKWPLPGVNKFGLFCVCDGHGGAGAAQSAVKIIPEVLANILSDSLEKEKVLSQRDASDVLKDVLAKTEARLEDHLYEGCTATVLLVWKDDEENLFAQCANLGDSACVINLDGRYIQMTEDHRVASLTERRRIQEAGLSLRDNETRIFGINLARMLGDKFPKQHDGRFSAEPYISEPLRIDQSNKDVFAVLASDGLWDVVSPSKAVQLVLQMREKERGTEDSAEKIAKGLLDQANVMRTKDNTSIIYLDFDPSL

SEQ ID NO: 14046 - protein, 184 aa, Lentisphaera araneosa HTCC2155
MSLYAATKKSNEMMAHSYSHLYDLPTTGLRFFTVYGPWGRPDMALFLFTDAILNNREIKVFNNGEMSRDFTYIDDIVDGIYKALISPPKRRQLEKLSTDSSSAPYEIYNIGNNSPVPLMNFIKAIENATGKEAKKNFLPLQPGDVVSTHADCTKIIQNLHYSPSTSLQTGVDQLVQWYKQHYKK

SEQ ID NO: 14047 - protein, 424 aa, Methylobacter marinus
MYVIVPTGRADQTKLSSRSYEAGRLATRLFRSVVMKALCWHGKYDVRVDTVPDPIIVDPTDAIVKITATAICGSDLHLYDGYMPTMESGDILGHEPMGEVVEVGSEVTSLKTGDRVVVPFTISCGHCFFCEKTLYSCCDTSNPNADMARKAMGHSPAGIFGYSHMLGGFAGGQAEYLRVPYADVGPIKITSDLPDDKVLFLSDIFPTGYMAAENAQIEPGDTVAVWGCGPVAQFVIQSCWMLGAGRVIAIDRVPERLTMAQEHGKAEIIDFEEEDVYDRLMAMTNGRGPDCCIDAVGCEAHGAGSFDAVLDKAKAALYLGTDRPHVLREAIMCCRKGGTVSIPGVYVGLLDQLPMGAAMNKGLTLKMGQTHVQRYLEPLLEKIEEDQIDPSFVITHSLGLDEGPQAYKTFRDKEDGCIKVVLKP

SEQ ID NO: 14048 - protein, 405 aa, Bdellovibrio bacteriovorus HD100
MTSAAVTFENTIETIELKRDVTKHLKQGHRWLFANCFDPSRNLKSGIHMLNYKGEALALGIWQGDTQLRFRVLVLAEEPIFRRNNMKRTLELYFENQWRKAVEIRKTFDLSVTNSFRLINGEGDGLPGLIVDVYNDTAVIKHDHPIMEKTWNAPAIAEKIQEAFPQVKCVYLKRRNDAEEKGVNIVGTLAPEVQFLENGVLFASNIRDAAKTGFFLDQRDNRKMIQHFAKDKTVLNLFSYTGGFSIFAAKGGAKEVTSVDIAKVAIQAVARNFEINDLKTVHHDVATDAFAYLEQLNTEKKKYDIVITDPPSFAPNEKSVEQAKAAYTKVFSNSIKLVNPEGLFAASSCSSHISTKEFMDICQEAFSRARKKATLVYIGGQPVDHPYPLAMEELRYLKFALFRLD

SEQ ID NO: 14049 - protein, 365 aa, Rhodococcus sp. RHA1
MSTERFETIVIGAGQAGLATGYHLTRCGQRFVILDAHDRVGDVWRERFDSLRLYSPARYDGLPGWGIPAPAWSWPGKDEVADYFEAYAQRFALPIRTGTTVDGLSRDGDRYVVTAGTDRFEADNVVVASGTWQSPVVPDLAERLDPRIRQLHSSDYRNPSQLQDGPVLVVGCSHSGADIALEASRSHRTTICGPVRGEVPFDIEGRLAHLAVPIMWFMANHVLTERTPVGRKMCTHVRSGGGPLLRVKRADLAAAGVEHFPAKVTGVHDGRPVLDDGTAFDVRNVIWCTGFRKDTSWIQIPVTGSDGWPEQSRGVSPDHPGLYFVGLPFLQAFASMLTGGVGRDAAYVAKHIAKRVVVRSPEAVA

SEQ ID NO: 14050 - protein, 389 aa, marine gamma proteobacterium HTCC2080
MDFGGITFTFAAIFLGAAVFASIALYTRQPIIIAYIILGAALGPFGTGLVSNTALVSDAGHVGIIFLLFLLGLDMQPKALLNSMKSSSWVALASSGIYIAVGYAITRGFGFTHNDALLVGAALMFSSTIIGIKLLPTTVLHHKHLGEVLVALLLFQDLIAIIVLVWLQSGDSDSSMVWSLARPMIMLPLLVLSCWASVRFVLIPLIARFDRYHEYIFLLSVGWCLGVAELAALMGLSAEVGAFIAGVAVATSPIAQYIAVSLKPLRDFFLVIFFFSVGAQFDVSALPSVATAAVVLALSYLCLKPVVYQMLLRGVSESPKLAWNLGFRLGQCSEFALLIAVVALESGRLSPTAHTLIQATTILTLLISSYLVVTRLPTPIASNDALRRD

SEQ ID NO: 14051 - protein, 415 aa, Magnaporthe grisea 70-15
MSDLQGRKIFKVFNQDFIVDERYTVTKELGQGAYGIVCAAVNNQTSEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMAKKPFPTLFPNANPDALDLLDRMLAFDPSSRISVEQALEHPYLHIWHDASDEPDCPTTFNFDFEVVEDVGEMRKMILDEVYRFRQLVRTAPGAGGHGAPHAPQVPIPAGAGQGQWKAEDPRPQEYVGQMNDLEAELAGGLDQRR

SEQ ID NO: 14052 - protein, 358 aa, Campylobacter coli RM2228
MNTYKIAVLPGDGIGLSVMKEALKILNFVAQKHGFKLETKEAKIGGASIDAYGVALSDETLKLCEQSDAILFGSVGGPKWDNLPIDQRPERASLLPLRKHFNLFANLRPCKIYESLRHASPLKDEIIQKGVDILCVRELTGGIYFGKQELGKESAYDTEIYTKAEIERITRLAFESARIRNKKVHLIDKANVLASSILWRDVVGQIAKEYEDIKLEYMYVDNAAMQIIKNPSTFDVMLCSNLFGDILSDELAAISGSLGLLCSASLNDKGFGLYEPAGGSAPDIAHLNIANPIAQILSAALMLKYSFKEEKAARDIENAIAIALERGKMTKDLNANSYLSTDEMGDCIVEILKENNNG

SEQ ID NO: 14053 - protein, 380 aa, Zea mays
MARHIHRHDMIRAFTTLRRWNGFLSTRYNEETIWFGHSINTANWMREYFSKWGESGTVDLKHELEQVILLITCRCLLGREVRQNLSDDVAALFHDLCNGMQPVSVIFPYLPIPAHRRRDRARRRLREMFATIIRARKASGRSEEDMLQCLIDYRYKDGRATTEDEIAGLLITVLFGGQQTSSITSTWTGAYLLQFRRYLAAAVEEQEEAIRRCGDRINHDVLAEMDVLHRCIKGALRLQPPLPIVFRWSHSDFAVTTREGEELVVPKGQMVAASPAVANRLPHVYKDPELYDPDRFAPGRREDKAAGALSYISFGGGKHWCLGEFFAYLEIKTVWAHLLRNFELELMSPFPENEWNSMVVGVKGKLMVKYTRRQLVVDGN

SEQ ID NO: 14054 - protein, 317 aa, Candidatus Kuenenia stuttgartiensis
MTITYIYKTIEKALSFRKGYIDNAHTNVYRLLNSYGDNLPEATIDIYDNTVLVQYFKTHEDRTKKEIYEAVQKLISPECIIEKERLKGRDVVTRLISGKEIPDNYVVIENGIQFCTSFNDGGGTGLYLDQRDNRKKVQSFARGKEILNCFCYTSSFSVYACAGGAAKTTNIDLSGKAIAWSKNNYVLNQIDVNNHDFIAGDVWEYFKIFQKRGKEFDVIILDPPSFSTSKSRTFTVEKDFPELVGLGLNILRENGILVFSTNIAKMTLSRLFQSLPKIKSHTKKLFKVINVSSQGLDFPVDGIYVNEPYLKFIMFSC

SEQ ID NO: 14055 - protein, 229 aa, Erythrobacter sp. NAP1
MTPEEQERELQRRERAASRLFSGRVDFLLSAPQLKFLPDPICPEVAFCGRSNVGKSSLLNALTGRKAIARASVTPGRTQELNFFDVGGEPGGKPLFRLVDMPGYGFAKAPVKVVERWKNLVKSYLRGRPVLARNLVLVDSRHGLKDVDREMMKMLDEAAVGYRIVLTKTDKIKASELERVANKVADEARKHVAAYPELHLTSSEKGMGIEALRAAVVADALGESWFDAG

SEQ ID NO: 14056 - protein, 103 aa, Glycine max
MATIRILGTLKEGDLHGKTVLVKVHLNVTLDDTLNISDDTKVRAAVPTIKYFTRNGPKVILSSHLRRSRCLTPKYSLNPLVPTLSQPPGTEVTIANEPNWEEI

SEQ ID NO: 14057 - protein, 585 aa, Synechococcus sp. WH 8102
MGDGAAAAQQETATSLPKAEQRKLDSDYLREPLLSELANDLPNFSEDALQILKFHGSYQQDDRDKREKGKDKTWQMMLRLRSPGGRIPAQLFLALDELSDRLGDGTLRATTRQAFQMHGIPKADLKEVIGTIVRNLGSTLAACGDINRNVMAPAAPFEKGGYPAARRLADEIADLLSPEAAEGSYLDLWVDGDLSYRFSPPAAVRRARKRQLEPGVFSGSEAEPLYGDTYLPRKFKVAVTVPGDNSVDLLTQDIGLVAFTDPSGDLRGCNVYVGGGMGRTHNKEETFARIADPLGYVDAADVFDLLQAIVALQRDHGDRRIRRHARMKYLLEDRGIAWFRNELKANYFSRPLKGFRNEAKPKLLDYLGWHRQKAGLWFVGLPLLCGRLKGTMKQGLRAIVDTYQLEIRLTANQDLLLCNIGTAQRATIKAELAALGFDLPDAPPPLARHAIACPALPTCGLAITESERILPSVLERLDAQLRRLEIDKSVLIRMTGCPNGCARPYMAELALVGSGVNQYQLWLGGSANLQRLAQPFLQRMPLDELEQTIEPLLISWKQAGGRRSLGDHVEKLGDQAVSELLGAAA

SEQ ID NO: 14058 - protein, 333 aa, Marinobacter sp. ELB17
MAFNLKNRHFLTLRDFSPREISFLLKLSTDLKAAKYAGTEIPQLVGKEIALIFEKNSTRTRVGFEVAAYDQGARVTYLGPSGTHIGHKESVKDTARVLGRVYDAIEYRGFGQKIVEELAEYAGVPVYNGLTDEFHPTQILADFLTMQEHVEKPLHQVAYAFLGDAANNMGDSLLIGGAKMGMDVRLCAPKVCWPQQSIQDEAQAIARGTGARITITEDVDTAVAGVDFVYTDVWVSMGEPKEKWGDRIKLLMPYQVNAAVMEKTGNPRARFMHCLPAFHNTDTIVGKEIQAEFGISAMEVTDEVFESPASIVFDQAENRMHTIKAVLVATLGA

SEQ ID NO: 14059 - protein, 271 aa, Enterococcus faecalis V583
MKISFIGAGNMASAIAKGALKKQFIAAENLYFYDIQVEKTAAFAQEIGAHAVASPQEAITVADLVILAVKPQFVQAALLEAKEAILDKQPLIVSIAAGTTIAELYQLFETTQPLRLVRVMPNMNALIGAGAAAVCGNAFASPEDIQTVLSLFRAVGQAWELEEQYFSIFTAIAGSTPAYAFLFIDSIARAAVKNGMNKELALEIATQAVLGSAQTLANSTENPWTLIDQVSSPGGTTVAGIVELENNAFISTVIKGIEATILRDQELAKQD

SEQ ID NO: 14060 - protein, 344 aa, Lentisphaera araneosa HTCC2155
MHIKKILITGVAGFIGFHLAKKLIELDFEVVGIDNLNDYYDVNLKLSRLQELGIAKKQHTSTKHRNFTFKKIALQDKDSLDKLFRDEDFDAVCNLAAQAGVRYSIENPNEYIQSNLVGFGNLLEACRHFNIKHLVYASSSSFYGLNSLSPFSESHTTDHPVSLYAATKKSNEMMAHSYSHLYDLPTTGLRFFTVYGPWGRPDMALFLFTDAILNNREIKVFNNGEMSRDFTYIDDIVDGIYKALLSPPKRTQEDKLRTDNSSAPYELYNIGNNSPVPLMDFIRAIEKSTGIEAKKNYMPLQPGDVVSTHADCTKIIQNLHYSPSTSLQKGVDQFVQWYKNYYNY

SEQ ID NO: 14061 - protein, 356 aa, Oryza sativa Japonica Group
MASSSTAAAALVVAALLLSSSPSPAAAAAGRGGELRMKHSDGGYSYNRTLAHIFVQYASAVYTSDLTSLFAWTCPRCQSDTKGFEMIEIIVDVENCLQAFVGVAPDPQSILIAFRGTQEHSVSNWIEDLFWKQLDVGYPGMPDAMVHHGFYTAYYNTTVRHEILESVRWARKTYGRLPINVVGHSMGGALASFCALDLSVKYGSQEVQLMTFGQPRVGNPSFAAYFSDQVPRTIRVTHQNDIVPHLPPYFCYLGEWTYHHFSREVWLHETIVGNVVTRNETICDGSGEDPTCSRSVYGRSVADHLEYYGVSLHADSRGTCQFVIGSTNMAYGTILEVDRTIIMTRYPQEWHAVESI

SEQ ID NO: 14062 - protein, 499 aa, Glycine max
MISFTVFVFLTLLFTLSLVKQLRKPTAEKRRLLPPGPRKLPFIGNLHQLGTLPHQSLQYLSNKHGPLMFLQLGSIPTLVVSSAEMAREIFKNHDSVFSGRPSLYAANRLGYGSTVSFAPYGEYWREMRKIMILELLSPKRVQSFEAVRFEEVKLLLQTIALSHGPVNLSELTLSLTNNIVCRIALGKRNRSGADDANKVSEMLKETQAMLGGFFPVDFFPRLGWLNKFSGLENRLEKIFREMDNFYDQVIKEHIADNSSERSGAEHEDVVDVLLRVQKDPNQAIAITDDQIKGVLVDIFVAGTDTASATIIWIMSELIRNPKAMKRAQEEVRDLVTGKEMVEEIDLSKLLYIKSVVKEVLRLHPPAPLLVPREITENCTIKGFEIPAKTRVLVNAKSIAMDPCCWENPNEFLPERFLVSPIDFKGQHFEMLPFGVGRRGCPGVNFAMPVVELALANLLFRFDWELPLGLGIQDLDMEEAIGITIHKKAHLWLKATPFCE

SEQ ID NO: 14063 - protein, 424 aa, marine gamma proteobacterium HTCC2080
MAVVWAAENVFECSNGALLNEGGLFMRLRIGPGAMVAAAFIGPGTITTASVAGATTGITLIWAIAFSVFATVLLQELAVRSALATDRDLATLIRDFGAGYWWGAPLLLLIILAVGVGNAAYQSGNLSGAGIGLNTALGTNFTSVVLLSATASAILIVINRYRLLERILVVLVAAMGLLFTGLAIMLAPLLWVQPEVRLLPDFSYANLTLVLALIGTTVVPYNLFLHATAARQHWQGSSIGEALKGARWESCVAILFGGVTTTAIVVVAAALVPNAVDQPAINAVIEAIEVQMPGWGVMILGMGLFAAGLTSAIAAPVAAGWTICGALGWSVDPQSLRFKLVALTVVLIGGLFAVVTSRPSALILTAQVTNALLLPLIALVLIMVANSSLLPSSYRNNVVLNATGIAVLVAMTLLAGGKLFKILG

SEQ ID NO: 14064 - protein, 413 aa, Glycine max
MGSLGAILKHPDDFYPLLKLKMAARNAEKQIPPEPHWAFCYTMLHKVSRSFALVIQQLGIELRNAVCIFYLVLRALDTVEDDTSIETDVKVPILIAFHRHIYDRDWHFSCGTKEYKVLMDQFHHVSTAFLELGKNYQEAIEDITKRMGAGMAKFICKEVETIDDYDEYCHYVAGLVGLGLSKLFHASGSEDLAPDDLSNSMGLFLQKTNIIRDYLEDINEIPKSRMFWPRQIWSEYVNKLEDLKYEENSVKAVQCLNDMVTNALMHPEDCLKYMAALRDPPIFRFCAIPQIMAIGTLALCYNNIEVFRGVVKMRRGLTAKVIDRTKTMADVYGAFFDFASMLEPKVDKNDPNATKTLSRLEAIQKTCRESGLLSKRKSYIVNDESGYGSTMIVILVIMVSIIFAYLSANHHNS

SEQ ID NO: 14065 - protein, 743 aa, Oryza sativa Japonica Group
MEASLGALIFPCFLLLICARADDTVSRNRPLSGGQRLISSGGLFALGFFQPVVNNSDDRAPNRWYLAIWYNKISKTTPVWIANRATPISDPNLSQLTASEDGNLALFDQARSLIWATNITNNVNSTVGVILDSGNLVLAPASNTSNFLWQSFDEPTNVWLPGAKLGRNKITGQITRFISWKSSVDPSPGYYTLEIDPNGGDQFIHLWNNSAIYWETGKWIGNMFTGIPEMALYPKEVLSYKFTVNNQESYFVYRTNASIATAMFIMEISGQVKTVVWMESKKDWVPFLALPKAQCAVYFLCGSFAMCTENAVTFCSCLRGFSKQYNGEWRYGNPSGGCMRNTKLQYDGNSSSKTTADEFYALAVAKLPDKAWGLATGTDGFLQLTRKATVIGASTAGAILVTLIVIIGILLILRKRNLSEANKVEGSLVVFRYRFLQHVTKNFSERLGKGSFGPVFKGTLPDGTLIAVKKLDGVSQGEKQFRAEVSTIGTIQHVNLIRLLGFCSERSMKMLVYEFMPNGSLDRYLFGSTPLTLSWKTRYQIALGIAKGLAYLHEKCRSLIIHCDIKPENVLLGADFMPKIADFGLAKLLGRDFSRVLTTMRGTIGYLAPEWISGTAITTKADVFSYGMMLFEIISGNRNADWHRQGEQGAGTFFPVLVAMRLPEGKIQDLLGSELSADANLEEVERACKVACWCIQDDENTRPTMGEIVQILEGLVDVSFPPVLWYLHVLAQRSNFSTEETSH

SEQ ID NO: 14066 - protein, 372 aa, marine gamma proteobacterium HTCC2080
MSQSFHPPQRTLMGPGPSDVSPRVLGALGRPTIGHLDPLFIELMDDTKRLLQYAFKTSNELTIPLSAPGSAGMEAAFVNLVSPGDTVIVCQNGVFGGRMKENVERCGATAVMVQDRWGDPVDPEKVAEAFAANPQANLLAFVHSETSTGVRSDAKILCGIAKANDALVVVDTVTTLGGIDLRVDEWGADAVYSGTQKCLSCVPGLSPMTFSPAAVERIQTRQTKVQSWFLDMQLVMGYWGGDSKRAYHHTAPVNALYALHEALLILEDEGLEASFSRHHANHEQLVAGLEAMGLEMAVAPEWRLPQLNAVCIPDGVNDAEVRGRLLQEFNLEIGAGLGALAGKQWRIGLMGHASNPVNVERCLTALKHVLSH

SEQ ID NO: 14067 - protein, 636 aa, marine gamma proteobacterium HTCC2080
MIILEDIALRRGPKLLMQGASTTLQPGQKLALIGANGTGKSSLFAMLLGELSADQGQIRGMTGLRVAHMAQELEVSDDTTLNFVMAGDAAVYQLTQDIGKAEQTEDYERAAYLYQEMEVLDGYSAPRRAEQLLLGLGFTQTDLQMSVTEFSGGWRVRLNLARALMTPSDVLLLDEPTNHLDLDTMLWLQGWLLRYSGTLLMISHDRDFIDAICERTLSLEQEQLIPYRGGYSAYEQQRAERMAQQRAQYAKQQREIGQMEDFVRRFRAKATKARQAQSRLKALERMETVAPAHVDSPFSFQFPEPGKSSDPLLTIDNLVLGYGDDIVLDGVSLSLHPGDRIGLLGKNGAGKSTFLKGLTGALPALSGDRITGAHLRIGYFDQQQLEVLDLQASALLHLQRLSPKVREQAILDFLGGFNFKGDRARQEIAPFSGGEKARLALAMVVWQDPNVLILDEPTNHLDLEMRHALAVALQGYTGAIVLVSHDRHLMRHAVESLWLVDSGAVTEYPDDLTAYEQWVLSGDRSATVPSGKTANKTALTQDSSGKGKQNRQGAAEQRARLRPLQKALEKTERTLEGLQQKLNELQAQLANSDLYEPGQQAQLAKLVEAEGLLKSQLSEIEETWMQQQETIESASR

SEQ ID NO: 14068 - protein, 261 aa, Oryza grandiglumis
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNASRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 14069 - protein, 599 aa, Ralstonia eutropha JMP134
MTVSATSPGTRLQRLLPWTQRVSRATLRADGIAGLLGAVLVLPQGVAFATLAGLPPEYGIYTAVVPCIVAALFGSSWHVMSGPTNANSLALFAMLSPVAFAGSPAYIGLALSVTILVGLMQLAVGTLRLGTLANFISPSVLLGFTCGAATLIGLYALKDLFGLAVPTGTSAFGVLRFLSDNVDAINWGAATVGAVTLGATLLFKRLGKRLPFMLLGLMAGYGVALLLNRTGWGGGHHVNVVGPIPSAIPAFHVPDISWRSVPDLLGIASALTIVALGQSISIAKAVALRSGQHIDANREFIGQGLSNIAGGLFSGYISCGSLNRSVPNFEAGAKTPLASVFSALWLLALVAVSASLLAQIPLAAIAAMLLLVAWGLFDFARLRRIAALSRTEFAIAVGTFAATLMIRLEMAVLLGTILSLVAYLYRTSRPAVRSLVPDADDPGRRFTPLDELHRPQPECPQLKLLRMEGAIYFGAVQYVTDRLHWLRTVNASQKHLLAMTKSMNFIDLAGAEMWEAELSERRAAGGDLYFHRPRTQVLQTWEQTGFTGKLGPDHVFSTKRQALHTIIGQLPPDVCAQCKVRIFEECAQRPGAQTHAETL

SEQ ID NO: 14070 - protein, 311 aa, Saccharomyces cerevisiae
MTASTPSNVMTLFLLRHGQSELNHENIFCGWIDAKLTEKGKEQARHSAELIEQYCKANNLRLPQIGYTSRLIRTQQTIETMCEEFKLKPQLQVVYDFNKIKLGDEFGSDDKDNMKIPILQTWRLNERHYGSWQGQRKPNVLKEYGKDKYMFIRRDYEGKPPPVDLDREMIQQENEKGSSTGYEFKEPNRQIKYELECSNHDIVLPDSESLREVVYRLNPFLQNVILKLANQYDESSCLIVGHGSSVRSLLKILEGISDDDIKNVDIPNGIPLVVELDKNNGLKFIRKFYLDPESAKINAEKVRNEGFIKNP

SEQ ID NO: 14071 - protein, 323 aa, Yarrowia lipolytica CLIB122
MAGGPTLKLNSGHEIPQIGLGTWLSKPNEVAKAVESALKDGYRHIDGATIYQNENEVGAGWKASGVPREEIFLTTKNWNNARTKEGVKKQLDQSLKELQTDYVDLLLIHWPVVFKTGEELFPHNADGTVALGEVPVEETWEAFEELVKEGKVKSIGVSNFTEERIEKLLKTAKIPPAVNQIEYHPYLQQPGLAKYLASKNIVLEAYSPLGNNTYGFPRAIDDERVIDLAKKKGKDAAALIVNWIRSKNHVVLPKSVTPSRIKSNFEVFDLSPEEIKFLDSLDEESRRNDPIEWGVDIFGTATPEEIKKRVDEAAKKYLAEQKK

SEQ ID NO: 14072 - protein, 511 aa, Arabidopsis thaliana
MDKRWSLQGLTALVTGGASGIGHAIVEELAGFGAKIHVCDISKTLLNQSLSEWEKKGFQVSGSVCDASNRLERETLMQTVTTIFDGKLNILVNNVGTIRTKPTIEYEAEDFSFLISTNLESAYHLSQLSHPLLKASGNGIITFISSAAGIVSFDAASIYGLTKGALNQLARNLACEWAKDGIRANAVAPNFITTALAKPFLEDAGFNEILSSRTPLGRAGEPREVASLVAFLCLPAASYITGQTICVDKMDKRWSLKGMTALVTGGASGIGYAIVEELAGFGARIHVCDISEAKLNQSLSEWEKKGFQVSGSVCDVASRPEREELMQTVSSQFDGKLNILVSNVGVIRSKPTTEYTEDDFAFHISSNVEAAYHFSQLSHPLLKASGYGSIIFVSSIAGVISFDAGSIYGLTKGALIQLAKNLACEWAKDGIRANAVAPNVINTPLSQSYLEDVSFKKALLSRTPLGRVGEPNEVASLVAFLCLPAASYITGQTICVDGGLTVNGFSYQPEV

SEQ ID NO: 14073 - protein, 322 aa, Triticum aestivum
MAKNSTATADAGDEIVHDFSPLLLVHRSGRLERPLAMPRVPAGHDAATGVVSKDVSLSPFSFVRLYLPPETGAGAGKKLPVLVYFHGGGFVIGSAASAAYHRCLNDLTAACAAVAVSVDYRLAPEHPLPAAYEDSLAALKWVLSTADPWLAERADLSRIFLAGDSAGGNICHHLAMHHDLRDAAGRLKGIVLIHPWFWGKEPIGEEPRPGRAEGVEQKGLWEFVCPDAADGADDPRMNPTAEGAPGLENLACEKVMVCVAEGDFLRWRGRAYADAAARARGPEPAVELFESDGVGHVFYLWEPATEKARELLERIVAFVRAE

SEQ ID NO: 14074 - protein, 629 aa, Poa pratensis
MARLRPFAGGAGSVAAVVVVFTGWLLAAGGVSAGDPPLSPKGLNYEVAALMAVKSRMRDEKGVMAGRDINSVDPCTWSMVTCSADQFVVSLQVANNGLSGALSPSIGNLSYLQTMLLQNNRISGDIPPEVGKLAKLKALDLSGNQFVGEIPNSLGQLTQLNYLRLDRNNLSGQIPVNVASLPGLTFLDISFNNLSGPVPKIYAHDYSLVGNKFLCNSSILHGCTDVKGGTHDTTSRPSAKAKNHHQLALAISLSVTCAIIFVLLFVCWLSYCRWRLPFASADQDLEMELGHLKHFSFHELQSATDNFNSKNILGQGGFGVVYRGCLRNGTLVAVKRLKDPDVTGEVQFQTEVELIGLAVHRNLLRLYGFCMTSKERLLVYPYMPNGSVADRLREYRHGKPSLDWSKRMRIAIGAARGLLYLHEQCNPKIIHRDVKAANILLDESFEAVVGDFGLAKLLDRQDSHVTTAVRGTIGHIAPEYLSTGQSSEKTDVYGFGILLLELITGPKTLSNGHGQSQKGMILDWVRELKEEKKLDKLVDRDLKDLFDIAELECSVDVIIQCTLTNPILRPKMSEVLQALESNVTLAENGIDLNREALPYGGSCSFSVRHEDPHDSSSFIIEPIELSGPR

SEQ ID NO: 14075 - protein, 398 aa, Burkholderia vietnamiensis G4
MNTTADSLVTLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRPVLVPSGPEACFQLTADDVRTRWGNRTRGVLLASPSNPTGTSLEPDELKRIVEAVRARGGFTIVDEIYQGLSYDAAPVSALSYGDDVVTVNSFSKYFSMTGWRLGWLVVPPALVGTFEKLSQNLFICPSALAQHAALACFEPATLDIYEARRLEFKRRRDFIAPALERLGFKVPVMPDGAFYVYAHCGGVAHPAAGDSAALTHAMLHDAGVVLVPGMDFGVHAPRDYIRLSYATAYSRLEEAVERLAKLFGHH

SEQ ID NO: 14076 - protein, 629 aa, Poa pratensis
MARLRPFAGGAGSVAAAVVVFTGWLLATGGVSAGDPPLSPKGLNYEVAALMAVKSRMRDEKGVMAGWDINSVDPCTWSMVTCSADQFVVSLQMANNGLAGALSPSIGNLSYLQTMLLQNNRISGDIPPEVGKLAKLKALDLSGNQFLGEIPNSLGQLTQLNYLRLDRNNLSGQIPINVASLPGLTFLDISFNNLSGPVPKIHAHDYSLVGNKFLCNSSVLHGCTDVKGGTHDTTSRPLAKAKNHHQLALAISLSVTCAIIFVLFFVFWLSYCRWRLPFASADQDLEMELGHLKHFSFHELQNATDNFNSKNILGQGGFGVVYRGCLRNGTLVAVKRLKDPDVTGEVQFQTEVELIGLAVHRNLLPLYGFCMTSKERLLVYPYMPNGSVADRLREYHHGKPSLDWSKRMRIAIGAARGLLYLHEQCNPKIIHRDVKAANILLDEGFEAVVGDFGLAKLLDRQDSHVTTAVRGTIGHIAPEYLSTGQSSEKTDVYGFGILLLELITGPKTLSNGHGQSQKGMILDWVRELKEEKKLDKLVDRDLKDLFDIAELECSVDVIIQCTLTSPILRPKMSEVLQALESNVMLAENGVDLNREALPYGGSCSFSVRHEDPHDSSSFIIEPIELSGPR

SEQ ID NO: 14077 - protein, 169 aa, Burkholderia vietnamiensis G4
MEIGQYQPNLEGDGLRIGIVQSRFNEPVCNGLADACVEELERLGVSGEDVLLVSVPGALEIPLALQKLAESGQFDALIALGAVIRGETYHFELVSNESGAGITRIGLDFNLPIANAVLTTENDEQAVARMTEKGRDAARVAVEMANLTMALDQLGDDEEEDEDDEEERA

SEQ ID NO: 14078 - protein, 554 aa, Ralstonia eutropha JMP134
MSQAIEIKVPDIGDYDAVPVIEVHVKPGDSINAEDALVTLESDKATMDVPSPQAGVVKEVRIKVGDNVSEGSVLVMLEAAGAAAPAPAPAVAAPAPAPAQAAAPAPAPAAAPAPAAAPAAGGTIEVKVPDIGDYDAVPVIEVHVKPGDTINPEDAVVTLESDKATMDVPSPQGGVVKEVKVKVGDNVSEGTLLILLEGAAGAAAPAPAAAAPAPAPAAAPAQAAAPAPVAAAPAPAAAASAPVGVTGKAAHASPSVRKFARELGVDVSRVPGTGPKNRITQEDVQRYVKGVMTGQAAAPAQAAAAGGGGGELGLLPWPKVDFTRFGEVESKALSRIKKISGANLHRNWVMIPHVTNHDEADITDLEAFRVQLNKENEKSGVKVTMLAFMIKATVAALKKFPNFNASLDGDNLVLKKYFNIGFAADTPNGLVVPVIKDADKKGVLEISQEMSELAKLARDGKLKPDQMQGGCFSISSLGGIGGTYFTPIINAPEVAIMGVCKSYMKPVWDGKQFAPRLTLPLSLSWDHRVIDGAEAARFNTYFGQLLADFRRILL

SEQ ID NO: 14079 - protein, 380 aa, Burkholderia vietnamiensis G4
MTLASTLDIIAELKAGRMVILVDEEDRENEGDLVIAAEFVTPEAINFMARYGRGLICLTLTQERCKQLHLPLMTYRNGTQYGTAFTVSIEAAEGVTTGISAADRAHTIATAVAHDVRPEHIVQPGHVFPIMAQPGGVLVRAGHTEAGCDFTALAGLTPAAVICEIIKDDGTMARLPDLLEFAKEHDLKIGTIADLIQYRSRTESIIERIAERTMQTAHGTFRAVLYRDQPSGSPHIALVRGAPAPDVDTPVRVHEPLSVLDLLETGISTHSWTLDAAMREIAERDLGVIVLLNCGDTKEHLIDVFKAFDEEQKAAALKRRPVDFKTFGIGAQILRDVGVGKMQVLSNPRKLGSMSGYGLEVTGFIPMPGDEAKSCPASNA

SEQ ID NO: 14080 - protein, 559 aa, Coccidioides immitis RS
MSKRGQIQKESQQQEMVQVDQIDRTGPPFWGSQSSSQRQSPNRIFDPNTVVGASYSHADLLKTISPHSRSHTPSRSPIPTRNPRNASDSKLANSNITSPRQPYRNLLPQAGELWNAHREHDDDDDGDNEDELAYDDDEDEFGLPSVTSLRKSKFQGLRRTQATESSFESQSGSHANGSSVLVPDLGGMRLRANSSDIAEERGTLAYPNAKSTEGKILRPQYKEILNDPANSLHLINHSPPPSGATPKQLEAHSARISRINKFKRILQSSTVSLPELRDLAWSGIPEEVRAMTWQLLLGYLPTNSERRVTTLERKRKEYLDGVQQAFERGHSTRNTSSSIPPPGTGRGLDEAIWHQISIDIPRTNPHIPLYGFEATQRSLERILYVWAIRHPASGYVQGINDLVTPFWQVFLSSYVTDFDIEEGMDPGQLPKQVLNAVEADSFWCLTKLLDGIQDNYIYAQPGIHRQVNALHDLTRRIDATLAKHLEKEGIEFMQFSFRWMNCLLMREISIKNTIRMWDTYMAEEQGFSRFHLYVCAAFLVKWSDQLLKMDFQVCYAIQS

SEQ ID NO: 14081 - protein, 280 aa, Zea mays
  misc_feature (80)..(80): Xaa can be any naturally occurring amino acid
QVCTKKQAGTGPEFPGWTGDKTRTKATGGLTGREPSSSSHASKRRRGLRGESMADRFIPNDFPDFVAEAEASDGGGAPPXGHRGLLSLPYTRLSDHFVRAARRLKDKVVEETWVKAGRKVTDYTLYTGSLGTALLLFKSFQVTGDRGDLALAADIVRACDDASRGLPFLTFICGRAGVCALGAVIAKHCDDQLRVTQYLSSFDEITITEKVPNELLYGRAGYLWACLFLNKHLSEKTIPLEHINSVAKDIINEGRGLASKGSSPLMYEWHGKKYWGAAHG

SEQ ID NO: 14082 - protein, 198 aa, Prochlorococcus marinus str. MIT 9301
MFLVIDNYDSFTYNLVQYLGELSVEHEITKELIVKRNDEINLEEIIKLNPGGILLSPGPGNPDQSGICLPILKKLSKNIPTLGVCLGHQALAQAFGGKVIVGKELMHGKTSKIFHNQKGLFKDIETPFVATRYHSLIVDSSSLPSCFDITATLEDSTIMAISHKEYKHLHGVQFHPESVLTQFGHKLISNFLKMAEQK

SEQ ID NO: 14083 - protein, 506 aa, Coccidioides immitis RS
MTGNIVDHAFKMFIGGLNWETTDQSLKDYFSQFGEVQECTVMRDGATGRSRGFGFLTFKDPKTVNTVMVKEHYLDGKIIDPKRAIPRDEQERTSKIFVGGVSQDANEQDFKKFFMQFGRVVDATLMIDKDTGRPRGFGFVTFDSEAAVEACLSQPLEILGKPIEVKKAQPRGNLRDEDDRRLRARGFQGDRFKDEKSGSTDVSQQGAQGQTNLANTMTPQMMAQYWQRMQQYFAMMQQQMALAAAQGQGMAGAAAMGGMNPAMAQQMQQLKQMQQMNPMAGGQPQGAAMNQPAQGAVPQGMQGMMNPMMMQQMQQMQQMQQLQQMQQMQNQPQGGPGYGGPGMGGQMSGAKPGNMNQGMTSGPGAMGGGNFSGPRGGPGYNAQEQLAFEQQKYEQQQQVRRVIDPRNYGGYQQGTTGNWDNGYEEQPNIPTGPQAGMGRGQPAGRGGMSPSPGLAPKQPQKIPTPQPQSSPPANAPTGPRNAGKPGANYRGGGRGVHRGFHPYARG

SEQ ID NO: 14084 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 14085 - protein, 153 aa, Streptococcus pneumoniae
EHFIRGQYRSGKIDGTKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 14086 - protein, 188 aa, marine gamma proteobacterium HTCC2080
MGFISDNVTLDNPAFIHESAWLYGKVYIGPDVSVWPNVVTRAEFLEIRIGARTNIQDFVMIHVGAMTPTIVGEDCSITHHATLHGCEIGDRCLIGINSTIMDGAKIGANSIVAGNSIVRENSVFPENSIIAGVPAKVVGTRDNGAANALNAAMYQRFAGSFADGRDRLDEGEVADIMALYKGEQPEES

SEQ ID NO: 14087 - protein, 424 aa, Parvularcula bermudensis HTCC2503
MKPKLLTTLPTTTRASLTADILAGITVALVALPLSIAIAIASGAAPETGLVTAIVAGFLISALGGSRVQIGGPTGAFIVVVAGVIAVHGYDGLVLATFMAGGILLIASVLRIGSLVEWVPEPVVDGFTVGIAIIIATSQLVDALGLTIQHVPAEFLAKLPVIWAARETLSLPALSITLLTSVLIISLRRLAPRLPGLIIAVALASIVAGGMNGIVQTPVETIVSRFGALASGLPAPHLPSFSMERVREMLPSALVIAFLAGIESLLSAVVADRMIGGKHRPNAEILAQGAANLGSALFGGLPATGAIARTATNVRSGGRTPIAGITHAVILLLIALFAAPIVGRLAMPALAALLILTAWNMSEPHRWPARLSKSRSDFALFALTLALTVLTDLTVAIAVGTGVGLALRLRRRNVSPTDWPTPKR

SEQ ID NO: 14088 - protein, 333 aa, Parvularcula bermudensis HTCC2503
MLVTGGAGFIGSHMVLALLDRGEKVVVVDDLSTGSRQLVPIAAPLVRATIADIGAMRQVIRDYGVTDVIHFAGSISVPESIRDPLDYYANNTVGTQRLAGICREMGVARLIFSSTAAVYAAAACDRGAPVAETAATDPASPYGRSKLMAEDILRDSASAYGLSVAVLRYFNVAGADPHARAGQINPNGTHLLKVALDAALGRRGSVSIYGTDYPTADGTGVRDYIHVSDLIEAHLLMLDHLRRHDGVHLYNCGYGQGVTVRQLIEAVEMVVGRPVPKIDAPRREGDLAQVVADASRLVADLGWRPRYDRVEHIVAHALQWEMAQERAHRTGWS

SEQ ID NO: 14089 - protein, 261 aa, Oryza latifolia
GVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNLLNERTLKGTFFGNYKPRTDLPNVVELYMKK

SEQ ID NO: 14090 - protein, 550 aa, Parvularcula bermudensis HTCC2503
MKASDLLVKCLENEGLKYIFGVPGEENADFMISLEGSSITFVMTRHEQGAAFMAEAYGRLTGEPAGCLSTLGPGATNLITGVADSNMDRAPMIVLTGQGATGRQHKESHQVMDVVRMFDPVTKWAHQIVDADTIPEIVRKAFRLAKEEKPGAVLIELPEDVAKRDATTAPLNVIRVRRPSIDDKTADYLYDELIKAKRPVILAGNGAIRRRASKQLRQFCEATGIGCLSTFMAKGAVDRHAPYSLFTLGLGSRDFVADAIDGADLVLVIGYDMVEYHPKLWNPWADKKVVHIDFIPAEVDRFYAPCLECVGDIAHTLWALNERIKTRGLPTYDLGYQANVRQRMIADFEAHKDDVGEGPIRPQKALWDLREVMGPEDVVLSGVGAHKMWTARYYQCDEPNTCLIPNGFCSMGQPLPGAVGARLSLPPERKIFGVVGDGDFMMNVQELETARRLNADINLMVWVDDGYGLIAWKQENEFHKHTDLSFGNPDWMKLAEAFDWHGQWVERPEDLKAALMAALNHQGPSFVALPIDYRENRKLTERLGEIEVQL

SEQ ID NO: 14091 - protein, 341 aa, Erythrobacter sp. NAP1
MNRNENVTDRVPVLVTGGAGYIGSHAVLALKDAGWPVAVIDNLTTGFRFAVPDGVAFYEGDIEDAELLGRIFEEQGTRAIMHFAGSIIVPESVEDPLKYYHNNTAKSRTLIEAAVKAGVPHFIFSSTAATYGVPEVSPVREDTPQSPINPYGWSKLMTEQMLTDTASAHTLNFCALRYFNVAGADPKARTGQSTAGATHLIKVAVEAALGKRDGVAVFGTDFDTPDGTGVRDYIHVSDLAAAHVLALEALMAQPERSLKMNCGYGRGFSVLEVLDAVDRVTNMTIDRRMEGRRAGDPASLISDPSRIRANLPWQPEHDDLDTIIAHALAWERKLSQLRGEG

SEQ ID NO: 14092 - protein, 272 aa, Parvularcula bermudensis HTCC2503
MNLTAMPNISPLLTIMIGAARAAARSLRRDYYEVEALQVRRKGASDFVTKADIAAEEIIVDALEKARPKYGIVREEGEDREGEDNSNRFIIDPLDGTTNFLHGLPQFAISIALERDREPFAGVVFCPILDELYYAERGFGAYLNDRRLRVSGRDDLTEALVGTGLPFKGKPGREQALIETDRVLSETAGIRRFGAASYDLCMTAAGKLDGYWERGLAPWDVAAGIVICREAGGEVSTIEDKGERAHLSGSILASNHHLHRDLRKTLLGERQA

SEQ ID NO: 14093 - protein, 259 aa, Rhodococcus erythropolis
MFNSIEGRSVVVTGGSKGIGLGMVRVFARAGANVLMTARDALTLERAAEGLNGLPGAVSTLQVDVTNPDSLAGMAEVAAERHGGIDVLCANAGIFPSKRLGEMTSEDMDSVFGVNVKGTIHAVQACMPWLETSGRGRVVVTSSITGPVTGYPGWSHYGASKAAQMGFIRTAAIELAPKRITINAVLPGNVITEGLDGLGQEYLDQMASSVPAGSLGSVEDIANAALFFALDEAAYITGQSLIVDGGQVLPESAMALGEL

SEQ ID NO: 14094 - protein, 327 aa, Saccharomyces cerevisiae
MSFRPGSRGGSRGGSRGGFGGRGGSRGGARGGSRGGFGGRGGSRGGARGGSRGGFGGRGGSRGGARGGSRGGRGGAAGGARGGAKVVIEPHRHAGVYIARGKEDLLVTKNMAPGESVYGEKRISVEEPSKEDGVPPTKVEYRVWNPFRSKLAAGIMGGLDELFIAPGKKVLYLGAASGTSVSHVSDVVGPEGVVYAVEFSHRPGRELISMAKKRPNIIPIIEDARHPQKYRMLIGMVDCVFADVAQPDQARIIALNSHMFLKDQGGVVISIKANCIDSTVDAETVFAREVQKLREERIKPLEQLTLEPYERDHCIVVGRYMRSGLKK

SEQ ID NO: 14095 - protein, 361 aa, Candidatus Hamiltonella defensa
ARGLSRDVVIIPTGAALLVTIDDSLLGSVVDPSGKIVAHLSEPTEIMHNPSIRAIDSPPPSYLHRLSIRDPFITGVKAIDGLITCGVGQRMGIFAAAGCGKTSLMHMLIEQADADVFVIGLVGERGREVTEFTEVLSKSGRAQKCIVVYATSDFSSLDRCNAALLATTIAEYFRDQGKKVVLFLDSITRYARALRDVALAAGEAPARRGYPASVFDSLPSILERPSNTKNGSITAFYTILLESDDEPDPISEEIRSILDGHIYLSKKLAIKNHYPAIDVLHSISRVSSQICDTNHLSMAGEFRNILAKIQELQMFVELGEYRQGENAENDRAIKKRPALLKWLQQSMNEHSSFEQTFQSFF

SEQ ID NO: 14096 - protein, 500 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNPRVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 14097 - protein, 317 aa, Bacillus licheniformis ATCC 14580
MKKPVYFNHDGGVDDLVSLFLLLQMENVKLIGTSVIPADCYLEPALSASRKIIDRFGSYQVETAASDSRGVHPFPKEWRMHAFYVDALPILNEKGEVRTPVSELPAHLHLIECVRQSPEPVTLLFTGPLTDLARALEEEPAIIKHIAKLVWMGGTFLEKGNVEEPEHDGTAEWNAFWDPYSVKTVFESDIQIEMVALESTNQVPLTNEIRSHWASLRKHIGIDFIGQCYAMCPPLVHNETNSTYYLWDVLTTLTLGTVDMTRSRSIKAVVHTQSPRQGTTEEHPDGRMVKVVDQVDRDQFFAYFEELMKRADRIPSL

SEQ ID NO: 14098 - protein, 258 aa, Synechococcus sp. WH 8102
MPQWISTPERGSLYQWLPRSLKSPRIPRYFYMSTKPLVISPSILSADFSRLGDEVKAVDEAGADWIHVDVMDGRFVPNITIGPLIVEALRPVTQKPLDVHLMIVEPEKYVPDFAKAGADIISVQVEACPHLHRNLAQIKDLGKLAGAVLNPSTRLDTLEYCLELCDLVLIMSVNPGFGGQSFIENQVQKISDLRRMCDERGLDPWIEVDGGVKAGNAWKVIEAGANAIVSGSGVFNQPDYAEAIKGIRNSSSKEAVLV

SEQ ID NO: 14099 - protein, 489 aa, Burkholderia vietnamiensis G4
MHTDSSFTFVLFGGTGDLSMRKILPALFEAHRGNMLAEGGRIVAVARHESDQAGYLEWVDTHVKPHAVKAAGKAFDESAWKSFLARIEYVKLDLGRAEDYVVLRDAVAPHAGIRVFYLATGPSLFVPICNALASVGLNEGARIVLEKPLGYDLRSSNAINDAVGEIFAEDQIYRIDHYLGKEPVQNLLALRFGNALFEPLWRREWVESIQITIAEELGVEARGDFYDNTGALRDMVQNHLLQLLSIVAMEPPHSMDSDSVRDEKLRVLRALKPIDPRDIGKVAVRGQYHAGVIKGAQVPAYATEPGVKPDSPTETFVALKVEIENWRWAGVPFFLRTGKRLADRVAEIVVNFRPVPHSALGAPALRPGSNRLVIRLQPNETIRLYCLAKQPGEGMNLASVHLDLAFDRFFKEGQMEAYQRLLLDVINGRLALFVRRDEQEAAWRWVEPILNEWARTLKPPKPYAAGTWGPAASSAMLAQHGTCWLEEEN

SEQ ID NO: 14100 - protein, 293 aa, Enterococcus faecalis V583
MTNFSQQHLPLVEKVMVDFIAEYTENERLKEAMLYSIHAGGKRLRPLLVLTTVAAFQKEMETQDYQVAASLEMIHTYSLIHDDLPAMDDDDLRRGKPTNHKVFGEATAILAGDGLLTGAFQLLSLSQLGLSEKVLLMQQLAKAAGNQGMVSGQMGDIEGEKVSLTLEELAAVHEKKTGALIEFALIAGGVLANQTEEVIGLLTQFAHHYGLAFQIRDDLLDATSTEADLGKKVGRDEALNKSTYPALLGIAGAKDALTHQLAEGSAVLEKIKANVPNFSEEHLANLLTQLQLR

SEQ ID NO: 14101 - protein, 210 aa, Triticum aestivum
  misc_feature (16)..(16): Xaa can be any naturally occurring amino acid
  misc_feature (42)..(42): Xaa can be any naturally occurring amino acid
MAPTVMASSATSVAPXQGLKSTAGLPVSRRSNGASLGSVSNXGRIRCMQVWPIEGIKKFETLSYLPPLSTEALLKQFDYLIRSKWVPCLEFSKVGFIFREHNASPGYYDGRYWTMWKLPMFGCTDATQVINEVEEVKKEYPDAYVRIIGFDNMRQVHCVSFIAFKPPGARSPPRPPQLTHDRPYIKCHCSFVNSDIALGFPSPFIFLICS

SEQ ID NO: 14102 - protein, 214 aa, Triticum aestivum
  misc_feature (55)..(55): Xaa can be any naturally occurring amino acid
SLSSCHRREPQKPPAPQPLASSERGGRRRKPPSPGGEMLFFALLVGPELDGLNQXLSPRGGCDDPSYPYYFKLRCESCGETSAKTTCVSLDEVVQLPTGKGTANLLQKCKLCSREGSVVMIPGQGTPLTAEQSQKGEMTCLMVFECRGYEPIEFAFGNGWKAESVHGTPFDIDLSEGEFDEYDEKGECPVALSRLQSTFKVPPPPAFHGKTRYV

SEQ ID NO: 14103 - protein, 711 aa, Escherichia coli
MCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQQQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 14104 - protein, 520 aa, Streptococcus pyogenes str. Manfredo
MTEISILNDVQKIIVLDYGSQYNQLIARRIREFGVFSELKSHKITAQELREINPIGIVLSGGPNSVYADNAFGIDPEIFELEIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 14105 - protein, 285 aa, Zea mays
  misc_feature (278)..(278): Xaa can be any naturally occurring amino acid
TRKLGPLEGYSRAAAAPLRRGGLAAARQPARSLAFAAGDARLAVHVASRCRQASSARGTRAMATMAKKSVGDLTEADLKGKRVFVRADLNVPLDENQNITDDTRIRAAIPTIQYLLGKGAKVILSSHLGRPKGFTPKFSLAPLVARLSELLGIQVQKADDVIGPEVEKLVAALPNGGVLLLENVRFYKEEEKNDPEFAQKLASVADLYVNDAFGTAHRAHASTEGVTKFLKPSVAGFLLQKELDYLVGAVSSPTRPFAAIVGGSKVSSKIGVIESLLXEKCDILL

SEQ ID NO: 14106 - protein, 402 aa, Prochlorococcus marinus str. MIT 9301
MSKLSLSSLDKTHLEGKKVLVRVDFNVPLNEDGQITDDTRIRAAIPTIEYLVNHSAKVILAAHFGRPKGQVNEKMRLTPVAARLSELLGQSVALTNSCIGDEAVAKSNSLSNRDVLLLENVRFFGEEEKNDLEFAQKLASHADMYVNDAFGAAHRAHASTQGVTNYLSPSVAGFLLEKELKYLQGAVDSPNRPLAAIVGGSKVSSKIGVLDSLLDKCDKIMIGGGMIFTFYKARGLDVGKSLVEEDKLELAKDLEAKAKAKGVELLLPTDVVLANEFSPDAESKISQIDSISGNWMGLDIGPDSIKVFQNALAECKTIIWNGPMGVFEFDKFADGTNAIATTLADLSAFSEVCTIIGGGDSVAAVEKAGLAEKMSHISTGGGASLELLEGKILPGVAALNDA

SEQ ID NO: 14107 - protein, 270 aa, Arabidopsis thaliana
  misc_feature (182)..(182): Xaa can be any naturally occurring amino acid
DHLQESFRGSELCILCDIEACVIYYGPDGELKTWPKEREKVEDIALRYSQLNEALRRKKSVTLYDFLNKKKDKTNLEKKAMITDNDDLKTCLKNVNVLKSPIADHYFNDQISQLIQSLEPHVSKVQERIRFVESQKHKETKLDHQSLASIYSLNQSLNPSQFTLFLYNHGDNTMSQTPVTAXNFNQDFSELLQESGLMKQELCGYDQNMFMNNNNFQHSFVSNTQDYSALQESVNNNYGLMPNVLCGYDQNLFTSDITNNNLLIDNSMYL

SEQ ID NO: 14108 - protein, 2906 aa, Haemophilus somnus 129PT
MNKIFKTKYDVTTGQTKVVSELANNRQVASRVEGAESQPKCGVFFGGMLGAFKVLPLALVMAGILGVNNVAYGDYKEIKIDEDSGQVGTEDLEKDENVVLAKKSSLETNNGRQTKKTVVIGAGDVQAKYTNQFNWTFGVEKGVVIGYAAKARANESIAIGAEAVAGDNENAKGSTAVGYLAKAKGSDSVAVGKNAESVSKGTSIGASSKVIGEQGTALGNNVYAAGQGTALGSDVMAAGYGSIAIGNDDIVKNGYTDKLPEDTIFLIYGYKDNHNYGDDNKTYKDILTKEAFQRKYVKDGNKDNRIYSPTYAAGLGSIALGSRTVAFGQTSLAVGALSFALADDSTALGVRAFVDTKAKGGVAIGDESRVFAENSFAIGNRAESTSQGSLSFGSNAKAVGVGSIAIGPSVASNAKLAGTGDEDFARYIMEKTKTASPTVTISGATANIEYSSETDKKLKFGNHSHLVSKGFGSQNFKNGQKKGNPVTDIINEVIKLKEDKNNPIKYSYDTNNEKLETTEKIYTTEKEGEHAISLGYHLSNNGDNTITIGSASVVRGANSVVLGALNNIGKYATNTIALGIGTNVFKENSVAIGTGVNVAGAGVVAIGSGVGVTQDNTIAVGYGAYGLSAESIVLGNAAGLEENAKKSIVIGNKAKVINKKAEEAIAAAAAGQPTTRTTSTKINQDMSAISIGTGSYVYSEKGMAFGDAAKVENNAENAIAFGTSSKATKVSSIALGNEAHSTMLNSVALGYKSRTDYAHLDTAPYSPKGALTIPTSSNVGLISVGAQNYTRRIINVAAGSQDTDAVNVSQLKGLEEKVELLSGSIGDNSTPYFGVEQTNNSSEAKTISDGINKQKNYDRYVYLAGEYASLLNRQKNGGEVFNEKSLQEIQEEIDKIGTPEIKRKANQITRVLNELKSAPQNKNSMQLTQKSNQIERAITTDKVKKVNAISEDVVKKSNYKGNYAEGVDSIAIGYGAHTTSTANHAVALGYKAEAQKADSIALGSNSVADTAGDITGFDTVTGEVKKTADYGAWKSKYAALSIGKVSGNDKITRQITGVAAGSEDTDAVNLAQLKEATLHFVSVNGGSNTDKNYANNGAIGKNSIAIGVGVQSKSENSIVMGNNSTIETDISKSISIGVNNHIRAKKGNAREDLTNTVALGSDNIITGRKVVNLGSGNKIGNTGNDYQTDKHAGAVSIRLIGDDNIAHGVWNTVIGEGNKLESSSWAQVMGDYNAVTKSDYAIVISSNKANKKEPITTDTVTDSKYAIVIGNNAKATSAEKGVVIGQGASVTVANSVAIGSGSKTSGDITTMGYDPSTNTTYSSTNTDDDYKWKPTAGEFAVGDTTYTVEQGKGKNKQTVKKPQTRRITGVAAGIEDTDVVNVAQLKKILSDALAAKPNNNAGANPQTQAEVEAAKQGAVDAKNEAVTAKDEAEAAKQGAETAKNQAESFATQADTAKQGAETAKNQAESFATQADTAKQGAETAKNQAEDAKTAALDAKQGAENAKNQAETFATQANTAKQGALEAKDKAEQAKADAVAAKLGADAAQTLAVNAKDKALEAQGKAEAAQAAAQNSASQAQTAQNKAEAAKLGAEQAKAQADAAKNQAVLAQAGAEQAKQDALDAQGKAEQAKQGADAAKDEAVAAKTQAETFATQANTAKQGALEAKDKAEQAKGEAEAAKLGAEQAQTVAVDAKNKALEAQGKAEAAQAAAQNSASQAQTAQNKAEQAQVAAVAAQQGADTAKTQAEAARNEAVTAKNQAEDAKTAALEAQNKAEAAKLGAEQAKAQADVAKNQAESARDEAVVAKTQAEEFATKAQTAQAAAVNAQQGAVEAKNKAEQAKSQAETFATQANAAKDAALEAQAGANNAKQEAEAARYEAVMAKDDAVAAKRGAEAAQTAAQGSASQAEAAKTKAEEFATKAEQAKGEAEAAKLGAEQAQTVAVDAKNKALEAQGKAEQAQNKAEEAQGKAEAAKDEAVAAQQGAVTAKNQAETARDGAVDAKNKAEQAKSQAETFATQANAAKQDAVTAKNQAESARNEANAAKTAALDAKQGAENAKNQAETFATQANTAKQGALEAKDKAEQAKADAVAAKLGADAAQTLAVNAKDKALEAQGKAEAAQAAAQNSASQAQTAQNKAEQAQAAAVAAQQGADTAKTQAEAARNEAVTAKNQAEDAKTAALEAQNKAEAAKLGAEQAKAQADVAKNQAESARDEAVAAQTAAQGLASQAEAAKTQAETARDGAVDAKNKAEQAKSQAETFATQANAAKDAALEAQAGANAAQQGAESAKDDAVAAQKASEDARDKAEGFATKADDAKTKAVAAQGKAEDAQNKAEAAQAAAEDAKNKANQAKDDAVAAKLGAEAAQTVAVDAKNKALEAQGKAEQAQNKAEEAQGKAEAAKDESVAARDKALEAQKASEVARDEAEKILSKTEDIAANNPFEYYTKDGKDKVIKGRDGNLYKEDELANYQYDKTQKKYVAKDPSTKEDLKSLEAKDVLIKAVPNTIPMEITNVASGLGITTPTDDEKTQLNKLAEKVSEKVTALGKKTKDFSEKAEKFADLELMVDSLKQTLDTMPDGEAKEKIRENLEKYKTQLSDAQEAKKNAKEAVESARNELIEANGDYNAFSEAMAKVEELVEPDSQAELSNVATIGDLQAVAKSGLKFKGNDGVEVRKQLSETLEIKGEGEFNSDRTATGNIKVEMAQDGNGLEVKLSDQLKNMTSFETRKVDGKQSALDSNGLKVSNSKTEERSQLSENRLAFYENDKLGLNLDGKSRALKVGEKAIISINDKNEALVEDLNASSSSKAIANKNYVDTKNNELRTQLNTTDRNLRAGIAGALAAAGLPMSSVPGKSMFAASAGSYKGQSAVALGYSRVSDNGKITLRLQGTRSSTGDVGGSVGVGYQW

SEQ ID NO: 14109 - protein, 473 aa, Arabidopsis thaliana
  misc_feature (12)..(12): Xaa can be any naturally occurring amino acid
GSLPIIGNLHQXLGRLLHSSFHKLSLEHGPVMLLRFGVVPMVVISSKEAAKQVLKSRDLETCSRPKLVANGLFTRNFKDIAFAQYGEDWREMKKLVGLELFNPKKHKFFRYIREEEGDLLVKKLSKSSQTQTLVDLRKAFFSFTAGIIFRVSFGQNFRECDFIDMDRLEELVQESETNVFSFAFTDFFPTGLGWLVDRISGQHSRIEKAFSKLTKFFQHVIDEELKIGQSQDHSNLVSSMLDMINRSTEYGSFKITSDHLIAMMTDIVLGGVNAGTITMIWTMTELTRHPRVMKKLREEIRATLGPNKERITEEDLEKVEYLKLVIKETFRLHPPGPFLLPRQVMSDIEIQGYHIPKNAHIKISTYAIGRDPKCWTNPEEFNPERFANTSINYKGQHYELLPFGAGRRSCPGMTLGITILELGLLNILYYFDWSLPNGMTIKDIDMEEDGALTIAKKVPLELIPTLPASLCIK

SEQ ID NO: 14110 - protein, 174 aa, Zea mays
  misc_feature (70)..(70): Xaa can be any naturally occurring amino acid
  misc_feature (78)..(78): Xaa can be any naturally occurring amino acid
LNFKNQPNDGVHVLSAQHLGDLYRDFVKDFPIVSIEDPFDQDDGSSWASLQSSVGIQIVGDDLLVNNPKXRIADAIDXKACNALLLKVNQIGTVTESIQAALDSKAAGWGVMVSHRSGETEDNFIADLAVGLASGQIKTGAPCRSERLAKYNQLLRIEEGLGNVRYAGEAFSSP

SEQ ID NO: 14111 - protein, 327 aa, Pseudomonas fluorescens PfO-1
MLFAISALASTLAAQATSRTEPKPDWSTQDMPSQNGRIVLVTGGTSGMGYEDALALTRAGAEVIIAARNAERGREAIANIRQAVPEARVQFETLDLANLQSVRDLANRLQGRLPRLDVLINNAAIMSPPVRGVSADGYEMQLATNYLGHFALTGLLMPLLRKSDDGRVVSLSSIAAGRAVLNFDDLQAERAYDPFTTYSQSKLAVLKWSIELQQRSDAAGWGIRSIAAHPGVAVTELIARGPGLDSEFGKQWAVERDMYHSAAQGALPTLYAATAPEAVGGAYYGPTGDNEKRGPLGFAKMPPAAADRSNSDALWQLSERLTGVTYR

SEQ ID NO: 14112 - protein, 110 aa, Zea mays
  misc_feature (47)..(47): Xaa can be any naturally occurring amino acid
  misc_feature (55)..(55): Xaa can be any naturally occurring amino acid
MITLNYVPFIFLQISQQVCGDALGEEFKGYVFKIMGGCDKQGFPMKXGVLTSDRXVRLLLARGTPCFRGYGRRNGERRRKSRRGCIESQHLCVINLVIVNKGEIDLPGFK

SEQ ID NO: 14113 - protein, 295 aa, Shewanella oneidensis MR-1
MSAKHPIIAVTGSSGAGTTTTTTAFSHIFRQLGINAAFVEGDSFHHYTRAEMEVMIRKSQAENRNLSYFGPEANNFARLEQCFRDYGATGQGETRSYLHTFDEAVPFNQMPGTFTQWRPLPENTDMLYYEGLHGGVVTGDANVAQHVDLLIGMVPIVNLEWIQKIIRDTSERGHSREKVMGSIVRSMDDYIKHMTPQFSRTHINFQRVPTVDTSNPFSAKDIPSLDESFVVIRFRGINNVDFPYYLSMIQGSFMSRVNTLVVPGGKMSLAMELILTPLIKDLMEKRQQLNSPQAN

SEQ ID NO: 14114 - protein, 181 aa, Parvularcula bermudensis HTCC2503
MLGIGDKLPEFKVVGVKPGFNNIEEGGESAFEDLTQDSFSGKWKVIYFYPKDFTFVCPTEIAEFGRLAKEFEDRDAVVLGGSTDNEFCKLAWRRDHPDLDKHPAWQFADTLGHLVDGLGIRSDEGVALRATFIVDPHNVIQHVYVNNLSVGRNPQDTLRVLDALQTDELCPCNRPLGGDTL

SEQ ID NO: 14115 - protein, 369 aa, Ostreococcus tauri
MDAMSISVRATREEVSPSSSASRAVSPDNTTRGRVIFITRDSWTTPSRGARRSGRPRRRDIGGAREDGARPHGRTRGRERGVGDARDDDFVYRKSLEGKERELYEKKRTIRQCLEDGKPIPTELRRDEARLREEVHAEDVHTARYGARGVVDDEYAKAAESEPRVLLTTSRDPSSRLQQFAKELKLLFPTSQRINRGSQILPDLVDLCRNGGFTDLVMVHEHRGEPDGLVISHLPFGPTCYFGISNTVMRHDIKDQDLGHVSEVFPHLILENFTTPLGQRTATVLKHLFPEPKAKSKRVVTFANDADYISLRHHTYEMPKGAKSVALTEIGPRFEMRLYQIKLGTAEQDDCDIEWSLRPFMRSGKKARL

SEQ ID NO: 14116 - protein, 432 aa, Synechococcus sp. WH 8102
MHIAVVGLSHRTAPVEIRERLSIPEQTMETSLQSLRGHEQVLEASILSTCNRLEIYTLVRHPDLGVSAVSEFLSGHSGLATGELTPHLFNYHHEDAVDHLMRVAAGLDSLVLGEGQILSQVKKMMRLGQEHKSLGPILNRLLTQAVSTGKRVRSETNLGTGAVSISSAAVELAQLKLGQSRGLDQLVTLESEQIAVVGAGRMSRLLLQHLQAKGASGVVLLNRTVQRAELLAADFPDLPVQCRPLTDLDQCLSTCSLVFTSTAADDPIIDAARLEPLNRRSKLRLIDIGVPRNIAADAAAVDGVESHDVDDLQEVVARNQEARQAMAREAEQLLQQEAQQFLEWWDSLEAVPTINRLRSSMETIRVEELQKALSRMGPDFSARERKVVEALSKGIINKILHTPVTSLRAPQGRQERQQALRTVERLFSLGDD

SEQ ID NO: 14117 - protein, 431 aa, Synechococcus sp. WH 8102
MKRVLAIILGGGAGTRLYPLTKMRAKPAVPLAGKYRLIDIPISNCINSNINKMYVMTQFNSASLNRHLSQTFNLSASFGQGFVEVLAAQQTPDSPSWFEGTADAVRKYQWLFQEWDVDEYLILSGDQLYRMDYSLFVEHHRSTGADLTVAALPVDPKQAEAFGLMRTDGDGDIKEFREKPKGDSLLEMAVDTSRFGLSANSAKERPYLASMGIYVFSRDTLFDLLDSNPGYKDFGKEVIPEALKRGDKLKSYVFDDYWEDIGTIGAFYEANLALTQQPTPPFSFYDEKFPIYTRPRYLPPSKLVDAQITNSIVGEGSILKSCSIHHCVLGVRSRIETDVVLQDTLVMGADFFESSDERAVLRERGGIPVGVGQGTTVKRAILDKNARIGSNVTIVNKDHVEEADRSDQGFYIRNGIVVVVKNATIQDGTVI

SEQ ID NO: 14118 - protein, 390 aa, Parvularcula bermudensis HTCC2503
MRKRSLDDFHQTRRLPPYVFAQVAEMVKAARAAGRDIIDLSMGSPDMQAAPQVIETLRERVYDEDASRYSDSRGILPLRQACADYYDQRFGVALNPDTQVVATLGSKNAFANLAFAITAPGDLICCPNPSYPIHMFGFVMAGGSVRHLPAEPSEEVFRAAERTIRFSVPKPIALILNYPSNPTTITAEIGFYEEAVRFAKKHDLFLLSDLAYAEVYEGTPPPSLLQVEGAMDISVEFTSASKSFNMAGWRMGFAVGNEDLIAALTRVKSYLDYGSFGPIQQACTVALQDWQSITDDVRAHYRSRRRALHKAAEEAGWHIPRSETTMFAWTPLPKGETDSLAFCRRMVAEAGVALSPGVGFGEGGEGHVRIALVADEARLAEAAQRVGRAL

SEQ ID NO: 14119 - protein, 242 aa, Yarrowia lipolytica CLIB122
MKLNIAYPAQGTQKCIDIEDEHRVRGFYEKRMGQEVEADFLGDEFKGYVLKITGGNDKQGFPMKQGVMHPTRVRLLLSKDSSCYRSRRAGERKRKSVRGCIVSSDLSVLSVVIVKQGDADIEGLTTETVPRRLGPKRANNIRKLFALSKEDDVRQYVIRREVTTKSGKTYTKAPKIQRLITPRRLAHKAQLREKKVKAIQASKDAAAEYAQLLAKRVAEKKSEKAEEKKRRASSLRTQSVQA

SEQ ID NO: 14120 - protein, 472 aa, Synechococcus sp. WH 8102
MSQSHFGLIGLGVMGENLVLNAERNGFSSVVYNRTYAKTEEFLNGRGQGRNIQGATDLQDFVGKLERPRRILMMVKAGPAVDAVVDQISPYLEEGDLLIDGGNSDYHDTERRVKELESKSFGFIGMGVSGGAKGALEGPSMMPGGTKASYDAIESLVNKMAAQVDDGPCVTYIGPGGSGHLVKTVHNGIEYGIEQILAEGYDLMKRVKGMNGEQMADVLAQWNATEELSSYLVEITEVCLRTKDPEDGADLVEKIMDQAGQKGTGLWTVVTALQMGASVPTIYASLNGRVMSSLKPERVAAESILKGPVIKDFDLGTPDDAMAPLMDATVLSCIASYAQGMELLRIASRDLDYSLQMPSIAQIWKGGCIIRARLLQRIQDAFAANPDLTNLMLDPWFADQINRRLPGLAKVVAGAAESGIPVPCFSSTLDYINSYRTGRLPQNLVQAMRDCFGSHTYQRVDKEGAFHTEWLG

SEQ ID NO: 14121 - protein, 261 aa, Oryza latifolia
GVTDLAPGDHVLPVFTGECKECPHCKSAESNMCDLLRISTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNLLNERTLKGTFFGNYKPRTDLPNVVELYMKK

SEQ ID NO: 14122 - protein, 305 aa, Parvularcula bermudensis HTCC2503
MPPIERIPLPLPAPEDVVVAEGGQVYTALRDDGVLVELPSGGSSARVCAEIGGRGLGVELYGDGRLLVCNATMGLQAVDPVTGRVESLLSQIDGRPIGVCNNASVGRDGTVYFSESSRVHPLDHYRRDLIENTRSGQLLRWRPGTAPEPLLSGIAFANGVVLSPEEDFVLLAETGLCQIHRYWLSGPRAGQADLFAALPGFPDNLSLGTDGLFWAAIAAPRVATAEAIHKLPRPLRALIARLPESLGPQAEKTCEVMAFDGEGQVVHHLRGDASRFHQVSGVREHNGVLWLGSIEEEALGRVVLR

SEQ ID NO: 14123 - protein, 261 aa, Oryza australiensis
GVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 14124 - protein, 514 aa, Zea mays
  misc_feature (110)..(110): Xaa can be any naturally occurring amino acid
  misc_feature (197)..(197): Xaa can be any naturally occurring amino acid
MERRRRRRRPPRLPLLVFVLVATTCPLGSSGIGSFGVGAESNGASSSFRTRSLLQIGDRNEDGLFHLPHTRALTHKSRSHRKVPTPAPAPASAPAPSPSMSPPDSSPSPXSPHGSHPMPRQSTPHRHPSITPPHLVRPVPRQDGNDPLVDTPAHSRHKHFWTTYGLVAAGIAVFLLVSAASILCFRAKKMGTVRPWXATGLSGQLQKAFVTGVPSLKRSELETACEDFSNIIGSTSTCMLYKGTLSSGVEIAVASSLVTSAKDWSKENESQYRKKITNLSKVSHKNFMNLLGYCEEEHPFTRVMVFEYAPNGTLFEHLHVREAEKLDWMARLRISMGIAYCLEHMHQLQTPAALRNFDSTTVYLTDDFAAKVSDLEFWNDAKGHNSTTNNELAFSPDMEDIVRKYGMVLLEILTGRVPSSEDDGPLENWVSRYFEGGMRLEELIDPSIGFFPEDTARALCEVVRSCIDRDPKKRPQMKEVAARMREITALGPDGATPKVSPLWWAELEIMTSES

SEQ ID NO: 14125 - protein, 621 aa, Photobacterium phosphoreum
MTLDISKYPHLALANTPDELRLLPAESLPQVCDELRTYLLKTVSQTSGHFASGLGTVELTVALHYVYNTPFDHVIWDVGHQAYPHKILTGRRDQMSTIRQKGGLHPFPWRGESEYDVLSVGHSSTSISAGLGMAIAAEKEALGRKVVSVIGDGAITAGMAFEAMNHAGDIHSDMLVILNDNEMSISENVGGLSNHLAHLLAGNFYASIREGGKKVLSNAPPIKEIVKRAEEHIKGMVVPSTMFEELGFNYIGPIDGHDIDELVKTLKNMRHLKGPQFLHIMTKKGKGYAPAEADPINYHAVPKFDLSEKPLPKAKNTSPTFSKIFGDWLCDMAAVDDKLMAITPAMREGSGMVRFSKEYPDQYFDVAIAEQHAVTLASGMAIGGYHPIVAIYSTFLQRGYDQLIHDVAIMNLPVMFAIDRAGLVGADGQTHQGAFDISFMRCIPNMVIMAPSDENECRQMLYTGHQHQGPTAVRYPRGCGLGTEVEDTMTALEIGKGIVRRQGEKVAILNFGAMLGYSLDAAENLNATVADMRFVKPLDEALILELAANHDVLVTVEENAIAGGAGSGVIEFLMQQKCIKPVLTIGLPDRFIEQGTQAELHQMLEIDGPGIEKQILEYLAK

SEQ ID NO: 14126 - protein, 322 aa, Bradyrhizobium sp. BTAi1
METAAATPRPGRGRVFDSIVDAFGNTPIVRLRKLPEQHGVKATILAKLEYFNPAASVKDRIGVGMILAMEQAGVIKPDTVLIEPTSGNTGIALAFVAAARGYKLKLVMPESMSIERRKMLAFLGAEIVLTPAAQGMKGAIAAAEELLRTTPNSVMPQQFKNLANPEIHRRTTAEEIWNDTAGNIDVFVAGVGTGGTITGVGQVLKSRKPGLKVVAVEPEESPVLSGGQHSPHKIQGIGAGFVPDILDRSVIDEIVKINSTTAIETSRALARNEGIPGGISSGAAIAAAIELGKRPENAGKTILAIVPSFSERYLSTALFEGI

SEQ ID NO: 14127 - protein, 797 aa, Oryza sativa Indica Group
MLSVHVFIGLLLLSLHAPPYSAAVDDTLAAGQVLAVGEKLVSRNGKFALGFFQPSAIAISKSSNYTNALGWYLAIWFNKIPVFTTVWVANRERPITVPRLNSTWLKMSGDGNLYILDHATNSIIWSTDHVVNTTTETGMNTSATLLNSGNLVIRNPSGVVSWQSFDNPTDVVLPGAKFGWNKATGLNRLGISKKSLIDPGLGSYSVELDTTGARGLILKHRNPSMEYWSSDRALIIPVLKSLFEMDPRTRGLITPAYVDNSEEEYYIYTMSDESSSVFVSLDVNGQIKMYVWSRANQSWQSIYAQPVDPCTPSATCGPFTICNGNSTQTCDCMESFSVKSLWDWELDDRTGGCIRDTPLHCVSDKNMTSSTDMFQPIGLVTLPYDPQIMQDATTQGECAQACLSDCSCTAYSYQNSRCSVWHGKLLNVNKNDGIYINADNVLHLRLAATDFQDLSKNKRKTNVELVVGASIVSFVLALIMILLMIRGNKFKCCGAPFHDNEGRGGIIAFRYTDLAHATKNFSEKLGAGGFGSVFKGVLTDMATIAVKKLDGAHQGEKQFRAEVSSIGIIQHINLVKLIGYCCEGDKRLLVYEHMLNGSLDVHLFQSHAAVLNWITMHQIAIGVARGLSYLHESCRECIIHCDIKPENILLDISYFPKLADFGMATFVGRDFSRVLTTFRGTVGFGMVLFEIISGRRNSPEVHTSGNYDATYFPVRAINKLHEGDMSSLVDPRLHGDYNLDEVVRVCKVACWCIQDDEFDRPTMREVVRVLEGLQELDMPPMPRLLATLTNFSAVASM

SEQ ID NO: 14128 - protein, 485 aa, Bacillus licheniformis ATCC 14580
MIQITDLNRQYIGGEWRDGQSESVLADLNPFTHKTIASFRKATREDVDAAYKAALEAKKKWDGVNPYEKRAILEKAAAYIEDNREAIVFLIMEELGGTRLKAAFEIDLVVNMIKEAAGFPLKMEGKILPSPVDGKENRIYRIPAGVVGVISPFNFPFFLSVKSVAPALGAGNGVVLKPHEETPICGGTLIAKIFEEAGLPKGLLNVVVTDIGEIGDSFVEHPIPRIISFTGSTKVGSYIGQLAIKHFKKPLLELGGNSALIVLEDADLEYAVNAATFSRFTHQGQICMSANRILVQKEVYPEFLKLFSQKVSGLKTGDPLDPETVIGPVINERQAEHLRKSIEKGIEEGATPLLKGDIKGNLVEPTILADVTPDMSVAKEELFGPVVCVMPFETEADAVEIANDTPFGLSGAVHTGNVESGVAIAKQIETGMIHVNDTTINDEPHVAFGGEKQSGIGRLNGEWSLDEFTTLKWISVQHQKRSFPY

SEQ ID NO: 14129 - protein, 401 aa, Marinobacter sp. ELB17
MNRKLQAVLVAVVIAASGAFYAAFASAEKNTVVGNPYAPTDSNLAVATVAGGCFWCVEAGYEKIPGVVEAVSGYAGGETPNPTYRSVSSGGTGYTEAVQVYYDPQQITYEGLLQGLWRMMDPTDDQGQFVDRGTHYRPAIFYHSQEEKQKAEAAKKALQESGVYDNPVVIEIVPAGTFYPAEDYHQDYYKKNPVRYKLYTFNSGRYQFIESVYGKDYELDFSQFKPAANSSGNAGADQNAEQASGASAGFNPEAFVKPPQDELKKLLSSIQYNVTQKDGTESPFNNAYWDNKEPGLYVDVVSGEPLFSSRDQYKSGTGWPSFTRPLDPGMVKEHEDRAFFMTRVEIRSSYADSHLGHVFDDGPAPTGKRYCMNSASMRFIPLAQMADAGYGDFIDAVESVN

SEQ ID NO: 14130 - protein, 191 aa, Glycine max
MTTSLLLPSPSCAAILSKGTNRICTRASFHSLKSHVKKGFRVRALKEKTEEIESPSQPSSPEEVTKKYGLEAGLWQIFSSKEEGKDNSQQKSKGDQAKELLAKYGGAYLATSITLSLISFALCYALISAGIDVQALLQKVGISTDATGEKVGTFALAYAAHKAASPIRFPPTVALTPIVAGWIGKKVEKDK

SEQ ID NO: 14131 - protein, 137 aa, Oryza sativa
  misc_feature (21)..(21): Xaa can be any naturally occurring amino acid
  misc_feature (52)..(52): Xaa can be any naturally occurring amino acid
  misc_feature (109)..(109): Xaa can be any naturally occurring amino acid
VQRGLNGEVFGRLENKGFCLXASKLITVEKSFPEKHYPYLSSKTFFGGFVKXMVSGPVVPMVWKGKKVVSSGRKLVGTTNPLGAEPGTILGELAVDIGRKVIHGRFSVXNASKKTALWFLKGIAEWRSKQHPWIYEV

SEQ ID NO: 14132 - protein, 311 aa, Yersinia pestis KIM
MGRWWRYKWITFHPSLTTTDGQAGPQGKGGFNAEAHRYHLYVSLACPWAHRALLMRTLKGLESLISVSVVHPLMQENGWTFSSDFPAATGDALYHLDYLYQLYLRAAPDYSGRVTVPVLWDKQQQTVVSNESADIIRMFNNAFDDVGAKAGDYYPTALRNDIDDINGWVYDQVNNGVYKAGFATTQEAYDEAVGTLFSALDRLEQILGQHRYLTGNQLTEADLRLWTTLVRFDPVYVTHFKCDKRRISDYPNLYGFLRDIYQMPGIAETVDFAHIRTHYYRSHGTINPYGIISIGPQQNLLEPHDRANRFV

SEQ ID NO: 14133 - protein, 359 aa, Hordeum vulgare
MARVPLLAALVVAMAVLVASSLGPRASAAEPPVAPGLSFDFYRRTCPRAESIVREFVQEAVRKDIGLAAGLLRLHFHDCFVQGCDASVLLDGSATGPGEQQAPPNLTLRPSAFKAVNDIRDRLERECRGAVVSCSDILALAARDSVVVSGGPDYRVPLGRRDSRSFASTQDVLSDLPGPSSNVQSLLALLGRLGLDATDLVTISGGHTIGLAHCSSFEDRLFPRPDPTISPTFLSRLKRTCPVKGTDRRTVLDVRTPNVFDNKYYIDLVNREGLFVSDQDLFTNAITRPIVERFARSQQDFFEQFGVSIGKMGQMRVRTSDQGEVRRNCSVRNPGPGADALQWPSLVQTIVDEAAGSIG

SEQ ID NO: 14134 - protein, 353 aa, Parvularcula bermudensis HTCC2503
MSRTVRLTILPGDGIGPEVTDAAISVLTAVAPDAGLSLAIDRCPFGGAGIDATGNPLPEQTLKSCVSADAILLGAVGGPKYDEAARHQGAPRPEQGLLGLRKELELFANLRPSKLFEGLEAASPLRRDIVADTDILIVRELTGGVYFGDHREGTDVASDIMPYSREEVDRVARVAFEAAKGRNGRLTSVDKANVLATSRLWRAVVDDVAKDYPTVTVDHVLVDAMAMHLVTKPASFDVVVTENLFGDILSDELSAIVGSIGLAPSASLGTPDTPGLFEPIHGSAPDIAGQGIANPIGTILSAAMLLRHGLKADAAAERIETAVSTVLKQGLRTKDLGGDADTAAATSAILAAL

SEQ ID NO: 14135 - protein, 392 aa, Rhizopus niveus
MVSFISISQGVSLCLLVSSMMLGSSAVPVSGKSGSSNTAVSASDNAALPPLISSRCAPPSNKGSKSDLQAEPYNMQKNTEWYESHGGNLTSIGKRDDNLVGGMTLDLPSDAPPISLSSSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSILDHLSYFDINEGSCL

SEQ ID NO: 14136 - protein, 430 aa, Prochlorococcus marinus str. MIT 9301
MKETIEFLIDTVEARQVLDSRGNPTVEAEVFLECGASGRAIVPSGASTGAHEAHELRDGGSKYMGKGVLNAVNKIHETISPALCGLSSLDQIAVDKLMIEIDGTPNKSNLGANSILAVSLATARASANALDIPLYRYLGDPLSNLLPVPLMNVINGGAHAPNSLDFQEFMLVPHGVNNFSESLRMGTEIFHSLKSLLDQKGLSTAVGDEGGFAPNLSSSEEAGDLLLEAIQKAGFKPGEQVSLALDAASTEFYSDGIYKYEGKSLNSSEMISYLSRLVSNYPIVSIEDGLAEDDWEGWSELNKELGNKVQLVGDDLFVTNTERLRKGIMEKSANSILIKVNQIGTLTETLEAIELAKMSGFTSVISHRSGETEDTTIADLSVATRSGQIKTGSLSRSERIAKYNRLLKIEEELGNQARFAGALGLGPKNI

SEQ ID NO: 14137 - protein, 637 aa, Shewanella oneidensis MR-1
MISINQAQLIRGSKTLLDEASLTIYPGHKVGLVGANGTGKSSLLALIMGHLSLDKGEFSMPSGWQIASVAQETPALDMSALEYVLDGDKEYRQLEADLHIAQEHNDGHAIATLHGKIDAIGGYAIRARAGALLAGLGFSEAEQNNPVKSFSGGWRMRLNLAQALLCRSDLLLLDEPTNHLDLDTMYWLEGWIKSYQGTLILISHDRDFIDEIVDEIVHVENQKLNFYKGNYSAFERIRAERMAQQQVAFERQQKERAHMQSFVDRFRYKASKAKQAQSRLKALERMTELLPSQADSPFYMEFRPPEALPNPLIKMEQVAVGYGDKQILSKVHLNLVPGARIGLLGRNGAGKSTLIKLLSGQLSPMTGLYEPNPGLNIGYFAQHQIEFLRLDDTPLQHLVRLAPNAREQELRNFLGGFGFNGDMALSPVRPFSGGEKARLVLALLVWQRPNLLLLDEPTNHLDLEMRHALTMALQTFEGAMVIVSHDRHLLRLTCSDYYLVDQGEVQAFDGDLDDYHQWLLDAAKAASANQAANSDDTKPAVDKKQQKRLEAELRQKVSPLKRKQAKLEIDQQKLSERLAELEHLLADGELYDQDNKAKLTSVLSERTSLTQTLEESEMQWLELQEEIDTMELELMGQ

SEQ ID NO: 14138 - protein, 438 aa, Pseudomonas fluorescens PfO-1
MMTLPSKTSLRRAVTGPMLFLFILGDVLGAGVYALAGTIAGEVGGAIWMPLLIALFFAMLTAGSYAELVTKYPHAGAASVFAEKAFGSPLISFLVGFCMLSAAVTSAAGLSLAFAGDYLAAFIHVPPHISALLFLLVIALLNARGIKESLGANLVMTVIELSGLLLVVVAAAWYFRTGDADLGRSLEFKPGVSPVLAVLGAALIAFYSFVGFETSANLAEEIRDVRKVYPRALFGALLTAGVLYMAVGVAASSVLPMEKLVATSAPLLEVVRASGLNIPPRVFAFIALVAVANGALLTMIMASRLTYGMACLGLLPNALSKVLPQRRTPWIAVIATTLVAIGLTLTGTLATLAETVVLLLLFVFLSTNLSVLILRRDEVAQDHFRVPTWVPLLAIVSCLVLLSQQSLETWMRGGALILTGMLLFACARVALPAPVEPG

SEQ ID NO: 14139 - protein, 349 aa, Shewanella oneidensis MR-1
MPAEWAAQQAVWMIWPYRPDNWRAAGAYAQATFAKVVDAIGAATPVYMGVPKAFLAKAKTVMPSHVTLVEMDSNDCWARDTGPTVVVNAEGECRGVDWGFNAWGGHNGGLYFPWDKDEQVAQQMLAQHGFARYRAPLILEGGSIHVDGEGTCMTSAECLLNANRNPELTKEQIEGLLRDYLNVKQFIWLQDGVYMDETDGHIDNMCCFARPGEVILHWTDDESDPQYPRSKAALEVLQNTVDAQGRKLKIHLLPQPGPLYCSEEESKGVTEGTGVPRTAGERLAGSYVNFLITNHRIVFPLLDPATDDIAAQKLQEIFPEHEIVGVPAREILLGGGNIHCITQQIPAGK

SEQ ID NO: 14140 - protein, 753 aa, Vitis vinifera
MVVVGEDDMPSEGGTVKQMVACCVITCLSRLGDFIHVSYGYGVQGGFRFGLYEYFKKLYSDMPVDRNRSFIFFAHSASAEVLANVALCPLKLLKSRFKSSPIFAKSLLDGFPKLYASEGPYGFYRGFVPLWGRNLLFSMIMLSTFEHSVDFLYRNVIHRRKEDCSRSIASLITNPAVGTNIGDRAAPVAAMVGMNSDNRSLIGGCSGQPPYFSSGYLQQPVPYETEAVPCYSWDLTYVGDATNGTMHPLILSVRSGAAISMPGMMDTILNLGLNDEVVAGLAAKNGRRFVYDSYRRCLDMFGDVVMGIPRSSFEEKLEKLKDALGVIWGALLGACRVHGNIDMLRFAVKKYFDLEPENAGKYFVLSNAYATFGLWDNVVEVRGAMRESRMRNELGYSRIEVQREVHFFLMGDKSHKQTEQIYEAAWIVDDTDVDDSYRSDNGDTDDGMVLVHMASLGNNSEKACSDSTSTPAPSAVSQNFRLIYYHCNALLYLCTISVDEPSSKALALDYGFRIFDHVVNSGVTPNEATITAVASLATAKSDGDLAFEVVRTMVNYELSPRLRTYGPALFWFCTNLEGEKAWRSRSWPAVKVSAEMGRGDKVYAYLHKLRTAVRSVSESTAEIIEGWFCGEATSEVGGADCCLGAIEEVALKNGGGWHGQGWIGKGKWVVCRAKVDSSGQCGSCREQLATVDIDRAETETFSESVAAMAMEREVRSNFREFQDWLDKHADYEAIVDGANIGLYQQNFASGCPT

SEQ ID NO: 14141 - protein, 278 aa, Triticum aestivum
MRPSRDLRLAVLLLFSAAVLLSAVPAARAQQETEEEEEFSYSLDAENGPAHWGDIKEEWSACGKGNMQSPIDLASPRVSLVRGLGYLNHSYSPANATIINRGHDIMLKFEGDAGSVSIGGTPYFLRQLHWHSPTEHSVNGRRYDMELHMFHESAQGKAAVIGVFYEIGAHDAFLHKLEPYLEMIADRKDREEKMGMMDPRGARGKASVYYRYVGSLTTPPCSEGVIWTIVKRVRTVSRHQLELLREAVHDDMEKNARPRQEVNSRDISMFRPFEQNRH

SEQ ID NO: 14142 - protein, 428 aa, Parvularcula bermudensis HTCC2503
MPLSSDPEPAVRGEAAAPSPRAAFSLSDQEWRAIVDKTDPAWQEIRETPCLPSRKLGALTNCRLWLKYENLQYIGAFKERGALAKLLSLSDAERQSGVVAASAGNHAQGLARHAELLGIRATIVMPAQTPSVKVEETKRFGAEVILHGTDFEAAHAEAIRQVEEEGKTLVHPFDDPYVAAGQGTIAKEMLCEAPEIDTLVIPIGGGGLIAGMAAVAKEMRPDIRIIGVQAALYPGMANAVRNESAPCGGMTLAEGIAVCDPGRFTREVVARLVDEIVTVDERALERSLSLLLMTQKTLAEGAGAAGLAALLAHPHLFEGHAVGTIVCGGNIDPRLLSSILMRDLARQRRLARLRVPLMDVPGQLTRVSAAIGAAGGNVIDVSYHKVFNDLPAKQTHLDISVEATGPAHMDRIVEALRAEGLEPEVANY

SEQ ID NO: 14143 - protein, 172 aa, Magnetospirillum magnetotacticum MS-1
MAAGLGSDLFRIKTLERLNADAEAGENKLERHLGPWSLVGLGIGAVIGAGLFSLTGIAAAEHAGPAVTLSFAIAAIGCALAGMCYSELAGMIPVAGSAYTYTYATMGEFVAWIIGWDLVLEYAVGAATVSVSCRATSPASCATPSASTCPVRWCIHPSRPTSSPTARGARLS

SEQ ID NO: 14144 - protein, 312 aa, Scenedesmus vacuolatus
NGFGRIGSLVLRATLDRKDVKVVAINDPFIEGEYMAYMFKYDSVHGRYEGDVQGDKHGITINGEQIKTLAMMDPTQIPWGEVGADYVVESTGVFTTVDKCQAHLKGGAKKVVISAPSADAPMFVMGVNADKYDPKQHTVVSNASCTTNCLAPLAKVVNDTFGIKEALMTTVHATTATQKTVDGPSKKDWRGGRGASANIIPSSTGAAKAVGKVIPELNGKLTGMAFRVPTQDVSVVDLTCILEKPAKYEDIMAALKAASEGPMKGILGYTEDDVVSSDFVSDPASSTVDAKAGIMLSPTFVKLVSWYDNEWG

SEQ ID NO: 14145 - protein, 308 aa, Glycine max
MENSYKANGNGPTENGYSVARHSYQPSLKGSLPWLDIRVFYVRVCKCELDDSTPGFLTLNHVPLNPDTLLEINGVRTSIYSDGMSTLLKRDRVDRKSEEVTFVSTDSIRMSGSVKFEVFDKDVLLLSGALELCNTNGVVGESSYNGQRWNMNCESYIIPGTSFFKGKQLLLPDSSLPTIEVYIAGSFSSTPIILTKTLQLSQKKHTKKGVLDAIPEHEASENGKDISSAHALQAPDYLYDKHEDEDYNSLYPGTAYADGEDGELSWFNAGVRVGVGIGLSVCLGIGIGVGLLVKTYQGTTSHFRRRLF

SEQ ID NO: 14146 - protein, 185 aa, Triticum aestivum
  misc_feature (63)..(63): Xaa can be any naturally occurring amino acid
  misc_feature (79)..(79): Xaa can be any naturally occurring amino acid
  misc_feature (89)..(89): Xaa can be any naturally occurring amino acid
  misc_feature (101)..(101): Xaa can be any naturally occurring amino acid
  misc_feature (104)..(104): Xaa can be any naturally occurring amino acid
  misc_feature (112)..(112): Xaa can be any naturally occurring amino acid
MGDYTIRISTSLIEQLARDDEKQVKRRTRKPRPKKVVEQPEEPQDHGRELPTEPKSSPAPAPXWSLPPPMYLPVTPAPXQPFPAIQEGXALRTGVAESEEXSWXNLQKKKAXMPQDLTKRAKELHDKEFKLPYQNPAPCTDERAGCAECYRSNVQDPLKCAEAVKRFEACVRMARRGGAAMGAAQ

SEQ ID NO: 14147 - protein, 434 aa, Erythrobacter sp. NAP1
MNAPFDTASAIGPDAAIQPAPDHQVVVVGLGYIGLPTAAVLASHGWNVCGVDVSEKVVETVNAGRVHIEERDLDRLVREATESERLTASTQVPTAHFYMIAVPTPLTDEKTPDISYVEAAARAIAPKILPGACVIVESTSPVGTTERVGQIIAEMRPDLQVPVYGSQQGGDIALAYCPERVLPGKIVRELVQNDRVIGGITPYCAERAAALYSSFVEGDCLTTNVRVAETVKLTENSYRDVNIAFANELSVIADDLGVDVWDVISLANRHPRVNILQPGPGVGGHCIAVDPWFLVSSSPKAARLIRTAREVNDFKATYTERRVRALLDAVPGGKVALLGLAFKPDIDDFRESPALEIALSLAKTRGQRIMVVEPFADELPKGFAGTGAQLVKLDEALATAEVIVVLVDHTAFKHLLPADLAGKLVFDTRGMLKK

SEQ ID NO: 14148 - protein, 150 aa, Arabidopsis thaliana
MTIRKTDFNLVQCHWHSPSEHTVNGTRYDLELHMVHTSARGRTAVIGVLYKLGEPNEFLTKLLNGIKAVGNKEINLGMIDPREIRFQTRKFYRYIGSLTVPPCTEGVIWTVVKRVNTISMEQITALRQAVDDQQCIDLTYLLFSYTRDLK

SEQ ID NO: 14149 - protein, 225 aa, Enterococcus faecalis V583
MIAENLTNINNQLQLACKSSQRSVADVTMIGVTKSVGIEEAAELVQLGVQNLAENRVDKLLEKKAGLEKFNDIQWHLIGNLQRRKVKLIINEIDYFHALDSLSLAKEIQKRATKVIRCFVEVNITGEESKHGFRKEDVLPFIQELADLDKIQIVGLMTMAPFGASEEVLHATFRELKELQMTVNEKHLSFAPCTELSMGMSNDFPIAVEEGATFIRIGTALFRDA

SEQ ID NO: 14150 - protein, 160 aa, Glycine max
  misc_feature (48)..(48): Xaa can be any naturally occurring amino acid
  misc_feature (67)..(67): Xaa can be any naturally occurring amino acid
  misc_feature (69)..(69): Xaa can be any naturally occurring amino acid
  misc_feature (83)..(83): Xaa can be any naturally occurring amino acid
  misc_feature (137)..(137): Xaa can be any naturally occurring amino acid
PGRNFGGPGSPPRTPAPDHAAVTPQARHAPKPKGQSCGGGERGGDRGXDGRVYDPVGCGGGRPPEQXRXPNRPAEEGGGPPPXLGRLGKEGRSRSQQQSDLHSLPIKEHQTSDTPAGPTLKDEVTKITPGQKRTRAXQRTRYKACGDGGDHNGHRGARRE

SEQ ID NO: 14151 - protein, 215 aa, Campylobacter upsaliensis RM3195
MYVAPSLLSANFLKLEEEIKAVSEAGADLLHIDVMDGHFVSNLTFGPCVLEKISSISSVPLDVHLMVKDVSKFVELFLPLKPKFLSFHIEAEAHPIKLCEYLRTQGIHPAITLNPHTPISSLEHLIEFVDMVLLMSVNPGFGGQKFLPLVYDKIRELRALIEKKQAKVFIEVDGGVNGLNAADLEEAGADILVAGNYIFSSNDYKNAIKSLKLEF

SEQ ID NO: 14152 - protein, 70 aa, Zea mays
MTTSRRLADRKTAKFQKNITRRGSVPETAVKKGKGNGYAAGPVVLGFFVFVVIGSSLFQIIRTATSGGMA

SEQ ID NO: 14153 - protein, 507 aa, Enterococcus faecalis V583
MNEKVALFTIFGGTGDLAKRKLYPSLFRLYKKGLLAERFAVIGTARREWTDEYYREIVRETIQDLNPTAEEATEFSSHFYYQSHNVNDTEHYNTLKELSDRLNEQYHLEGNHVYYLAMAPQFFGTIVNHLKSQHIISEEGFDRLIIEKPFGSDYESAYELNEEIRAAFPEQDIFRIDHYLGKEMIQNISAIRFANNIFESQWNNRYIDNVQITFAESLGVEDRGGYYDHSGALKDMVQNHILQVVALLSMEPPVAFSEKEIRTEKVKALRAIRLYSEEEALQNFVRGQYGEGQLADQTFAAYRDEPNVAETSSTETFVAGKFLIDNFRWSGVPFYVRTGKRLTEKGTRINIVFKQVPINVFKDDTCEECDKTDLPPNVLTIYIQPTEGFSLTLNGKEIGQGFNTTPVKLDFRQSAEMTENSPEAYEKLLLDCLNGDSTNFSHWDEVAQSWRIVDIIRHAWDKTDVSFPNYAAGTMGPQAAFDLLEKDGFTWEWQPDNWYRDRGQLDQ

SEQ ID NO: 14154 - protein, 324 aa, Arabidopsis thaliana
MMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 14155 - protein, 168 aa, Triticum aestivum
MDHDKTGCQSPPEGPKLCINNCGFFGSAATMNMCSKCHKTILFQQEQGAKLASAVSGSPSNILKETFTADLVDAGTKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 14156 - protein, 550 aa, Prochlorococcus marinus str. MIT 9301
MKIINGFHLKNVRGDILGGITAAVVALPLALAFGNAALGPGGAIYGLYGAVVVGFLAALFGGTPAQVSGPTGPMSVTVAGVVASLAAVGVPKDLSAGQILPLVMAAVVIGGLLQILFGILKLGKYITLVPYSVVSGFMSGIGFIIIALQIGPLLGITTQGKVIDSLTTVFSNFQPNPAAIGISVMTLGIVFLTPRKISQWVPAPLLALLIVTPISIFMFGEGELVRIGDIPRGVPSLNIPSFNQYLPIIFQAGLVLAVLGAIDSLLTSLVADNISQTKHNSDRELIGQGIGNAVAGLFTGLPGAGATMRTVINVKSGGSTPISGMVHSVVLLIVLVGAGPLAEQIPNALLAGILIKVGLDIIDWGFLRRAHKLSLKTSAVMYGVLLMTVFWDLIWAVLVGVFIANMLTIDSITETQLEGMDEDNPLSKDDQAKNALPADEKALLDRCAGEVMLFRLKGPLSFGAAKGISERMMLVRNYKVLILDITDVPRLGVTATLAIEDMMQEAKNNSRKAFVAGANEKVKDRLAKFGVEGIIETRKEALETALNEIA

SEQ ID NO: 14157 - protein, 458 aa, Shewanella oneidensis MR-1
MAFSTLKLKTELLENLSSMGYNEMTPIQAQSLPAILAGEDVIGQGKTGSGKTAAFGLGLLNKLDVKRFRIQTLVLCPTRELADQVAQEIRTLARGIHNVKVLTLCGGVPMGPQIGSLEHGAHIIVGTPGRIVDHLDRNRLDLSNLNMLVLDEADRMLEMGFQPQLDAIIEQSPRERQTLLFSATFPEQIQSIAKQIMYNPVMVKAAVTHEKNTIEQHFYQLDDDKSRMQALQLLLLEHKPESAVVFCNTKRETQKVADELEGLGFSVLALHGDLEQRDRDETLLQFANKSACVLVATDVAARGLDIDALDAVFNYHVAYDTEVHIHRIGRTGRAGSKGAAYTFYNDQDGYKIALLEEYLDREITSESLPSLSLLGSAPNAPTMITLQIDGGKKEKLRPGDILGALTGDNGIEGTQVGKILVTDYRAYVAVNRKVAKKALSKITSGRIKGKSYRAWLMK

SEQ ID NO: 14158 - protein, 314 aa, Scenedesmus vacuolatus
NGFGRIGRNFLRCLETRQNSLLEVIAINDSGGVKQASHLLKYDSTLGKFDADVKIVDDGHISVNGKSIRVVSSRDPTKLPWGEMEIDLVIEGTGVFIDTPGASKHIEAGAKKVLITAPAKGSDIPTYVVGVNAHDYKHSDAIISNASCTTNCLAPFVKVLDEKFGIVKGTMTNTHSYTGDQRLLDASHRDLRRARAAALNIVPTTTGAAKAVALVLPKLKGKLNGIALRVPTPNVSVVDLVVQVEKKTFAEEINNAFKEAAAGSLNGVLAVSDEPLVSVDFRCTDVSSTIDSSLTMVMGADMVKVVAWYDNEWG

SEQ ID NO: 14159 - protein, 479 aa, Streptomyces coelicolor A3(2)
MSTTAQIGVTGLAVMGRNLARNFARNGYTVAVHNRTASRTHALVEEFGSEGDFVATETAKEFVAALERPRRLVIMVKAGDPTDAVIREFAPLLEPGDMIIDGGNAHFADTRRRERELREQGIHFVGTGISGGEEGALHGPSIMPGGSKESYESLGPMLEKISAKAADEAPCVTHVGPDGAGHFVKMVHNGIEYADMQLIGEAYQLLRDVAGYSPAQIAEIFRAWNTGRLDSYLIEITAEVLSHVDGATGKPFVDVVVDQAEQKGTGRWTVQIALDLGVPVSGIAEAVFARSLSGHAALRDASRGLAGPQASPLGESEAAAFADRVEQALYASKIVSYTQGFHEIAAGSEEYDWDIDLGAVSAIWRGGCIIRAAFLDRIRAAYDARPDLPSLLSDETFAQEIAAAQDDWREVLVAATRQGVPTPGFAAALAYYDALRAERLPAALTQGQRDFFGAHTYRRTDRDGAFHTLWGGDRSEVTA

SEQ ID NO: 14160 - protein, 492 aa, Mycobacterium sp. JLS
MADPRGFMKYTHRELPPRRPVPLRLRDWKEVYEDFSHETLQTQAARCMDCGIPFCHNGCPLGNLIPEWNDLVFKDRWRDAIERLHATNNFPEFTGRLCPAPCEASCVLGINQDAVTIKQVEVEIIDNAFDEGWVVPLPPDRLTGKKVAVVGSGPAGLAAAQQLTRAGHTVTVFERADRIGGLLRYGIPEFKMEKRHIDRRLEQMEAEGTQFRTGVNVGVDISVAQLRSEFDAVVLAGGATAWRDLPIPGRELDGIHQAMEFLPWANRFAAGDLKNEVTGEDGEPPITAKGKKVVIIGGGDTGADCLGTSHRQGAASVHQFEIMPRPPETRADSTPWPTYPLMFRVSSAHEEGGERVFSVNTEEFCGDENGHVRSLKVHEVEMKAGKFEKIEGSDFELEADLVLLAMGFVGPEKDGLLTDLKVELTDRGNVARDDDFATSVPGVFVAGDMGRGQSLIVWAIAEGRAAAAGVDRYLMGKSALPAPIRPTAVPQR

SEQ ID NO: 14161 - protein, 116 aa, Zea mays
  misc_feature (43)..(43): Xaa can be any naturally occurring amino acid
  misc_feature (73)..(73): Xaa can be any naturally occurring amino acid
MECTSVMIMPDCGHRGLIGQTINRGEQKGYYLKVLELVNVERXFAHKHYSGLASKTFYQGLVDYMMSGPLVAXMVWAGKIVAQLAHRSVALLTLWVLSLGNIRGDSAGYIGLNDNH

SEQ ID NO: 14162 - protein, 472 aa, Yersinia pestis KIM
MSQNVYQFIDLQRVDPPKKPLKIRKIEFVEIYEPFSETQAKAQADRCLSCGNPYCEWKCPVHNYIPNWLKLANEGRIMEAADLAHQTNSLPEVCGRVCPQDRLCEGSCTLNDEFGAVTIGNIERYISDKAIAMGWKPDMSHVHPTGKRVAVIGAGPAGLACADVLARNGVQAVVFDRHPEIGGLLTFGIPAFKLEKEVMIKRRKIFSEMGIEFQLNTEVGKDITMEALLKDYDPVFLGVGTYQSMRGGLENEEANGVYDALPFLIANTKQLMGYEATAHEPYINMQGKRVVVLGGGDTAMDCVRSSIRQGATDVVCAYRRDEVNMPGSKREVKNAREEGVEFKFNLQPLSIEVNSNGKVCGVRMVRTQLGAPDAQGRRMAEQIPGSEHVLPADAVVMAFGFRPHSMEWLAAHDVKLDKQGRVIAPESTDNAFQTSNPKIFAGGDIVRGSDLVVTAIAEGRKAADGIMNYLEV

SEQ ID NO: 14163 - protein, 136 aa, Photobacterium phosphoreum
HEEGVNFAFNLQPLAIAVDDNGNVIGVDVVKTALGDADAAGRRRPEPVAGSEHRLAADAVIMAFGFQPHAMPWLAPYDVELDQWGRIKAAQTEFAFQTSNPKIFAGGDAVRGSDLVVTAIDEGRKAADGILDYLDV

SEQ ID NO: 14164 - protein, 479 aa, Haemophilus somnus 129PT
MSRRLRRTKIVCTLGPSTDRGNNLEKIIVAGANVVRMNFSHGTPEDHLARAEKVREIAKKLGKTVAILGDLQGPKIRVSTFKEGKIFLNIGDNFTLDADLPKGEGNQEAVGLDYKTLPQDVVPGDILLLDDGRVQLKVLSTDNTKVFTEVIVGGPLSNNKGINKLGGGLSANALTEKDKEDIILAARIGVDYLAVSFPRSSADLNYARELAQQAGLKAKIVAKVERAETVIDEEAMDDIILASDVIMVARGDLGVEIGDPELVGIQKKLIRRSRQLNRVVITATQMMESMISNPMPTRAEVMDVANAVLDGTDAVMLSAETAAGQYPSETVSAMAKVCLGAEKMPSVNISRHRLDKEFDTIEETIAMSTMFAANHMKGVAAIIAMTSSGHTAKLMSRISSGLPIFALSRNESTLNLCALYRGVIPIHFDQDSRTLEGLKAAIQSLKDKGYLVSGDLVLLTQGDHLTSNGTSTCRALVVE

SEQ ID NO: 14165 - protein, 478 aa, Microcystis aeruginosa PCC 7806
MLINRLGIDRGKKFLKESILFGNDPNPELIGILGVYFVQGILGLSRLAVSFFLKDDLALSPSQMGALIGVAAIPWVIKPAFGFLSDGLPIFGYRRRPYLILSGILGVLAWLALATVVENAWQAMAAILLGSLSVTISDVIVDSLVVERARRESFTQSGSLQSLTWGISALGGLITAYLGGWLLAHLGTRPVFALTAIFPLIASAMAFLITEEKIKNNNDAQSTPKVKEQIGQLWSAIRQKSILLPTAFIFLWQATPSADSAFFYFTTNELGFEPEFLGRVRLVTSLASILGIWVYQRFLKAISFRLILGWSTVISALLGMTTLLLVTHTNRALGIDDHWFSLGDSLILTVMGQIAFLPVLILSARLCPVGIEASLFALLMSIWNMSGLVSQEIGALLTHWLGVTETNFDNLWLLVVITNLSTLLPLPLIKWLPSTDPQSQEVKKTFPPAEVFEHHVTGSLAEPGFIPELVPELIDTRD

SEQ ID NO: 14166 - protein, 339 aa, Candidatus Kuenenia stuttgartiensis
MRVAMYYNNNDVRIEEMPTPQIGPGELLVKIFASGICGSDVMEWYRIKKAPLVLGHEIAGEIVAIGDAVKQFKVGDRVTVAHHVPCNTCHYCLNGHHSVCDTLRTTNFYPGGFAEFLRVPQINVDRGTFILPQEMSYDEGTFVEPLACSIRGQRLSNFKPGQSLLVIGSGISGLLHIQLARALGAGKIFATDINEYRLKFAKKIGADIAINAKEDVPSIIRKDNNGRLADLAIVCTGAISATEQAFHSIERGGTILFFAPTEPGVKIPIDLWNLWRNCNSIVMSYAGPPADMAVAIELIRTGRIAVNDLITHKLPLNDAAKGFKLVADAKESVKVIIAP

SEQ ID NO: 14167 - protein, 245 aa, Candidatus Kuenenia stuttgartiensis
MFGRLREDIDAVFQNDPAAKSKFEIVFCYPGLHALWLFRISSFFWKKQWYFTARFLSHINRFLTGIEIHPAAQIGRGVFIDHGMGVVIGETATVGDGCLIYKGVVLGGTSFEKTKRHPTLGKKVIVGSNACVLGNISIGDNVRIGSGSVVVKDVPANATVVGVPGRIIERSKNKDHEVMLDHGQLPDPIAEAFRALIKENNKLLTRIKKLEESLNIVSNDNSRESNTESIIMTTFMKNYHNGEGI

SEQ ID NO: 14168 - protein, 309 aa, Candidatus Kuenenia stuttgartiensis
MTKIYDDITATIGNTPLVRLNKISKGLDCIITAKMESFNPMASVKDRIGIAMIEAGEKAGLIKKDTVLIEPTSGNTGIALAFVAAARDYKLILTMPDTMSLERRELLKAFGAEIVLTPGSEGMKGAINKAEEMLQNIPNSFMPQQFKNDANPEIHRKTTAEEIWNDTDGQIDIFVGGVGTGGTITGVGEVIKKRKPSLKVIAVEPSGSAVLSGGKPGPHKIQGLGAGFVPEILNTKIIDEIVKVENEQAFALSRQLARDEGILVGISSGAAAYAALQVAARPENKGKLLVVVFPDTGERYLSTVLFKEL

SEQ ID NO: 14169 - protein, 1495 aa, Arabidopsis thaliana
MSPFSETSVLLLPMVEKCINLLQTYGVSSITKLRQIHAFSIRHGVSISDAELGKHLIFYLVSLPSPPPMSYAHKVFSKIEKPINVFIWNTLIRGYAEIGNSISAFSLYREMRVSGLVEPDTHTYPFLIKAVTTMADVRLGETIHSVVIRSGFGSLIYVQNSLLHLYANCGDVASAYKVFDKMPEKDLVAWNSVINGFAENGKPEEALALYTEMNSKGIKPDGFTIVSLLSACAKIGALTLGKRVHVYMIKVGLTRNLHSSNVLLDLYARCGRVEEAKTLFDEMVDKNSVSWTSLIVGLAVNGFGKEAIELFKYMESTEGLLPCEITFVGILYACSHCGMVKEGFEYFRRMREEYKIEPRIEHFGCMVDLLARAGQVKKAYEYIKSMPMQPNVVIWRTLLGACTVHGDSDLAEFARIQILQLEPNHSGDYVLLSNMYASEQRWSDVQKIRKQMLRDGVKKVPGHSLVEVGNRVHEFLMGDKSHPQSDAIYAKLKEMTGRLRSEGYVPQISNVYVDVEEEEKENAVVYHSEKIAIAFMLISTPERSPITVVKNLRVCADCHLAIKLVSKVYNREIVVRDRSRSKMADTSHLERMGRELKCPICLSLYNSAVSLSCNHVFCNACIVKSMKMDATCPVCKIPYHRREIRGAPHMDSLVSIYKNMEDASGIKLFVSQNNPSPSDKEKQVRDASVEKASDKNRQGSRKGRASKRNEYGKTKEIDVDAPGPIVMKPSSQTKKRVQLLQNLSAESLTKPTESVETAEKPKDYTENTVIRLDEHPSLNKEGNLSPFFWLRDEDDGENSSQRTESDQLLGTTPVNVPSFSDLMDSDHESPSKEDEQQKPNPGDMFDSEMFEWTQRPCSPEILPSPVKAKVLGRDEIDLTQKKLPKVKVASSKCKNRKAGSARNTVARRSIGVSQEDNMESSAAATISEQQDSRGTSGTIIRNDVNTDENVKAKRATRSKAQSTRVQSDLNVSNEADGKQGTKRKRSSIKSSPAHPIAGPNELSLGTEIVGKGDQDQAHGPSDTHPEKRSPTEKPSLKKRGRKSNASSSLKDLSGKTQKKTSEKKLKLDSHMISSKATQPHGNGILTAGLNQGGDKQDSRNNRKSTVGKDDHTMQVIEKCSTINKSSSGGSAHLRRCNGSLTKKFTCAFCQCSEDTEASGEMTHYYRGEPVSADFNGGSKVIHVHKNCAEWAPNVYFNDLTIVNLDVELTRSRRISCSCCGLKGAALGCYNKSCKNSFHVTCAKLIPECRWDNVSVAYIVEALYSPLHSSFNTFSYQQVKFVMLCPLDASIKLPCEEANSKDRKCKRTPKEPLHSQPKQVSGKANIRELHIKQFHGFSKKLVLSCSGLTVEEKTVIAEFAELSGVTISKNWDSTVTHVIASINENGACKRTLKFMMAILEGKWILTIDWIKACMKNTKYVSEEPYEITMDVHGIREGPYLGRQRALKKKPKLFTGLKFYIMGDFELAYKGYLQDLIVAAGGTILRRRPVSSDDNEA

SEQ ID NO: 14170 - protein, 715 aa, Oryza sativa Indica Group
  misc_feature (283)..(283): Xaa can be any naturally occurring amino acid
MVERITPERTLPFPLSVGHEKEQINGTGDTREPLVEIDETNEYHNTANSAYRIQFVGGIQDNRSDFFWKAKVYNDECEIAPEHEREEAPRTAKKLSWWALSFSLSNVWCKFYRKSQAWNSTASFSDVDEKNRKGGDAEDDFTHSRPDHVFRGVHRAIICGKVGQVPVQKILRNGHTVTVFTVGTGGMFDQRTVGAENLPMPAQWHRISVHNEQLGAFAVQNSAVYVEGDIETRVYNDRINDQVKNIPEICVRRDGKIQLMQSGDSNVGKSLEELSPYGSDICXQLAKLELSTRASSMSLNTSCQRHVYNDECEIAPEHEREEAPRTAKKLSWWALSLAFLMFGFYRKSQAWNSTASFSDVDEKNRKGGDAEDDFTHSRPDHVFRGVHRAIICGKVGQVPVQKILRNGHTVTVFTVGTGGMFDQRTVGAENLPMPAQWHRISVHNEQLGAYAVQKLVKNSAVYVEGDIETRVYNDIINDQVKNIPEICVRRDGKIQLMQSGDSDVSKSLEELSYNLRQTKIPGVECPLFGFTGFAPGTVFVANNHELGCPLAKPPFYDVEHAPKLQGDTDGKNNLAGPERLVDKAGRPQGRRRRGALPMRKPSGGTPGGFSVVARSRRRRVEASISACGGASSGGGRMSGAAQGREGRPATAGGQATRRGAASEGDGGRQALYGAEGRVQRPVEASLGERVLPHTRSLVNPTAWMDWKHFGCRAPT

SEQ ID NO: 14171 - protein, 303 aa, Leuconostoc mesenteroides subsp. mesenteroides ATCC 8293
MTKNIVVLGSLNVDNIMKMPRMPLVGETMALTEVTTAPGGKGANQAVAASRQGANVSFIGAVGNDANGQFMRATLLTNGVNVDAVSTNSDVPTGSAYIMLQESGANTILIHGGANQALTIEDINTALIAQADVLIAQFEVPFEVILAAFKIAKKNNVQTILNPAPAVYELTPELMAVTDIVLPNETEAQLLTGINVINDEGVLNRVSDALQAKGVQRSIITLGEAGSFIADGQKRWWVQPEKVDAQDTTAAGDTFIGTLASVIAPDFSNLDDAVQRANIASAIAVTRPGAIPSIPTDKEVDNY

SEQ ID NO: 14172 - protein, 137 aa, Spinacia oleracea
MATITASSSASLVARASLVHNSRVGVSSSPILGLPSMTKRSKVTCSIENKPSTTETTTTTNKSMGASLLAAAAAATISNPAMALVDERMSTEGTGLPFGLSNNLLGWILFGVFGLIWALYFVYASGLEEDEESGLSL

SEQ ID NO: 14173 - protein, 216 aa, Triticum aestivum
MAPTMAITTATLVLLVATLLAPSALGSRSGPSSHHGHGGHAKHSPPPSPPPAPAAPVAAALVRTTCNSTAYYDLCVAALAADPSSTTADVRGLSAIAVSAAASNASASAAALGANVTAQGGAAVDGTVQALLRTCSAKYGEARDALAAARGSIAQQDYDYAAVYVGAAAEYPQVCKALFRRQRPGAYPADLAAREEALKQLCSVSLDIISLLSATS

SEQ ID NO: 14174 - protein, 648 aa, Yarrowia lipolytica CLIB122
MKWIGTFKNCLVGGSQQQTHDAEERGSTCGSNSVKAAPTETTLIKKIFNPTIVQQKDTCVDNALGGSQEMEQITSLWNKTDLWMAWASMLLVAVAVALEVQTVSVYSTFATSDFDQMSLLSALSVVKAVMYIATRPVMAKFADVLGRFESILMSVVLFTIGFIMLAASPNIGTYFAAHIFYVFGQVGIQFMEQVFAADTSDLKNRMFFVILPNICYLFVPWCSAPITNAIIKHSTWHWGYGMWCIIVPVVSIPVLTIMFRHKMKARALGMQCGKSVRNMKETLLQFDLVGLILFTGGLCLLFLAVTLVKSSKSWTQPHVLPMIIIGPILLLLFPIWEKTYPKYPFLPFSAMKDRTLITGCIFVGLYSLAFYIYYPYYYPWLLVCKGLSVTAATNTSVTFTVASTAASIGAAALIRYTKRIKPIIVAGGFVYILGLGLTYHYRQPDHSLAQFIAAQAVEGVGSGMLQSPTLVLIQSVVNHNQVVSATAIFYSSISVGTVIGDAISGSMYRQSYPKQLTEYAPFLSEADIHKMVNDVRAPLKYAWGSPERVAVIEAFNHVYRKMLYGPLVVAGVMILISFTMPNVDLDELEQRVKGVVFGKSDKPADGEKNPVSNQCPCDILPTDNSSQDGDFEKSESVVSKTIHNEQKI

SEQ ID NO: 14175 - protein, 376 aa, Zea mays
MSAEPTSPPLSTAQVRGSLIPPLPDDLAVHCIALLPRAAHPSLALVSRAFHALLCRHPEPLLAARRTLRCSEPHVLLSLRPPSSASPIFFLLLPHPGWPPLPLPSPPVPVSSSASAATDGARLFLVGGSVSAVPSASVQILDPRARSWSAGPRLSSTREFAAAVAHSGALFVAGGCIPSSPFWAEALDLSTPNAKWRAVASPAHLREKWMHGCASLDGKVVVVADRGGLSYDPSAPPAEAWAPVSPVLDMGWKGRAAVVEGILYSYDYLGQVKGYDPYTDSWSTVEGLEGELPKFLCGATLADVGGLLYLGWEGKWKGKLKGKMEMRSMVVIEWASIQITRVQEGRLRGKVVSRDTVLFPDMPRGSTITHCIALEL

SEQ ID NO: 14176 - protein, 418 aa, Triticum aestivum
  misc_feature (205)..(205): Xaa can be any naturally occurring amino acid
  misc_feature (325)..(325): Xaa can be any naturally occurring amino acid
AIFWSEVHFLECVTQDGNDHIHTAKLVLIVATIVSAIAIPKFFFVLCRFLLAPLAVWIFLAYKYMKTRIIIDAVEKFLRIQQMIGPARYSYTDIVAVTSHFRDKLGQGGYGTVYKGVLLPGDVHVAVKMLEGNSNCNGEDFISEVSTIGRIHHVNVVRLVGFCSEEMRRALVYEYMPNGSLDKYIFSAEKSFSWDKLNEIARGIXRGYYLHQGCDMQILHFDIKPHNILLDSNFVPKVADFGLAKLYPRGDSFVPLSAMRGTIGYIAPEMISRSFGVISSKSDVYSFGLLLLEIAGGRRNADPNMGSSSQAYYPSWVYDRLTWEXAGEISDVAADMHELEKKLCIVGLWCIQMRSRDRPTMGEVIEILEAGADGLQMPSRPFFCDEGHIHVEDSYQFTSELTAVSEEDLTTVSEEDNM

SEQ ID NO: 14177 - protein, 323 aa, Leuconostoc mesenteroides subsp. mesenteroides ATCC 8293
MTPAYELFNLGSNDELAGEISTILGVPLAPIDIKTFADNEIYERIENTVRGRNVYVIQGITAPVNDNFMKLMIFIDAARRASANSINVIIPYFGYARSDRKARSREPISARMIANMLESQGVKRVMTMDLHADQVQGFFDIPVDHLLAMPALGHYFYANDLLGDDLVVVAPDHSSVARARKFAKLLHADWALVDRRVDSVRPNTPYQITGNVAGKRAILIDDIIDTGTSMVLASEAAANAGAIEIYAVATHAVLSDNAVDHLEKAPIDHVVVANTVEIAEHKNMSKLKVLSVAESFAEAIRRINVFESIEDVLKSPDNLDVML

SEQ ID NO: 14178 - protein, 427 aa, Mycobacterium avium 104
MRYRPGEALLALYRRRGPVIDAGAGRRGYTLLLGAEANKFVFANADAFSWRATFENLALVDGPTALIVSDGDDHRRRRSVVAPGLRHRQIQDYVTTMVSCIDRVIDGWRPGQRLDVYQHCRAAVRRSTAESLFGRRLAVHSDALGEYLQPLLDLTHQPPQLVGLQRRINAPAWRRAMAARQRINNLVDTLIAEARAAPNPDDHMLTMLIDGRGDEGYALNDNEIRDAIVSLVTAGYETTSGALAWAVYLLLSQPGAWATAAGEVRRVLAGRLPAAADLSGLTYLNGVVHETLRLYPPGVISARRVMRDLRFEGRRIRSGRLLIFSPYVTHRLPEIWPEPMRFAPERWNPDAPGYRRPAPHEFIPFSAGLHRCVGAAMATTEMTVMLARLLARTRLRLPAQRLRAANVAALRPTPGLTVEVIDSVPAQ

SEQ ID NO: 14179 - protein, 478 aa, Pseudomonas fluorescens PfO-1
MNNSYDQLYLFIGGEWIDAQGRSTAAVVNPATGREIGRVPLATAGDLDRALEVSRVGFEQWRQTVPDQRAKILKRAADLILERAPHIAAQMTLEEGKPLSESMDEVVRAAEYFEWFAESARRIDGRVVPANRPGVLQLVKRQAIGPVAAFTPWNFPAITPARKLSAALAAGCSVILKPGEESPSTALALARALDDAGLPKGVLQVVFGVPDQVSSQLIASAIIRKVTFTGSVPIGRLLSARAAEGVKPITLELGGHGPVLVFADADVEKAAVEGVANRFRGTGQVCISSTRFIVQRGAYQAFVDHFVTATKALKIGDGFDPQTQVGPLANPRQLVKMEQLIADAVEKGARVLVGGEALPGDGFFFQPTVLADVPMNARIMHEEPFGPIAVLMPFDELADGLQEANRLPYGLSAYAFTSNARTAIDVADGLEAGMIGINQYRIVATELPFGGMKESGHGSEGGVEGIEHYLTHKFISQV

SEQ ID NO: 14180 - protein, 346 aa, Rosa gallica
QKWSNGKHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHHPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALLTGKERNEKEWAKLFTDAGFSDYKITPIL

SEQ ID NO: 14181 - protein, 618 aa, Coprinopsis cinerea okayama7#130
MSRFNAPAGQSLFASKLAYEALEIESGEESEEEIVQEEPAQSSAPEEPPKPTKSALKKASRLARQERRQQEKAERSRARAAAKQAASQSPSTPSTPLETPTSASRSESGVDETPAAPVKLETPVAAAPPPPAVVAEAKPKDEKPIPSRPASNGNINGHVHQELAQPTPPPANEEAKTPAPSAQPKAAAVPTKAPPVAVIEPLKQPVVKPVAHPPAPVDEEQVKKRQNVVERVIWTFVMIFGFIGLLLMGHAYMIVLVMLCSTLVYREVTALFSLKSADQKENKPELKGKDPWSKTLNWYFFAVTNYFLYGESIIYYFKHVVFADAQLLPFATNHRMISFTLYIIGFMGFVMSLKKGYLKQQFGLFCWVHMSLLIIVFSSHFIINNILEGLIWFWVPASLVVCNDCFAYIWGKTMGRTPLIKLSPKKTVEGFVGAFFSTIIFAVLWGTYFMRFNYMICPVHDLGTNAFTAMSCNPNPVFIWRSLELWKPLSVALGTISGQSITSISYAPYQLHLLVLACFASLVAPFGGFFASGFKRAFDIKDFGQSIPGHGGMTDRMDCQFLMGVFTYVYYSSLIRQNNVTVGGILQTIVSNLTVDEQLELIGDLVRYLEKQGIAVPR

SEQ ID NO: 14182 - protein, 541 aa, Vitis vinifera
MNVKPLVVERIDIDETIENNEESRIEVDGNFLNGENVKGVDESEVLITKREESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWRIITGSDPKNTPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 14183 - protein, 317 aa, Prochlorococcus marinus str. MIT 9301
MQNKYLIMASKKFWFWFWTQLMNGFAPSDLHGNYKRPKGITIDSEYDINTQNGQIYLLVGHSCPWCQRTLLIQEIKDLSKKVKVIFLKADVEHGEWILNKKIKGCIRLSDLYKKANKKTIFRATLPLLISFVKDEVNILSNESSQITRLLNSIKSESKYQALSIKDCNQKFLDLINNSINDGVYKCGFARNQSAYYKASKNLFAAINEIENLLQKNKGDWIFGEELTYADIYLFPTLIRWELIYSKLFKCTQQELSSFEKIIEWRLKFFKLSNVKRTCFDNEWKKDYYKALFPLNPNQLIPVLPSLEEIMRLEPKNI

SEQ ID NO: 14184 - protein, 346 aa, Rosa gallica
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHHPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALLTGKERNEKEWAKLFTDAGFSDYKITPIL

SEQ ID NO: 14185 - protein, 512 aa, Coprinopsis cinerea okayama7#130
MPPAATLEYASNAPEPLAMYSRLPKHHLRSEDGTPDYLRLILTAKVYDILKETPLVMATNLSAKLGNQIWLKREDLQEVFSFKIRGAYNFMASLSEEERWKGVVTCSAGNHAQGVALSGARLGIPCTIVMPQGTPTIKVRNVARLGAKVVLHGVDFDEAKAECARLASAHSLTFVPPYDDPLVIAGQGTVGMEILKQLPESDQLDGIFAAVGGGGLVAGIAEYIDRIGNPNNHVIGVETIDGDAMARSIEAGHRVTLNEVGPFSDGTAVRIVGEEPFRICKKLLDSPIVKVDNDEICAAIKDIFEGTSITEPAGAVALAGLKRYIADNNLIGANKKFVVVVSGANMNFDRLRFVSERAEIGEGREALLSVDIPERPGSFVALHSIIHPRAVTEFIYRYNIDGDRAHVLLSFKIESNSRETEVQAILAALEAADMKGLDMTNDELAKSHVRYMIGGRQQVPNERIFRFDLGRVLAGIQVPESDSDAFKAFLDKLDYSYVEETDNPVYARFLRG

SEQ ID NO: 14186 - protein, 346 aa, Rosa gallica
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKAKNGKVIIIDMMMENQKGDEESIETQLFFDMLMMALVTGKERNEKEWAKLFTDAGFSDYKITPIL

SEQ ID NO: 14187 - protein, 275 aa, Mycobacterium sp. JLS
MREPTMMHRVAAEFIGTFWLVFGGCGSAVFAAKYTSADGYAFGIGFLGVSLAFGLTVLTGVYAFGTISGGHFNPAVTLGAALARRVEWRVLPAYWLTQVIAGVAAGLVIYVIAKGREGWTATGNMAANGYANHSPAGYSLLAVVIAEVLLTGIFLLVILGATDTRAPKGFAGLAIGLTLTLIHLISIPISNTSVNPARSTGVAFFNGNEAPAQLWVFWIAPLLGAAIAGAAYPYLFGRHEELADRPVRDETLDAQVRAEDVADARVERGPDPEVR

SEQ ID NO: 14188 - protein, 346 aa, Rosa gallica
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSTNLKYTGGDMFEAVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 14189 - protein, 255 aa, Triticum aestivum
  misc_feature (21)..(21): Xaa can be any naturally occurring amino acid
  misc_feature (61)..(61): Xaa can be any naturally occurring amino acid
  misc_feature (157)..(157): Xaa can be any naturally occurring amino acid
  misc_feature (160)..(160): Xaa can be any naturally occurring amino acid
  misc_feature (173)..(173): Xaa can be any naturally occurring amino acid
  misc_feature (193)..(193): Xaa can be any naturally occurring amino acid
  misc_feature (228)..(228): Xaa can be any naturally occurring amino acid
DCQPVTAQTAPGIKVPISHRXFGAHSLHHQLMLIVLFMTDEKLNARVKCPLTQNLALNRNXAQLTTDPHYSQRMLIFDYDGTHYQALIQIRNHGFYEADYIQSVTPNLSMPTQIFWLGQRRKSGIALNSRYHTDNMMSTLQLASTVIADKTYDHKVXEEXSLATDFMYNHVTXDVTSSDVNNYILRHCHLRRXVDSHGSCAAYLDDILNLDVNYLLSAQIDHPKKHYXFGSSMTAGNKYAHSNYCERTTDGLVTL

SEQ ID NO: 14190 - protein, 474 aa, Haemophilus somnus 129PT
MNKEIKTQVVVLGAGPAGYSAAFRCADLGLETVIVERFSTLGGVCLNVGCIPSKALLHVAKVIEEAKSLSAHGIVFGEPTTDIDKIRGWKEKVINQLTSGLAGMAKQRKVQVVNGYGKFSGPNAIIVAGDEGETKITFDNAIIAAGSRPIQLPFIPHEDPRIWDSTDALKLKEVPENLLIMGGGIIGLEMGTVYHALGSKIDVVEMFDQVIPAADKDMVQIYTKRIEKKFNLLLETKVTAVEAKEDGIYVSMEGKAASETRRYDAVLVAIGRVPNGKLIDAGIAGVEVDDRGFIRTDKQMRTNVPHIFAIGDVVGQPMLAHKGVHEGHVAAEVIAGQKHYFDPKVIPSIAYTEPEVAWVGKTEKECKAEGINYEVAKFPWAASGRAIASDCADGMTKLIFDKDTHRVIGGAIVGTNGGELLGEIGLAIEMGCDAEDLALTIHAHPTLHESVGLAAEVFEGSITDLPNPKAKKKK

SEQ ID NO: 14191 - protein, 585 aa, Haemophilus somnus 129PT
MEVPSPEAGVIKEVLVKVGDKVSTGTPMFVLENAELASTETASKSMQTEKTQSAVASIIEIYVPDIGGDEVNVTDIMVSVGETVAEEQSILNVEGDKASMEVPAPTAGIVKEILIKVGDKVSTGSLVMKFEVAGVVSAAETAQVSSSAQVTGESAVQDVHVPDIGGDEVNVTEIMVAVGDSVTEEQSLITVEGDKASMEVPAPFAGVVKEILVKSGDKVSTGSLIMRFEVQGKAPTPEASSAVTEAKVDPSPAAQENQMTPVSQADVTASAVFAHATPVVRRLAREFGVNLDKVKGTGRKGRILKEDVQAYVKAAIKAVESGNVSPTSAGNGAVNGAGLGLLPWPKVDFSKFGDIEQVELGRIQKISGANLHRNWVMIPHVTQWDKADITELEKFRKEQNVLAEKQKLDVKITPLVFIMKAVAKALENYPRFNSSLSEDAQSLILKKYINIGVAVDTPNGLVVPVFKDVNKKGIIELSRELAEISKKARAGKLTASDMQGGCFTISSLGGIGGTHFTPIVNAPEVAILGVSKSEMTPVWNGKDFTPRLMLPLSLSYDHRVIDGADGARFITFINSVLSDLRRLVM

SEQ ID NO: 14192 - protein, 415 aa, Debaryomyces hansenii CBS767
MSGEKRKRESKTTELRVSSYTEDPAVVVGSFFKGLSVPSDMEFDLYKHKKNDEFVIHGENERLDYNGETVEDDNNDYVVALYDPLNKSVDLYKSPLVLSKVTAKSKRSFKGPSIRQAGVRNVTQRNALGEAFGTKKAKAAITNLEKNRIDADKLQEMELDIVDSVKETTQDLPTRKQMEDTVTHDRPTPIANVEATNVEDIYELYNIIPKREWSYLRVNSLFTEEDPKQRLELLPYDKSIYVSKHLAPLISSNNTEKLQLLYYASLLFGVYENRRVKDKQTLMLKLQNKPSEILVDGILERFTIPRASQFGKSKDRSFVIDPHHEDKLLCYLLAIIFHIDNFMVELPPLAHELNMKPTRLVSLCKALGAIIKSATVAQAEAFGIPKVSASTYKVATLKVPFKLPEMSKRVRKGGR

SEQ ID NO: 14193 - protein, 220 aa, Triticum aestivum
  misc_feature (158)..(158): Xaa can be any naturally occurring amino acid
KLAACAAPLCVRISCSTPSPTALHRPRRRRVTSARCSLAAAPGLRAPAELVDSILSKVKGTDRGVLLPEEGHQEVADVAQQLGKYCIDEPVKSPLIFGDWDVVYCSVPTSPGGIYRTPLGRLVFKTDGMVQVVEAPDIVRNKVSFSIFGLDGAVSLKXKLNVLDSKWIQVVFEPPELKVGPLGFQYGGESEVKLEITYVDEKIRLGKGSRGSLFVFLRQD

SEQ ID NO: 14194 - protein, 491 aa, Bacillus clausii KSM-K16
MGETTVEVRKVKNYINGKWIESSTSLYEDVVNPATKEVICQVPLSTKADVEYAVEAAKTAFAKWSKVAVPRRARILFNYQQLLQRDKEELARLITIENGKNLTEARGEVQRGIENVEFAAGAPSLMMGDSLPMIATDVEASNYRYPIGVVGGIAPFNFPMMVPCWMFPMAIALGNAFLLKPSERTPLLTEKLADLLTEAGVPDGVFNVVYGAHDVVNGMLEHPDIKAISFVGSKPVGEYVYKKASENLKRVQALTGAKNHTIVLNDADLDDAVTNIAGAAFGSAGERCMACAVVTVEEGIADAFVAKLKAKAESLVMGNGLDDGVFLGPVIREENKNRTIAYIEKGVEEGATLVCDGRSRVSADGYFIGPTIFENVTTDMTIWKDEIFAPVLSIIRVKNLDEGIQIANRSEFANGACLFTTNAAAVRYFRENIDAGMLGINLGVPAPMAFFPFSGWKSSFYGTLHANGKDSVDFYTRKKVVTARYPKPSFD

SEQ ID NO: 14195 - protein, 617 aa, Oryza sativa
MRGTTFWSYTALRRCTFCASVGSTRTMPEGEVGGGAGLGGASAAAEAATRRARRGGGERRRRRTLREEEAVVVTGKGAGEDGRVTAVAAIGACAEQRLLRKGGAAAAGGGLTVEGFHRWLCSDANAALDPQKRVYQDMGLPLSHYFIYTGHNSYLTGNQLSSGCSEVPIVKALHDGVRVIELDLWPNAAKDAVEVLHGRTLTSPVGLMKCLEAIREYAFVASPYPVILTLEDHLTPDLQSKVAKMIKETFGDMLYVSETENMAEFPSPDELKGKIIVSTKPPKEYLQTKNDADADEAGVWGEEITDDKVAATAMTTEEKCAAAEEAVAAAAVDEEMQEAETDKKTQHGVDNEYRRLIAIPLTRRKHDMDQDLKVDPDMVTRLSLGEKAYEKAIVTHGAHIIRFTQRKLLRIFPRSTRITSSDYNPLMGWRYGVQMVAANMQGHGRKLWLTQGMFRANGGCGYVKKPDILMNNDPDKLFDPTSKLPVKTRLKVTVYMGDGWRFDFRKTHFDKCSPPDFYARVGIAGVEADTRMEQTKVKMDTWIPAWDHEFEFPLSVPELALLRVEVHESDNHQKDDFGGQTCLPVWELRRGIRSVRLCDHRGEPLRSVKLLMRFDFT

SEQ ID NO: 14196 - protein, 484 aa, Haloarcula marismortui ATCC 43049
MTHTSDYDLVILGGGAAAFAAITEASRRDLSTAMVNTGLPIGGTCVNVGCVPSKHLLAVAESGAAASENPFDAVRYPEEPTVDWAAALNDTDELVERFRQENYVDIAEHFEIDIYEGYGQLVDDTTIEVVDGADEGARITGEKALVATGSSPWAPPIDGLYDVDYYTSETILEERDLPESILMLGGGYIALEWGQILHRVGIDVTVLQRSDRVLSDMEGQLGREMQRAFEEEGIEVITGNDFQRVRTLAADGGAEAIQSGVAVETTIDGDERTVTGDALFVATGVQPNSEGIGLETVGIETNPDGTIRVDEYFQTTNPDIYAAGDVIGEPELETVAAKEGNHAVKNAFGNEGVSIDYDAVPAVVFTSPEVAAVGTTELEYMDEHGTCSCRTVQMADVPRAKAVENTDGLVQVVKHHETDEIVGVHMVGPRAADMIMEATLAVTFGLTVDDIIDTVHPFPTFSEAFKQACQAFRRDISMMSCCIE

SEQ ID NO: 14197 - protein, 309 aa, Thermus thermophilus HB8
MLEVVTAGEPLVALVPQEPGHLRGKRLLEVYVGGAEVNVAVALARLGVKVGFVGRVGEDELGAMVEERLRAEGVDLTHFRRAPGFTGLYLREYLPLGQGRVFYYRKGSAGSALAPGAFDPDYLEGVRFLHLSGITPALSPEARAFSLWAMEEAKRRGVRVSLDVNYRQTLWSPEEARGFLERALPGVDLLFLSEEEAELLFGRVEEALRALSAPEVVLKRGAKGAWAFVDGRRVEGSAFAVEAVDPVGAGDAFAAGYLAGAVWGLPVEERLRLANLLGASVAASRGDHEGAPYREDLEVLLKATQTFMR

SEQ ID NO: 14198 - protein, 336 aa, Streptomyces avermitilis MA-4680
MSTPVKAAVFGTGSWGTAFGMVLADAGCDVTLWARRAELADAVNSTRTNPDYLPGVELPENLRATTDPAEAARAADFTVLAVPSQTLRGNLAEWVPLLAPDTVLVSLMKGVELGSAMRMSEVVEDVAKVGADRIAVVTGPNLAREIAARMPAAAVVACANEAVAQRLQAACHTPYFRPYTNTDVVGCELGGAVKNVIGLAVGIADGMGLGDNAKGSLITRGLAETTRLGLVMGADPLTFSGLAGLGDLVATCSSPLSRNHTFGTNLGRGMTLQETIAVTKQTAEGVKSCESVLDLARRHGVDMPITETVVGIVHEGKPPVVALKELMSRSAKPERR

SEQ ID NO: 14199 - protein, 422 aa, Campylobacter upsaliensis RM3195
MLKELDLLYLWHPCTQMKDHEKIPLIPIKKAQGVWLYDFDDKAYMDCISSWWVNLFGHCNPEISNAIKTQLKCLEHVLLAGFSHEGIIKLSQRLCALSGFDKCFYADNGSSIIEAALKMSFHYHLNKGKKKNKFLSLTNSYHGETLGALSVGDVKLYKQTYNPLFLENLSTKAPSGEDYEEALKELKSTLEKHANSLCAFIVEPLVQCAGNMNMYESSFLNEAIKLCHHFDVQVIFDEIAVGFGRTGKLFAMHHCEEKPDYLCLSKGITGGFLPLAVVLVKDEIYNAFYAPYEENKAFLHSHSYTGNALATAAANEVLNIFETQNVLEKNAFLSLFIKQEFEKLKEFHFLSNFRQCGMIYAFDIKSQISRAGLLVYEKALQKKLLLRPLGNTIYFMPPYIITKDEISYVVDSLIEIFKEFKP

SEQ ID NO: 14200 - protein, 494 aa, Anaplasma marginale str. St. Maries
MSGSAVVLCILDGWGNGNGDECDAIHAARKPFWESVVSGCPRSSLSASGEDVGLPAAQVGNSEVGHISLGAGRVVLQDLQRINAEIGEIHSNPYLLQFAEAIKNGRGVCHIMGLLSDGGVHGLQDHITQLARVLAELRIKVLIHAFLDGRDVSPRSAKKHVTALNDAVHSYDISIATISGRYYAMDRDHRLDRTEKAYEAIALARGPRYRDAMTAIESSYSEGISDEFLVPSVIGDYQGFSPKDGILLTNFRSDRIVQILSMILHRSQEVSNILGMVRYSEKIQVPSLFPPRNICNTLGEVVSKCGLKQLRIAETEKYAHVTFFFSGGKEEPFPGEDRVIIPSPQVSTYDLQPEMSAFPMTEVLVERIESRQYSLIVVNYANADMVGHTGNLEAVKKAISVIDACLQMVFNAAKKAGATMLITADHGNAEKMFDMRGTPFTAHTSNTVPLVLCNCDKRFGLVDGRLCDVAPTILELMEIAKPDEMTGSSLLTPE

SEQ ID NO: 14201 - protein, 346 aa, Rosa gallica
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSRNLKYTGGDMFEAVPPADTVLLKWISHDWNDEECVKILKRSREAITSKDKKGKVIIIDMMMENQKGDEESIETQLFFDMLMMALVTGKERNEKEWAKLFTDAGFSDYKITPIL

SEQ ID NO: 14202 - protein, 346 aa, Rosa gallica
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGTTFWDYGNHQPSIAHFFNDAMASDARLVTSVIIDDCKGVFEGLESLVDVGGGTGTVAKAIADAFPHIECTVLDLPHVVADLQGSRNLKYTGGDMFEAVPPAGTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 14203 - protein, 446 aa, Pseudomonas fluorescens PfO-1
MNVSVFGIGYVGLVQGAALAEVGHNVLCVDVDAGRVEALKEGTLPLYEPGLKILVRDNYQSGRLQFGTDLVDAVHHGDVLLIAVGTPPDEDGSADLQYVLSVARTIALNLDRHQIIVDKSTVPVGTGDRVRACIEQVLADNGRGDLTFDVVSNPEFLKEGCAVEDCMRPDRIIIGTDSPRAEEVMRELYEPFNRSREKIIVMDVRSAELTKYAANCMLATKISFMNEMACLAEKLGADIEKVRHGIGADPRIGYQFIYPGLGYGGSCFPKDVKALIQAADGVDIDARVLKAVEARNQEQKASLYRKVFDHFDGHLRGKTFALWGLSFKPNTDDMREAPSRVLMEALWQAGASVQAFDPKAMEEAQRLYGSRDDLTLTGTKEAALKNADALIIVTEWQSFRAPDFDQLSRLLKQPLIFDGRNLFDPQRLSKRGFTYVSVGRQTPSVL

SEQ ID NO: 14204 - protein, 346 aa, Rosa odorata var. gigantea
QKWSNGEHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 14205 - protein, 498 aa, Justicia americana
  misc_feature (1)..(2): Xaa can be any naturally occurring amino acid
XXINPTTSGSGVAMIEKKNWGRIVQIIGPVLDVAFPPGKMPNIYNALVVQGRDTVGEAINVTCEVQQLLGNNRVRAVAMSATEGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEMESNLKK

SEQ ID NO: 14206 - protein, 346 aa, Rosa odorata var. gigantea
QKWSNGEHSNELLHAQSHIWNHIFSFINSMSLKSAIQLGIPDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 14207 - protein, 575 aa, Haemophilus somnus 129PT
MISGITASPGIVFGKALVLKEEKIVLDTQKIKDEQIDIEVARFYSGRAAAIEQLIAIKDRALVSLGEEKAAIFEGHLMILEDEELEEEILDYLRSNKVNAGVAASKIIDQQVAMLSEIDDEYLQERAGDIRDIGNRLIKNILGMKIVDLGDINEEAILVAYDLTPSETAQLNLDKVLGFITDIGGRTSHTSIMARSLELPAIVGTNDITSKVNTGDYLVLDAVNNAIYVNPTQEEIERLKALERQLAEEKAELAKLKDLPALTLDGHQVDVVANIGTIRDCEGADRNGAEGVGLYRTEFLFMDRDQLPTEEEQFIAYKEVVEAMNGRLVVLRTMDIGGDKDLPYLNLPKEMNPFLGWRAIRIGMDRREILHAQLRAVLRASAFGKLAVMFPMIISVEEIRELKSVIESLKQELRDEGKAFDENLQVGVMVETPAAAINAKFLAKEVDFFSIGTNDLTQYTLAVDRGNELISHLYNPMTPAVLSLIKHVIDASHEEGKWTGMCGELAGDENATLLLLGMGLDEFSMSAISIPRIKKLIRNVNYQDAKLLAEQALQQPTAAGILSLVNDFLVEKALN

SEQ ID NO: 14208 - protein, 346 aa, Rosa odorata var. gigantea
QKWSNGEHSNELLHAQAHIWNHIFSFINSMSLKSAIQLGIPDIINKHGYPMTLFELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPLADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 14209 - protein, 351 aa, Pseudomonas fluorescens PfO-1
MRKTTLITGGAGYIGSHTALALINAGHKVLVLDNLCNSCRECIRRLEQLTLTRVDFIKGDIRDPVLLDDIFSRYDIEAVVHFASLKSVEESVRKPLDYYANNVAGTLDLCQAMARNNVFQLVFSSSATVYGEPANTPIAEDFGTGKPVNPYGRTKLMIEELLTDLCNSDPRWSIGLLRYFNPIGAHESGMIGEDPSGRPNNLLPCLTQVAIGRIPELTVYGSDYPTVDGTCVRDYIHVVDLAIGHLKALQVLQHDNGIHFWNLGTGVGYSVLQIIHSFEDITGISIPYRFAPRRLGDIAKCWADPAKAGRELGWSAQRGLEQMITDSWRWQSCNPQGYQSSFKIPAPVAVK

SEQ ID NO: 14210 - protein, 256 aa, Oryza sativa Japonica Group
AMQMGSETYHHLKDIILEKYGSNSCNIGDDGGFAPNISSITEGLDLVIEAINRAGYNGRIKLAIDVAATDFCMGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 14211 - protein, 456 aa, Haemophilus somnus 129PT
MTKHYDYIAIGGGSGGIASINRAASYGKKCAIIEAKYLGGTCVNVGCVPKKVMFYGAQVAEAITKYAPDYGFDVTLNHFDFAKLVESRQAYIDRIHTSYNNVLAKNNVDVLNGFAKFFDAKTIEVSYANGEKELVTADHILIATGGRPSRPTIPGAEYGIDSDVFFALTELPKRIAVVGAGYIAVELAGVVNSLGAETHLFVRRQTPIRSFDPLIIETLVEVMKQDGIQLHTQAIPQEIIKNADNSLTIKLEDGRTQDVDCLIWAIGREPATDVINLASTGVETNERGFIKVDKYQNTNVEGIYAVGDIIEGGIELTPVAVAAGRRLSERLFNNKPDEHLDYHLVPTVVFSHPTIGTVGLTEPKAIEQYGAEAVKVYTSSFTPMYSAVTSHRQPCRMKLVCVGKEEKIVGLHAIGFGVDEMIQGFAVAIKMGATKADFDNTVAIHPTGSEEFVTMR

SEQ ID NO: 14212 - protein, 475 aa, Microcystis aeruginosa PCC 7806
MTKRTFGVIGLAVMGENLALNVESRGFPIAVYNRTASKTKEFMETRAVGKDVKAAYSLEEFVQILERPRKILVMVKAGPPVDAVIEQLKPLLEEGDMIIDGGNSLYEDTERRTRDLESTTKLGFVGMGVSGGEEGALHGPSLMPGGTEFAYRELEPILTKIAAQVDDGPCVTYVGSGGAGHYVKMVHNGIEYGDMQLIAEAYDVLKNGLGLSNQQLQETFAEWNRTDELNSYLIEITADIFKCVDPETGHHLVDLILDSAGQKGTGRWTVLSSLELGVPIPTIYAAVNARVMSAYKDERVAAAKELPGPGETYPGDAALFVDKVRDALYCSKMCSYAQGMALIAKASQEFNYNISLPESARIWKGGCIIRASFLDKIRKAFAENPGLPNLLLAPEFKQSILDRQEAWREVLVLANKLGIPVPAFSSSLDYFDSYRRANLPQNLTQAQRDYFGAHTYERTDKPRGEFFHTEWMTES

SEQ ID NO: 14213 - protein, 391 aa, Zea mays
MRSSEASSRLVQELVLYAASAALSCLVLFAGLRHLDPNRAASQKAQQQKKEIAKRLGRPLVSTTPYEDVIACDVINPDSIDVEFDSIGGLDQIKQALYELVILPLRRPELFTFGKLLSPQKGVLLYGPPGTGKTMLAKAIARESGAVFINVRISNLMSKWFGDAQKLVAAVFSLAHKLQPAIIFIDEVDSFLGQRRTTDHEAMTNMKTEFMSLWDGFTTDQNARVMVLAATNRPSELDEAILRRFTQIFEIGIPVESERSKILQVVLKGENVEHNIDYDHIASLCEGFTGSDILELCKQAAFYPIRELLDDEKKGRKLDKPRPLRQSDLERALSMSRKGKKAASSALQSPLWVRPTNSEDDQVQNAIFEISKLMSRIVQNSESEPQEPSSP

SEQ ID NO: 14214 - protein, 238 aa, Dichelobacter nodosus VCS1703A
MRFRINAISQLKWLVSLISIWERLCYDSVSFFRTIVGKTVLLIIDNYDSFTYNLAQYFMELGEQILVEKNDAITPVDIENLAPTAIVISPGPCSPKEAGISNAVIAHFAGVIPIFGVCLGHQCIAEVFGGKVVGAHQVCHGKVSPVCHHHGGVFRHLPNPLTVARYHSLVVDKDSLPKAFEITAWIEDDRENVIMGIRHKTLPIEGVQFHPESFLSEAGHDLLKNFLMDVQVFNRENV

SEQ ID NO: 14215 - protein, 137 aa, Zea mays
  misc_feature (66)..(66): Xaa can be any naturally occurring amino acid
  misc_feature (93)..(93): Xaa can be any naturally occurring amino acid
MALRNALLRHLRVPVQNLAVRGSNQSQIGFLGSIRAFSSHDDHLSKQDVVDRVLDVVKSFPKVDPXKLTPEVHSQRDLVKKFGPGEKGMAIEXEFKLEIPGKKIEKITPLFSWPFKKLFSNPPKGRRKNPPGGGNLP

SEQ ID NO: 14216 - protein, 594 aa, Oryza sativa Japonica Group
MGSFLRKQPSFLLILLILHLGAREARALSSDGEALLAFKKAVTTSDGIFLNWREQDVDPCNWKGVGCDSHTKRVVCLILAYHKLVGPIPPEIGRLNQLQALSLQGNSLYGSLPPELGNCTKLQQLYLQGNYLSGHIPSEFGDLVELGTLDLSSNTLSGSIPPSLDKLAKLTSFNVSMNFLTGAIPSDGSLVNFNETSFIGNRGLCGKQINSVCKDALQSPSNGPLPPSADDFINRRNGKNSTRLVISAVATVGALLLVALMCFWGCFLYKNFGKKDIHGFRVELCGGSSIVMFHGDLPYSTKEILKKLETMDDENIIGVGGFGTVYKLAMDDGNVFALKRIMKTNEGLGQFFDRELEILGSVKHRYLVNLRGYCNSPSSKLLIYDYLPGGNLDEVLHEKSEQLDWDARINIILGAAKGLAYLHHDCSPRIIHRDIKSSNILLDGNFEARVSDFGLAKLLEDDKSHITTIVAGTFGYLAPEYMQSGRATEKTDVYSFGVLLLEILSGKRPTDASFIEKGLNIVGWLNFLVGENREREIVDPYCEGVQIETLDALLSLAKQCVSSLPEERPTMHRVVQMLESDVITPCPSDFYDSE

SEQ ID NO: 14217 - protein, 767 aa, Candida glabrata CBS 138
MMETQPTQQATQATQKYLIDNFTQEQIKKNSVYRVICTSGQIPIKDMEVDVEQIAKKKESIKKIWTFGRNNACDYHLGNISRLSNKHFQILLGEDGNLLLRDISTNGTWLNNQRIEKDRNHLLSQGDEITVGLGVSSDIISLVIFINEKFRDYLEEVRQELSSQGLKVSSKSNANPNINLTGIYKDFSINDEVVGTGAFATVKKAVERNTGKTFAVKIINKRKVVGNMDGVSRELEVLQKLNHPRIVSLKAFYEDEANYYMVMEFISGGDLMDFVAAHGAVGEEAGREISRQILEAIQYIHSKGISHRDLKPDNILIEQDDPVLVKITDFGLAKVQGNGSIMKTFCGTLAYVAPEVIGGFTGATGEEETEEERIEYSSLVDMWSMGCLVFVILTGHLPFSGSTQEQLYEQIRKGSYHEGPLKDFRISDEARDFIDGLLQVDQSKRMTVDDALNHPWIKQCSSQFDANSMSSQVSLSQSMSQQKALESLDDAQYEFLKAQKKLQQDEPINDKLKDFKVPTQPPTRFTQPKVINPIENIKKYTKSVKKKGSGKFMTFKPLPESVIQESFEIKQGINPFFIGRSDDCNCRIDDNRLSRVHCFILKKRHPIGKSIYESPAQGLDDIWYCHSGSNDSYVNDIRMTPGKKYLLQEGDEIKIIKDKQKDFVIGFQVELNDTTGLFNNGLGIPNEERSVTSQTEDELKLVSRLAKIMAAQRSSTKEANETMDQNRNLLKKVHSVSLSQSITDPSRKVKRAKLDQTDHNAENMQFF

SEQ ID NO: 14218 - protein, 358 aa, Candida glabrata CBS 138
MIPSKRILTDKDVKIWEESETREDILSFIESLAKAVEGFENDQVSEPVSDSVQSTIAVLTEIDKLIKLHPVIQDKNTSRFGKVEFRDFYDDVCEKADDLLSSHFPALTSEQIEQLSIYLQESWGNKRRIDYGSGHELNFICFLYGLTHYKIFDLQRDARNLVLVLFIEYLKIMREIETLYWLEPAGSHGVWGLDDYHFLPFLFGAFQLAPHKHLKPKSIHNEELVEMFADKYLYFGCIAFINSVKTSTSLRWHSPMLDDISGVKKWSKVAEGMIKMYKAEVLGKLPIMQHFYFSEFLVCPEGISEPRTHIHNGDEDDDQCCQDGAAHNTWGDCCGIKIPSLYAANAMEKQSHKPIPFD

SEQ ID NO: 14219 - protein, 721 aa, Oryza sativa Japonica Group
MAAATALDSLPAPLRSLRLKTKQQELLLRVSALALIYVLAFVVRLFSVLRYESMIHEFDPYFNYRTTLFLSDHGFSEFWNWFDFESWYPLGRVVGGTLFPGLMVTAALLHRLLRALSLAVHIREVCVLTAPFFAANTTLVAYAFGREIWDSGAGLVAAALIAVCPGYISRSVAGSYDNEGVAIFALLLTFYLFVRAVNTGSLAWSLASAFGYFYMVSAWGGYVFIINLLPLYVLVLLVTGRYSQRLYVAYNSTYVLGMLLAMQIRFVGFQHVQSGEHMAAMGVFFLLQVFFFLDWVKYLLNDAKLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSKSPQTVSGKSSGSKAAAKGAVDQSLPFQQNVAIALLLGAFYLLSRYAVHCTWVTSEAYSSPSIVLAARGHNGGRVIFDDYREAYYWLRQNTPSDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGAAPKMLNCLMYKLCYYRFGELTTEYGKPPGYDRVRGVEIGNKDIKLEYLEEAFTTSNWIVRIYKVKPPKNRS

SEQ ID NO: 14220 - protein, 291 aa, Magnaporthe grisea 70-15
MSDSTPTEAAVAESNTAGNEATTNSDKASPETTTTSTTEPGNTAKTAAAERMARFRALQARAKTSSDQNLKAATAESRREASDPSQLTALHRRHAIASHKILKADVEESGGDFERKRAWDWTAEESERWDKRVKKKEAARDNNAFQDYRHEAEKIYKRQLKNMPPDMERYAKDKMAAIDKAAAAGTLDIVETEDGELIAVDRAGTFYSTTDSTDFAKNKPDKEAIDRLVNDMKKAEDVAAKKRKARMAKNGEDDDVTYINDKNKQFNQKLARFYNKYTAEIRESFERGTMI

SEQ ID NO: 14221 - protein, 309 aa, Propionibacterium acnes KPA171202
MSGATAKVTVVGSINADMRVGVERFPGPGETLAGGEATLTPGGKGANQALAAARCGVQVAMVGAVGKDPTAETALSLLSEGVGLDGVVRRDVLTGTAVVMVADSGENSIIVIAAANGTVDAQTVRAQAERIQDADVVVCQGEIPPDGIAEAARGAKRFVFNLAPVVDVDPEVIRMADPLVVNEHEAALVALALGSTTSRLEDDPDAALRELLNLGCRSVVITLGSAGCIVGGPEGFDAVAAATVKAVDTVGAGDAFVGALAAELARGRTLVEGCRFATAVATLTVTKPGAQASYPSADEVESIRRGEHA

SEQ ID NO: 14222 - protein, 163 aa, Glycine max
MNQWAIQPKAFAAGGEQSVVVCPKPRRIGLGNHLHHPSSRSLRCYFSQQVESKAETDILDIILTKEQVNHSQVLDSPSPFLCGSPPSRVANPLTQDARFRDEIKLVSSSPITTPLGQPPSSPSSSGRKGGCVRGNFGNSPAVRIEGFDCLDRDSRNCSIPALA

SEQ ID NO: 14223 - protein, 396 aa, Zea mays
  misc_feature (274)..(274): Xaa can be any naturally occurring amino acid
  misc_feature (282)..(283): Xaa can be any naturally occurring amino acid
  misc_feature (296)..(296): Xaa can be any naturally occurring amino acid
  misc_feature (312)..(312): Xaa can be any naturally occurring amino acid
  misc_feature (340)..(340): Xaa can be any naturally occurring amino acid
MYRAAGSHLRSLKNHGASRFASTSVVKQSSGGLFSWLLGGGSSQLPPLDVPLPGITIPPPLPDFVEQSKTKITTLPNGIKIASETSPGAAASVGLYIDCGSIYETPASSGASHLLERMAFRSTANRSHLRLVREVEAIGGNVSASASREQMSYTYDALKSYAPEMVEVLVDSVRNPAFLEWEVKEQLQKIKSEISEVSSNPQGLLLEALHSAGYSGALAKPLMATESAINRLDISTLEEFIHENYTAPRMVLAASGVDHDALISVVEPLLSDLXCVKRPEEXXSVSVGGDSRCPAXSRLPLTLAFGVPGGWXSRAPALVVPGPLVPMGGGGSFFAGGPGXGVALRLALRVVPPLPPSPVLLSPFRRSPPALSVFSPLLRCLSLAPSVSPFPPPSPS

SEQ ID NO: 14224 - protein, 401 aa, Zea mays
  misc_feature (33)..(33): Xaa can be any naturally occurring amino acid
  misc_feature (107)..(107): Xaa can be any naturally occurring amino acid
  misc_feature (124)..(124): Xaa can be any naturally occurring amino acid
  misc_feature (200)..(200): Xaa can be any naturally occurring amino acid
  misc_feature (257)..(257): Xaa can be any naturally occurring amino acid
  misc_feature (284)..(284): Xaa can be any naturally occurring amino acid
  misc_feature (312)..(312): Xaa can be any naturally occurring amino acid
  misc_feature (333)..(333): Xaa can be any naturally occurring amino acid
MASSPRSPPAPTPEFEISRQSRLFAALSKKVIXLDELRMLAAQGVPDAAGVQATVWKLLLGYLPNDRALWPVAVGAEELAKKRGQYAAFKVFTPNPEFAKVQTEGPXNVNAEHVHNGFLHRSEXTREEHPLSLGKTSAWNQFFEYSEIMEQIDRDVKRAHPDMHFFCSDSSFAKSNQESLKNALLIFAKLNAGIGYVQGXNEILAPLFVFRSDPDDKNAVWTGSLFCFVELVSGFRDNFCQKLDNSAVGVRATLADXAKLSQLVAKHDGGLQQHLEITTELSVXVNPQFYAFRWIPLPLTEEFNFADTIHIXWDTVLSDRDSLQDTLLRICCXLVRKRLWAGDFTSILELLQNYLPTNISHHLYSAHKLQCTDLFLRPKRCCVCSAGLWLSPSSIAKGIQN

SEQ ID NO: 14225 - protein, 346 aa, Rosa odorata var. gigantea
QKWSNGEHSNELLHAQSHIWNHIFSFINSMSLKSAIQLGIPDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSRNLKYTGGDMFEAIPPANTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 14226 - protein, 893 aa, Candida glabrata CBS 138
MINAIQPPTKAEQNNIKAIIGNSYNRLYSQFSSSELTEVGNYKIQKQIGEGSFGKVYLATHRPTKQKVVLKTGDKSDPNVVREVFYHRQFDYPYITKLYEVIVTETKVWMALEYCPGKELYDHLLSKSRLPTLECAELFAQITGAVHYAHTLNCVHRDLKLENVLLDKNGNAKLTDFGFTRESMTKAVLETVCGTTVYMAPEMIQHKPYDGFKVDIWSLGVILYTLLCGCLPFDEDDDLLTKQKIINDTPVIDERITIPEAQNLIEQLLSKDPTERPNTSAILLHPFLQPYGTLILEQTNKIILKQKQGGSQFSSRLERRLIKKMKRIGYDTQAIRQSVIKKKCDSLSGLWFLLAEKEKKIDDKNRPRRSRSLLSVRKVFDDSTQDLLTGDDGLLTTSLEVTRVGSIGKILNKQAERVTSLAPMGVKKSIDFSTRSLNLTLTNTNQSQDNNTKNQESVTFSKEQVRRVQSGTNASTQNEQSPKKTNIFKKMSKFFKEKKYFSNLNNEESASSTNTMRRSLETSLGASSHNKESVSPEKGNSINEDENRNEKFDSTDKRKPIKQSEKATMVLLPEDRHKLTITEPNVTRLKSSSVTSRQTSTDNDDSESMDNSRSGSAEIKKRNLVPTARPFSGLSEISNDTYNSDYSTDGNTSSYRVNDPPLSQIMKTNSGGTSQYSGNSEKLTNGTGRRYIRRNQSLISNASSASEKSSRTDSFYDITTASPPAFIDNRSKNNFGLKESILPRFGAHHSWGPKRSYASNRVGSLGRRAQKRNYLKNNSSRTTQSIIKEEDSSDNDETDVSYHSYRYNNNKSPLNAFRSGGTPEYGEDKLISSSPLQTFGNVEHTPPKSATDSPEAFNGIYAPVVSNRIPSKNIVEDEELISAADLEDNFSDD

SEQ ID NO: 14227 - protein, 423 aa, Coccidioides immitis RS
MELSDEQLGALDVDIDVQEVLLAAAQHDISRMRELIQSYDKPGNPVNVKDPETGYTPLHAAIAACEPDSEEPDERQEANGLGNTPNRLPKVDSSDVLESGGEMIKFLLQEGGIWNDLDANDETPGCMAKRMGLDALYQLMVDAGVRAEMLLNRLDEYAPLQDEDEEIDDDNLSTGGAPGQTEVQQPNEQAATAQEGNTATAQEPDVTSSRYLQSNLTFTDNHLLDQDQNGVMMSWESGIMERSAKSILPEAGLRVLNIGHGMGIVDDIFQSLQPAVHHIVEAHPAVVAEMKRKGWHERPGVVIHEGKWQDILPELVNEGQTFDAIYYDTFAESYSDFRDFFSEQVIGLLDMNGKWSFFNGMGADRQISYDVYQKVVEMDLLEAGFDVDWEEIGVPSLEGEWNGVRRRYWVVDSYRLPVCRYLD

SEQ ID NO: 14228 - protein, 481 aa, Sinorhizobium meliloti
MATPLCQPAASHFIDGTFIEDRTGPEILSVNPVDGEIIAKLHGATSCIIEKAIASAKRAQKEWARKEPAERGRVLSRAADIMRARNRELSVLETRDTGKPISETLVADAASGADCLEYFGAIAATLSGDSIQFGEDWVYTRREPLGVCLGIGAWNYPIQIAAWKAAPALACGNAMIFKPSEVTPLSALKLAEILTEAGLPPGVFNIVQGAGDVGAELATHPAIAKVSLTGSVKTGARVASAAMAGIRPVTMELGGKSALIVFDDADVEAAVSGAILGNFYSAGQICSNGTRVFLQRGIREAFLARLLARVAALKIGDPMDEETDIGPLVSAAHRNRVATYVARAEVEGAYQMAPPRKLPPGDAWHEPVVFTNVTDWMTLAREEVFGPVMAVLDFDDEQDVVARANATDFGLAAGIFTRDLVRAHRLAAELEAGTVWINAYNLTPAGMAFGGIKRSGIGRENGRVAIDHYTQLKSVFVSMQT

SEQ ID NO: 14229 - protein, 346 aa, Rosa odorata var. gigantea
QKWSNGEHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLKWILHDWSDQECIKILRRSRVAITSKDKKGKVIIIDMMMENQKGDEESIETQLFFDMLMMALVGGKERNEKEWAKLFTDAGFSDYKITPIL

SEQ ID NO: 14230 - protein, 346 aa, Rosa odorata var. gigantea
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 14231 - protein, 587 aa, Arabidopsis thaliana
MLRILGRRVVSASKELTSIQQWRIRPGTDSRPDPFRTFRGLQKGFCVGILPDGVDRNSEAFSSNSIAMEGILSELRSHIKKVLAGGGEEAVKRNRSRNKLLPRERIDRLLDPGSSFLELSQLAGHELYEEPLPSGGIITGIGPIHGRICMFMANDPTVKGGTYYPITIKKHLRAQEIAARCRLPCIYLVDSGGAYLPKQAEVFPDKENFGRVFYNESVMSSDGIPQIAIVLGSCTAGGAYIPAMADESVMVKGNGTIFLAGPPLVKAATGEEVSAEDLGGATVHCTVSGVSDYFAQDELHGLAIGRNIVKNLHMAAKQGMEGTFGSKNLVYKEPLYDINELRSIAPVDHKQQFDVRSIIARIVDGSEFDEFKKQYGTTLVTGFARIYGQTVGIIGNNGILFNESALKGAHFIELCSQRKIPLVFLQNITGFMVGSRAEANGIAKAGAKMVMAVSCAKVPKITIITGASFGAGNYAMCGRAYSPDFMFIWPNARIGIMGGAQAAGVLTQIERATKKRQGIKWTEEEEEAFKKKTVDAYEREANPYYSTARLWDDGVIDPCDTRKVLGLCLSAALNRPLEDTRFGVFRM

SEQ ID NO: 14232 - protein, 346 aa, Rosa odorata var. gigantea
QKWSNGEHSNELLHVQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLTLTPFLTAMLDPVLTKPWNYLSTWFQNDDPTPFDTTHGMTFWDYGNHQPSIAHLFNDAMASDARLVTSVIIDDCKGVFEGLESLVDVGGGTGTVAKAIADAFPHIECTVLDLPHVVGDLQGSKNLKYTGGDMFEAVPPADTVLLKWILHDWNDEECIKILKRSRVAITSKDKKGKVIIIDMMMENQKGDEESIETQLFLDMLMMALVGGKERNEKEWAKLFTDAGFSDYKITPIL

SEQ ID NO: 14233 - protein, 346 aa, Rosa odorata var. gigantea
QKWSNGEHSNELLHAQAHIWNHIFSFINSMSLKSAIQLGIPDIINKHGYPMTLSELSSALPIHPTKSHSVYRLMRILVHSGFFAKKKLSKIDEEGYTLTDASQLLPKDHPLSLTPFLTAMLDPVLTKPWNYLSTWFQNDDPTPFDTTHGMTFWDYGNHQPNIAHLFNDAMASDARLVTSVIIDDCKGVFEGLESLVDVGGGTGTVAKAIADAFPHIECTVLDLPHVVGDLQGSKNLKYTGGDMFEAVPPADTVLLKWILHDWNDEECIKILKRSRVAITSKDKKGKVIIIDMMMENQKGDEESIETQLFLDMLMMALVGGKERNEKEWAKLFTDAGFSDYKITPIL

SEQ ID NO: 14234 - protein, 331 aa, Streptococcus pyogenes str. Manfredo
MSIRSLFGGLREKILGKNMKIVFPEGNDERVVRAAARLKFEGLLEPIILGQSEEVRNLLTKLGFADQDYTIINPNEYADFDKMKETFVDIRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNPDLALDGELQFDAAFVPETAAIKAPDSAVAGQANTFIFPDLQSGNIGYKIAQRLGMFDAIGPILQGLNKPVNDLSRGSSAEDIYKLAIITAAQAIESQG

SEQ ID NO: 14235 - protein, 369 aa, Oryza sativa Japonica Group
MSDPSTPRKIEDAKNISIYNDVIDFTLFELETITKSFRADYVLGEGGFGTVYKGYIDENVRVGLKSLPVAVKVLNKDGHQGHREWLTEVRFLGQLRHPNLVKLIGYCCEDDHRLLVYEFMFRGSLENHLFRRTATPLSWATRMSIALGAAKGLACLHNAERPIIYRDFKTSNILLDSDYTAKLSDFGLAKAGPEGDQTHVSTRVMGTYGYAAPEYVMTGHLTARSDVYSFGVVLLELLTGRKSIDKSRPSREHSLVDWALLKLNDKRRLLQIIDPKLEGQYSVRAAHKACSLAYYCLSQNPKARPLMSDVVETLEPLQGSGGSDGAVQSVLGSGLPSYRVNRRLTTNSVHCRAIPNPKCSPAVPACRVR

SEQ ID NO: 14236 - protein, 382 aa, Oryza sativa Japonica Group
MAHGGGGRAKVTPNLAMDEEGTRVLNITVLQRLDPAVEDILITAGHVTLYDFDTNLNQWSRKDVEGSLFVVKRNAQPRFQFVVMNRRNTDNLVEDLLGDFEYQLQVPYIMYRNAAQEVIGIWFYNSQECEEVANLFSRILNAFSKATPKPKAPSIKSEFEELEAAPTLVEGPLEPQTSNIIPATTHVQEDPLSAFFSGAINVGSASGLSVAGQLNQSFGSTPLSSHAPTSISISQPPAVHHLLPSQTSSVISPDVHGGTGAVVNRSASLLNPSLFSPLTSSQTTMARTNPVAPTAPPQHPRITQQPHSAPLLQPFPLPTASPSPPYGTPLLQPFPPPNPSPSLASAPVYSPVLSREKVRDALLRLVENDDFIDLVYREIVKG

SEQ ID NO: 14237 - protein, 400 aa, Zea mays
MCCVMQKKKKPLERLPHKRHSSPLAHSSAPSRIQIVRQQSPKPYSTTRSPTDASPTSNSTPHRARESRIPTMATIQHQAKPAVAAAPSTTTGGGQRAMDLYEKLEKVGEGTYGKVYRAREKATGRIVALKKTRLPEDDEGVPPTAMREVSLLRMLSQDPHVVRLLDLKQGVNKEGQTILYLVFEYMDTDLKKFIRGHRSNNEKIPAATVKILMYQLCKGVAFVHGRGVLHRDLKPHNLLMDRKTMALKIADLGLSRAITVPVKKYTHEILTLWYRAPEILLGATHYSTPVDIWSVGCIFAELVTNQPLFPGDSELQQLLHIFKLLGTPNEQVWPGVGKLPNWHEYPQWKPTKLSALVPGLDADGYDLLEKLLEYEPAKRIPAKKALEHPYFKDVRKGDAH

SEQ ID NO: 14238 - protein, 1528 aa, Arabidopsis thaliana
MVLSRRFAQVSSDEEDDVPITRSKGRNSASPEESLGKRRKRKTVKLYEDFEEKEADRKKKRKGNKEDEDMAEGDDDQAEEETNPEAEEEEDEEEEEKPDDACPVGDSVNVTGKGKGKRTHFNQFAYDGNTYDLEVPVLLVPEDKSQKPYVAIIKVLDITQTKDGSMMILGQWFYRPEEAEKRGGGNWQSSDTRELFYSFHRDEVPAESVMHRCVVYFVPAHKQLPKRKNNPGFIVRKVYDTVEKKLWKLTDKDYEDSKQREIDVLVKKTMNVLGDLPDLESEDMLVDQENVLKAKRSFRKVNISPVDVRREEDASLKAETPGSGAGISSEHYAILEKFDSLTGDAHRDKCLGKLLEAVQHICYIPENKQAGDEAKVGSDASHLEQDEKDTKPENGKDEKFLWPDAAVPQVCALENASHASLASDFQKYNQKMRTLVFNLKNTALLARRLLNGELEPATILNMSPTELKEGLTADETTKKEPDDADRMQMTSVRCSRCSQLTVGLRDIIQAGHGDRYQLECVDCGYSWYASRDEVSTLTIVTDKPAQGTEKEDIEKNLTSPRETNKPKDEALKTNDSNADNNPEASKKPEWKLHGQYVCAPQAVLLSINGVRIMRTLDGIRLHWWPIYNWEMTLPLIFNSTSSCSDDFAVKSEVVEIIEEHKMIQCFMSLCCNEKTTMEYEEYEEVSLPLIHEHLMMPCNYLTRADCCGRFGFTSGGYYCESCSFLVHRKCVEDSSEYIEHPSHSVHPLKLQSKPDHICDICDKRIVDLCYHCEICDFNVDLYCAKYPPPKVIDISETHHHKLTLLKKGIKFDCGASKCGEVMYGFPYKCHECDLAFHVDCVWNPPEAKNPSEVNHSHHPLHPLKLHIGQPPDYSDGKCRLCAQKICDRLFYHCSACNFSLDMCCLLNPPSQYVMDLKVHAHELTFRPRLDSFTCNACGLSGDRNPYICVQCDFMIHQECLDLPRLININRHDHRVSRTSVLGVVNSVCGVCRRKVDWTWGGYSCQRCPHYVVHSKCATREDVWNGKELEGVPEEIEDVEPYVVIDENTIQHFSHKEHYLRFHVSALLWEENKRCNACTQPIGLQSFYGCVVCDFILHQNCAESPRKKWHFLHNERLTLVTSKDDYFHCTACDRLSNGFMYQCGDMKLDVLCGSISEPFVHPSHPHHPLYYIPPEEEKQCNGCDNWSSLVLTCIESGCRYFLCFDCARLPQVVKHRVDAHPLSLCYGEKASGKYWCDICEKETNPSTWFYTCKDHRASLHTKCVMGDFARLMPGSTLTYSHISYEVVRNNSMSRPFCRACESHCMYPIILKNTALLARRLLNGELEPAKILNNILLLCANKSRDPNNHILILFLHLAGHRKPAQGTEKEDIEKNLTRSGETEKPQDEALKTNDSNASKNGRRHGESPNSGTHLVQRIDKQFKSGKAYHDNKTKTLVIISLLFPCTIFINNRLFMFIDHKRSKAATTWPSREILILKERNGRRHGETPTPAPTFSKQINKNVRNRLSLSLRLGSSFEIGLQYWFSTHTRG

SEQ ID NO: 14239 - protein, 346 aa, Physcomitrella patens subsp. patens
MAPSANGQKAAVQQRVYIVVRRAEFRELNSHINPNTDDQPYEPEISYLDFAYVDEKQAYAVAIREQILELDENGTHNGRKVAAQTSLSLKERLKNIHKVVDVAAEAHEDPEAPVVKFEDDEEEEEGDEEEGDEEEVEEEVDEGEEGVEEVEGEEEEDDEEGEDDVIELDDDDEGEEVDDDDDDEDEEDDEGDPTFSTVLLQPSSIVSFPAVVQDSACRHSIRKSVFPVRCRSRLLEKLRLSQGSTGHRSTLKALKRLPWSWSPHTSRPQWQAIVASSCSRPSLKYAFALLASIESFTANTIETMWGLCAAENHMTTTPHGKPLHNAAQTKSKYSTAKDSQTRTLEF

SEQ ID NO: 14240 - protein, 156 aa, Haemophilus influenzae
NRSNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDENEVAKHFAALSTNAKDVEKFGIDTN

SEQ ID NO: 14241 - protein, 531 aa, Streptomyces avermitilis MA-4680
MTVLDETPGETSGEPTDARGRVAELHEIRAQALAGPSEKATDAQHAKGKLTARERIELLLDPGSFQEVEQLRRHRATGFGLEAKKPYTDGVITGWGTVEGRTVFVYAHDFRIFGGALGEAHATKIHKIMDMAIAAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAETSGVCHFAYDDEETCLAEVRYLLSMLPQNNRENPPHAESSDAADRRSDVLLDLVPADGNRPYDMAKVIEELVDDGDFLEIHERWARNIICALARLDGRVVGIVANQPQTLAGVLDIEASEKAARFVQMCDAFNIPIVTLLDVPGFLPGVDQEHGGIIRHGAKLLYAYCNATVPRISLILRKAYGGAYIVMDSQSIGADLTYAWPTNEIAVMGAEGAANVIFRRQIAEAEDPEAMRTRMVKEYKAELMHPYYAAERGLVDDVIDPAETREVLIKSLAMLHTKHADLPSRKHGNPPQ

SEQ ID NO: 14242 - protein, 348 aa, Dehalococcoides sp. VS
MKQGVIEHYRKYLPVTDKTPSITLGEGDTPLVRCPKLEKELGIAELYFKLEGCNPTGSFKDRGMVMAVAKAIEDGFKAVVCASTGNTSASATAYAAASGLESIIIIPSGKIALGKLAQAIVYGAKIIQIKGNFDQALQIVFKLTEKHKVALVNSVNPYRIEGQKTSAFEIVDALGKAPDFLFIPVGNAGNITAYWKGFKEYHQLGKTTSLPKMMGFQAEGAAPIVRGHAIAEPETLATAIRIGNPASWKKAEEARDQSGGIIAMVSDAEIMAAYHKMASAGIFGEPASAAPLAGLIKRIKGGQDFSSSQVVCVVTGNGLKDSDIAIKGAGGFSETEASLGAVEKVLGW

SEQ ID NO: 14243 - protein, 288 aa, Cryptococcus neoformans var. neoformans B-3501A
MSNFSSTPNASTPPQFQQQRVQPQQQAAPSQNQAVPFTTLSASSSVPTPVASAVGVSSPTSGSISSQSVVGGPTGSPAPPPISSNVNGSATPASSSTPVPVPNVSASDTQAAITSAPITTSIPNAQSNTSAPISSSGPTAGLAGNASTSAAAATQTEPQPSNQDTFWAARREEEIARRDRSLAELLVMLDGYKPLIPEEVTEYFLQRSGFDCSDPRLKRLLSLVAQKFISDLSRDAFHFSKLRVNGATAGRGRPAAGVDRNRVVLTMDDLSLALGEHGVNLKAPDYYL

SEQ ID NO: 14244 - protein, 479 aa, Vitis vinifera
MEMLSCLLCFLVAWTSIYIMFSVRRGSQHTAYKLPPGPPKLAKTYGPIMTLKLGYVTTIVISSAPMAKEVLQKQDLSFCNRFVPDAIRATNHNQLSMAWMPVSTTWRVLRKICNSHLFTTQKLDSNTHLRHHKVQELLAKVEESRQAGDAVYIGREAFRTSLNLLSNTIFSVDLVDPISETVLEFQELVRCIIEEIERPNLVDYFPVLRKIDPQGIRRRLTIYFGKMIGIFDRMIKQRLQLRKMQGSIATSDVLDTLLNISEDNSNEIERNHMEHLLLDLFVAGTDTTSSTLEWAMAELLHNPEKLLKARVELLQTIGKDKQVKESDITRLPFVQAVVKETFRLHPVVPFLIPHRVEEDRDIDGLTVPKNAQVLVNAWAIGRDPNIWENPNSFVPERFLELDMDVKGQNFELIPFGAGRRICPGLPLATRMVHLMLASLIHSCDWKLEDGITPENMNMEDRFGITLQKAQPLKAIPIRV

SEQ ID NO: 14245 - protein, 346 aa, Rosa odorata var. gigantea
QKWSNGEHSNELLHAQAHIWNHIFSFINSMSLKSAIQLGILDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 14246 - protein, 346 aa, Rosa odorata var. gigantea
QKWSNGEHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLADVGGGTGTMAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 14247 - protein, 739 aa, Zea mays
MLNGGGGGQKKRNTKIEPYRHRVETDPKFFDKSWRKLHDAIREIYNHNASGLSFEELYRTAYNMVLNKFAPQLYEKLTENMKGHLEEMRTCIEAAQGGLFLEELQRKWNDHNKALTMIRDILMYMDRTYIPTNKKTPVFEHGLELWRDTIVRSPMIQGRLFDTLLELIHRERTGDVINRGLMRTTTKMLMDLGLSVYQDDFERPFLEVSASFYSGESQQFIECCTCGEYLKQAERRLHEESERVSQYLDAKTNEKITAVVVKEMLANHMQRLILMENSGLVNMLVEDRYEDLTRMYTLFNHVPDGLATIRSVMVSHIKDTGKSLVTDPERLKDPVDFVQRLLNMKDKYDNIINVSFSNDKSFLNALNSSFENFINLNNRSPEFISLFVDDKLRKGVKEANEEDLETVLDKVMMLFRYLQEKDLFEKYYKQHLAKRLLSGKAASDDSERSMLVKLKTECGYQFTSKLEGMFTDLKTSQDTTQGFYASTSSELPADAPTMSVQILTTGSWPTQTCNTCNLPPEIVSVSEKFRSYYLGTHNGRRLTWQTNMGTADIKVTFGNGSKHELNVSTYQMCVLMLFNSADVLTYREIEQSTAIPAADLKRCLQSLALVKGKQVLRKEPMSRDIADDDSFCVNDKFTSKLFKVKIGTVVAQKETDPEKLETRQRVEEDRKPQIEAAIVRIMKSRRVLDHNSIMTEVTKQLQPRFMPNPVVIKKRIESLIERDFLERDKTDRKMYRYLA

SEQ ID NO: 14248 - protein, 255 aa, Coprinopsis cinerea okayama7#130
MAIPDAQIHPVATGAAAALVEAHQAPQELVFYAGWFCPFVQRTWIALEEKKVPYQYKEVNPYKKEPEFLAINPKGLVPALAYKGRALYESLILCEFLEDAFPNHTKLLPDDPVEKAHARIWIDHLSKTYVPASHRLLQAQTPEKVKEGRDEVVDSLRKFSEQIRGPFFLGETFSLVDVAVAPWIARDYILREHRGFDRKDVGPKWEEYAKLIESRPSVVQTSSDREHLDVIYGRYLRDEAQSEAAKAIRAGRVIP

SEQ ID NO: 14249 - protein, 577 aa, Vitis vinifera
MNCLRLTQFPKRCLSTRFPSLDPKLNNTKTPFSSPNSTYTTPNSHTFDTPTISQLIAKQHWSKLKTIVKETNPSSLLQHLFNSEAQPDLILCYFKWTQKEFGAIHNVEQFCRLLHLLANAKNYNKIRALLDSFAKNAHYSNSTIFHSLSVLGSWGCANSIIVDMLVWAYVKNGEMDLALEGFDRAGDYGFRLSALSCNPMLVSLVKEGRIGVVESVYKEMIRRRIGVNVVTFDVVINGLCKVGKFQKAGDVVEDMKAWGFSPSVITYNTIIDGYCKAGKMFKADALLKEMVAKRIHPNEITFNILIDGFCRDENVTAAKKVFEEMQRQGLQPNVVTYNSLINGLCSNGKLDEALGLQDKMSGMGLKPNVVTYNALINGFCKKKMLKEAREMLDDIGKRGLAPNVITFNTLIDAYGKAGRMDDAFLLRSMMLDTGVCPNVSTYNCLIVGFCREGNVKEARKLAKEMEGNGLKADLVTYNILVDALCKKGETRKAVRLLDEMTLMEKKGRRANIVTYNVLIKGFCNKGKLEEANRLLNEMLEKGLIPNRTTYDILRDEMMEKGFIPDIDGHLYNVSISS

SEQ ID NO: 14250 - protein, 341 aa, Rosa odorata var. gigantea
QKWSNGEHSNELLHAQAHIWNHIFSFINSMSLKSAIQLGILDVINKHGYLMTLSELTSALPIHPTKSHSVYRLMRILVHSGFFAKKKLSKIDEEGYTLTNASQLLLKDDPLSLTPFLTAMNKPWNYLSTWFQNNDPTPFDTAHGMTFWDYGNHQPSIAHFFNNAMASDARLVTSVIIDDCKGVFEGLESLVDVGGGTGTVAKAIADAFPHIECTVLDLPHVVADLQGSKNLKYTRGDMFEAVPPADTVLLKWILHDWNDEECVKILKRSRKAITSKDKKGKVIILDMMMENQKRDEESIETQLFFDMLMMALVTGKERNEKEWAKLFTDAGFSDYKITPIL

SEQ ID NO: 14251 - protein, 473 aa, Frankia sp. CcI3
MSLLVVGLNHQTAPTSLLERTSVSAEDIPKVLHDLAEGTHVSEAVVLSTCNRIEIYAEVETFHGGVADISDQLSRICGIDLGDLAGHLYVHHEARAIGHLFSVVCGLDSMLVGESQILGQVRTAFRAGQAAGVAGSALSGLFQAALRVGKRAHSETSIDAAGASIVSVGVRLAASGLGLHSEVPAVPVAPPGGRALDGGGVAAEGPRHAVTPEPPPLAGTRVLLIGAGAVGSLAAQTVRRAGAGEVVIANRTAARAARVAEAHEARVVGLTDLAHEITMADLVISSTGASGLVVEHELVAAALPGRAGRPLVFLDLALPHDIDPGVRELPGVSLIDLDALRIALDGAQVTHDVEAVRALVAAEVASFLDRRRAGRVAPTVVALRAHAAAVVRSELARLHTRLPDLDDREWSLVEGSVRRVVDKLLHAPTVRVQELAGAPGGDAYAEALRELFDLPREVPAVVSAPDLDLLERS

SEQ ID NO: 14252 - protein, 346 aa, Rosa hugonis
QKWSNGEHSNELLHAQAHIWNHIFSFINSMSLKSAIQLGIPDIINKHGCPMTLSELTSALPIHPTKSHSVYRLMRILVHSGFFAKKKLSKTDEEGYTLTDASQLLLKDHPLSLTPFLTAMLDPVLTKPWHYLSTWFQNDDPTPFDTAHGMTFWDYGNHQPSMAHFFNDAMACDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRCKEAITSKDKKGKVIIIDMIMENQKVDEESIETQLFFDMLMMALLTGKERNEKEWAKLFTDAGFSDYKITPIL

SEQ ID NO: 14253 - protein, 303 aa, Haemophilus somnus 129PT
MALIKEIKMKVIIPVAGLGTRMLPATKAIPKEMLTLVDKPLIQYVVNECVNAGIKEIVLVTHSSKNAIENHFDTSFELETMLEQRVKRQLLDEVRSICPTGVTIMHVRQGNAKGLGHAVLCGRAIVGKEAFAVVLPDVLLAEFDSNQKTENLAAMLKRFKETGNSQIMVSPVPDKDISSYGIVDCGGVTLNVGESVKISNIIEKPSFDDAPSNLSVVGRYVFSATIWDLLEKTPVGVGNEIQLTDAIGMLIEKEVVEAFHMTGKAFDCGDKIGYMQAFVEYGLQHPQLGENFKTYLKQLVQDL

SEQ ID NO: 14254 - protein, 375 aa, Streptococcus pyogenes str. Manfredo
MTYFDNAATTPLSPNVIRAMTAAMQDNFGNPSSIHFYGRRANKILRECRQAIARNLGASEQQIIVTSGGTESNNMAIKGYALAHQAKGKHLITTTIEHHSVLHTMAYLEERFGFEVTYLPCQNGQINLSDLKQALRDDTILVSVMYANNETGDLLPIKDIGNLLKDHQAAFHVDAVQAVGKLKIIPSELGIDFLSASAHKFHGPKGCGFLYSNGQPIDPLLHGGDQEGKRRASTENMLGIIGMAQALTDAMTCLDQSTDHIISLRHHLISLLEGLPYYINQGTHYLPHVLNIGFLGYQNTILLTQLDLAGIAVSTGSACTAGAVNPSHVLAAYYGDDSSRLKESIRISFSDQNSIEDVNQLAQTLKNILGGTDGF

SEQ ID NO: 14255 - protein, 346 aa, Rosa hugonis
QKWSNGEHSNELLHAQAHIWNHIFSFMNSMSLKSAIQLGIPDIINKHGCPMTLSELTSALPIHPTKSHSVYRLMRILVHSGFFAKKKLSKTDEEGYTLTDASQPLLKDHPLSLTPFLTAMLDPVLTKPWHYLSTWFQNDDPTPFDTAHGMTFWDYGNHQPSMAHFFNDAMACDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRCKEAITSKDKKGKVIIIDMIMENQKVDEESIETQLFFDMLMMALLTGKERNEKEWAKLFTDAGFSDYKITPIL

SEQ ID NO: 14256 - protein, 378 aa, Oryza sativa Japonica Group
MASNDDTNGNWDTKVDAKVPSAFLPPPPGFPPLPVPALADEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDAREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQDISSCVLTVLNTQPRRGRTADGGCSSAGARRRRPVADQLRLPGYQLPSAAAAAAIFIGRCSLNGAACWS

SEQ ID NO: 14257 - protein, 117 aa, Physcomitrella patens subsp. patens
MSSAAEFVEGGAQDPCDEACSICLESFGEDDPATATSCSHDYHLQCIIEWSQRSKECPMCWQPLSLKDPESQDLLNAIGQERALRRRKLQAAQIFHQSAVEDYEFDRVSLLHSIIKS

SEQ ID NO: 14258 - protein, 509 aa, Vibrio sp. Ex25
MTVTFTRILTAVLLFIKEPHMSIWQRVSFTHRFSQLPSAFYTLVEPQPLDNTRWVAWNGEFAQQFGLPAEQSDELLAVFSGQSEFEPFRPLAMKYAGHQFGVYNPDLGDGRGLLLAEIEHQDGTWFDIHLKGAGLTPYSRMGDGRAVLRSTIREYLCSEAMVGLGIPTTRALGMMVSDTPVYREKTEFGAMLIRMAETHVRFGHFEHFFYTNQLAEQKLLADKVIEWHFADCASAEKPYAAMFGEIVQKTADMIAYWQAYGFAHGVMNTDNMSILGQTFDYGPFGFLDDYEPGYICNHSDYQGRYAFDQQPRIALWNLSALAHALSPLVEREDLEASLSQFEVRLSQQFSRLMREKLGLKTKIAEDGRLFEAMFELLHQNNTDYTRFFRTLSNLDTDSSQAVIDLFLDREAARAWLDLYLARCELEVDELGELISAEQRCEQMRQANPKYILRNYLAQLAIDKAEEGDFSELHRLAELLKRPFDEQPEFDDYAKLPPEWGKKMEISCSS

SEQ ID NO: 14259 - protein, 267 aa, Debaryomyces hansenii CBS767
MYSDSRDSVFEWDSDVFSDKFRGNSDVSSQGTLSTPSTGNQYCTPRSISAVESFSYDNTMLQPEVIPRTSIWSASFRSNSESLVPFDPLVVNGAEQKTGEEEYVYQIPPRFVFRSFRGCRFAVEDNARFFVIKSYSGMDVDASIANNIWASTNLGNKRLNRAFDEVRAVRGKIFLFFLVNCSGRFCGVVEMKNNIDFTRTSDVWVEKSRWKGVFPVEWLMIKDVPNRHFQHLKNPLNESKSVTNSRDTQELPFDIGVSMLKIFSSFK

SEQ ID NO: 14260 - protein, 622 aa, Debaryomyces hansenii CBS767
MSEQQGSDNRHHHHHHHHNNHHGDHSGQHDGHNNKVHQPQPIDPKANPANRIGKYQVLKTLGEGSFGKVKLAQHTTTGQKVALKIINRKTLAKSDMQGRVEREISYLRLLRHPHIIKLYDVIKSKDEIIMVIEYAGKELFDYIVQRGKMPEDEARRFFQQIIAAVEYCHRHKIVHRDLKPENLLLDEQLNVKIADFGLSNIMTDGNFLKTSCGSPNYAAPEVISGKLYAGPEVDVWSSGVILYVMLCGRLPFDDEFIPALFKKISNGVYTLPNYLSQGAKDILTRMLVVNPLNRITIHEIIEDEWFKQNIEEYLLPPDLSKTKHKKIEVDEDVITALQSTMGYDRDEIVNVINKCNQHNAPQQQSNEIIDAYLLMRENRTLVKDLKNSKLNNMDTFLSQSPPPSWTNNANNNSNMNINVNHSTKAPGVQQSLTYQTLAAVPDLSTLPNSTIAILPSSLPSIHRAYMMESNMDTQLKIAPVSHKKLKTRWHFGIRSRSYPLDVMGEIYRALKNLGAEWSKPTEEELWTIRVRWKYGPCILPNEKSQEEQQKDIPDMMKMQIQLFQLEPNNYLVDFKFDGWENSSNKDVSIKQDVDEMSSFSAYPFLHLATRLIMELAVNSQTN

SEQ ID NO: 14261 - protein, 236 aa, Oryza sativa
MAGGGDELKLLGMWASPYVLRVKIALSLKGLSYKYVEEDFKNKSELLLSSNPVHKKVPVLIHNGKPICESQVILQYLDEAFPDAGATLLPADPHERAVARFWAAFCDDTIAKASQQASSGKTEEEKAEGEKKVVEALEKMEVGLSECSKGKPFFGGDTVGYVDVVLGGFLAWVRAGDAMKGVKRFDPATTPLLAAWAERFVELDVPKAAMPEVDKLIELAMARMAGAAAAAAAAPN

SEQ ID NO: 14262 - protein, 144 aa, Geobacillus stearothermophilus
MIPTPFPCPNCSQKGARTMNKKTIRDVDVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKN

SEQ ID NO: 14263 - protein, 364 aa, Dehalococcoides sp. VS
MTNTAYLVLEDGTVFSGKSFGAETEAIGEVVFNTSMNGYQEMLTDPSYTGQIIVPTYPLIGNYGVNPFDNESACIRATAFGVHEECLLPSHYQNNQTIHSFLEESGIPGISGIDTRAITRKLRSAGVMRGMITTTKTPEEALKTIRSAPDYGQIDFVRKISTPAAYEWQKEKPSFAGFHIAVLDCGLKYSILNQLKSHGCKVSVLPCTASPQDIDALNPDGVLLSPGPGNPELLDYLINTVRYACEKYPVMGICLGNQLIGKAFGAKTFKLKFGHRGGNHPVKDLASGRVYITSQNHGYSLDPATLKEGLEVSHINLNDGTVEGLRHRELPVFSIQYHSEASPGPMDSTYLFKQFVEMIRQAKK

SEQ ID NO: 14264 - protein, 648 aa, Symbiobacterium thermophilum IAM 14863
MHLRDLTGPEQLKRLAPAELAQLAAEIRRVILETVATNGGHLAPNLGVVELTLALHIVFDSPRDKILWDVSHQSYVHKLLTGRLHQFHTLRQFGGIAGFTDPRESVHDHFHWGHASTSISAAVGMAKARDLAGDDYEVVAVIGDGALTGGMAYEALDHAGHDKTKVIVVLNDNSMSIAPNVGGISNYLARIRTGPSYQRVKHDVAEALRQIPLIGPQALELADRLKEGVKHLLVHNMFFEDLGFTYLGPVDGHNVSALVDVLRQARAYPGPTVVHVVTTKGKGVPYAEQLPDKFHGGGPFDVATGRTGPGSLTYSEVFGNVMCKLAAEDPRVCAITAAMPSGTGLSRFARQFPDRYFDVGIAEQHAVTFAAGLAKGGMRPVFAVYSTFLQRAYDQVIHDVALQNLPVTLAIDRGGLVEDGATHQGVFDVAYLRAIPNMVVMAPKDENELQHMLYTALCHDGPAALRYPRGKAQGVPLDETLQPLPIGRGEVMQEGADVALIGLGTMARVCQEAARLLAEKSISAMVINPRFVKPLDAELLLRAGREVGAVVTVEEACLAGGFGSAVLELYAAHGVNARVERMGIPDEFVDHGQPARYLERYGLTPEGVAQRAEALLLRMRSDLAAQPARRSRSVRRLSGAKAAGNGET

SEQ ID NO: 14265 - protein, 297 aa, Symbiobacterium thermophilum IAM 14863
MRGEFQQYMAARRQQVEAALDRYTAGLDAPSRLVEAMRYSLLAGGKRLRPILTIAASELFGLEAADVMPGACALEMIHTYSLIHDDLPCMDDDDLRRGRPTCHKVYGEAMAVLAGDALLTQAFALMAEQAAVPRVGPARAVRAAAELAHAAGAEGMVGGQVEDLAWEGRQADEPQLRRIHSLKTGALFRAAVRMGGILAGAGEEDLDRLGRYATHFGLAFQIWDDVLDVTGDAALTGKGVGRDARLDKSTYVTLHGVEGARERAYQAVRLALEELEPFGGAGWVLRALAESVVDRVA

SEQ ID NO: 14266 - protein, 346 aa, Streptomyces avermitilis MA-4680
MSTPAADGFRMPAEWTPHERTWMAWPGPNPTFDHPDDLAESCRAWADVARAIRRFEPVTVVCGPGRSAEARDLLGPGIDTVERDLDDAWMRDIGPTFLTDGKGGLAAVDWTFNGWGAQSWARWEHDAKIAAYVGDLAGAKTYASKLVNEGGAIHVDGEGTVLLTETVQLGAERNPGWTREQVETEIHAHLGTSKAIWLPRGLTGDYPPHGFGTLGHVDIVAAFARPGVVVAHHQPDPAHPDHEVSKEVIGLLKAATDAHGRRIEVVEVPAPTVLEADGHWADYSYINHYLCNGGVVLCGFDDPRDETAAGIFRRLFPERTVTLVDARTIFSGGGGIHCITQQQPKN

SEQ ID NO: 14267 - protein, 365 aa, Leuconostoc mesenteroides subsp. mesenteroides ATCC 8293
MSELKPNFFWDEVIEKVQNNHESKQPFFSMAPMEAVTDTVFRRVVAKAAAPDVYYTEFTNASSMVHPKAKFSVQGRLAVAEGEQQPVAQIWGSRPKEIAGSIEVLADMGYQAVDINMGCPDGTVIKNSSGSDLIRHPDLAEEIIVAAQSGSLPVSVKTRLGFYKPEEFREWLPIILRHQVAVLTVHLRSRKEMSKAPAHYEHIDEILAMRDEIAPNTLIQINGDIKTRAQGIALVQEHPGIDGIMIGRGIFENPYAFEKEPRQHTLEESIALLNLQLDLFDEVSETVTTKHFEALKRYFKIYLRGFAHASALRQMLMDTHTTTEVREILTRELAKVYAAVADDKHIYRDNAAASADMALSVNKQK

SEQ ID NO: 14268 - protein, 346 aa, Rosa majalis
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 14269 - protein, 756 aa, Candida glabrata CBS 138
MTASKRHTYYGGGSISYERTNNSEHDKTQRPQDHQGPKHRKHVTFGPYVIGATLGEGEFGKVKLAWSKSAYQQCDNTEGNAGNKPMTFKVPKQVAIKLIKRDFITKDPSKETKIYREINALKHLSHPNIVKLEEVLQNSKYIGIVLEYAAGGEFYKFIQRKRRLKENHACRLFSQLISAVHYIHSKGLVHRDLKLENLLLDNEENLIITDFGFVNEFLRQNGMMKTSCGSPCYAAPELVVSNRPYDARKADTWSCGIILFAMLAGYLPWDDDPKNPDGHDISRLYNYILNTPLKFPEYINPVPRDLLRKILVIDPKKRINIRSIEKHPWLESHSTFLSITPDEWDRLSNTKNIYRKSKPQFYPNKRPGSTYSNYSSGSKDNKRDSLIIDSALVSLPVPPKEFQSHILARPSSLVVESRYSPLGKRNGHNRSNSAASAALQAVFDASERESLKSVDSKPRSRSNDHKDIIEGIQPQKHAFVKPSRKVRPTSMQAPGSSYIHHGNFEGLHELMKRDNSTASSHQTSISSEARIFDASPTLIPDLTKSPSSSTGNSPKLLPRKSFTVSKPLLDLKFASADIIKANESTDSLSKRIHDQIYEVEHPRQRRHSYRYSGIISDLIFGTLSEEGEINTFENKDHKSDAEESEMTISESKLDSVSICSQQSNIHRNISKQASSVSLLRTTSNHSTNNLNVGSRTYGRAELYDKRHLRQIPSNTLNQINAPGNTHRNSAIYSEDDKRKSTAKRVFEFFKRRSMRV

SEQ ID NO: 14270 - protein, 346 aa, Rosa marretii
QKWSNGEHSNDLLHAQAHTWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAVLDPVLTKPWNYLSTWFQNDDPTPFDTAHGMTFWDYGNHQPSIAHFFNDAMASDARLVTSVIIDDCKGVFEGLKSLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALVTGKERNEKEWAKLFTDAGFSDYKITPIL

SEQ ID NO: 14271 - protein, 484 aa, Glycine max
MSTQNRRSSFSSSTTSSLAKRHASASTTSSLAAAPTNMAKKRPPLSNLTNTVAHRNSSSSVPCAAKFAKTKKDVVPACSGNKRPTLANVKPASAVIFPKANSFPVKNEAPPTPPPPVATVTVPAPVVDVSPSKSDTMSVSTDESMSSCDSFKSPDIEYVDNSDVAAVDSIERKTFSHLNISDSTEGNICSREILVELEKGDKFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKYKYVAKKYCPPSIPPEFFQN

SEQ ID NO: 14272 - protein, 346 aa, Rosa marretii
QKWSNGEHSNELLHAQAHIWNHIFSFINSTSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMRENQKGDEESIETQLFFDMLMMALVTGKERNEKEWAKLFTDAGFSDYKITPIL

SEQ ID NO: 14273 - protein, 318 aa, Brassica napus
  misc_feature (307)..(307): Xaa can be any naturally occurring amino acid
LGQDFHESKFIDKEEIEELVFEAETALASFTCSDFFPVAGLGWLVDWFSGQHKRLNDVFLKLDTLFQLVIDDHLNPGRTKDHEDIIDAMLDVIHKQGKNDSLKFTVDHIKGFLANIFLAGIDTGAITMIWAMTELAKKPTLMKKVQDEIRDCLGNNKETITEEDVDKVPYLKLVIKETFRLHPAAPLILPRETMSHMKVQGYDILPKTRILVNTWAIGRDPKLWTEPEEFNPERFIDSHVDYRGQHYELLPFGSGRRMCPGMPMGIATVELGLLNLLYFFDWRVPDGMTQKDIDTEEAGTLTTVKKXVPLKLVPVRVM

SEQ ID NO: 14274 - protein, 606 aa, Vitis vinifera
MKIATYANARTTLEARKGVGKAFIVAFRSGAVMGFLLAASGLLVLYVSIHLFSLYYGDDWEGLYESITGYGLGGSSMALFGRVGGGIYTKAADVGADLVGKVERNIPEDDPRNPAVIADNVGDNVGDIAGMGSDLFGSYAEASCAALFVASISSFGISHDYTAMSFPLIISSVGIVVCLGTTLFATDFVEIKNVSEIEPSLKRQLLISTILMTAGIAVVSFFALPSEFTLFNFGSTKTVKNWHLFFCVSIGLWAGLVIGYITEYYTSNAYSPVQDVADSCRTGAATNVIFGLALGYKSVIIPIFAIAIAIYVSFSMAAMYGIAVAALGMLSTIATGLAIDAYGPISDNAGGIAEMAGMSHKIRQRTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTGGAWDNAKKYIEAGASEHARSLGPKGSDPHKAAVIGDTIGDPLKDTSGPSLNILIKLMAVESLVFAPFFAAHGGLLFKLL

SEQ ID NO: 14275 - protein, 459 aa, Pseudomonas fluorescens PfO-1
MKITVFGSGYVGLVQAAVLAEVGHDVVCMDIDEKKIELLRQGHVSIFEPGLASLVREGLDAGRLQFTCDEILAVQHGKVAFIAVGTPSNEDGSADLRYVLSVGDAVARHREKPLILVEKSTVPVGTGDTLRAHLDKALVKAGRLLQFDIVSNPEFLKEGSAVADCRRPDRIVIGCEREEVRDVMRDLYSPFNRNHDRIMFMDLRSAELTKYAANCMLATKISFINQIAELAEHLGADIESVRQGIGADSRIGYHFIYPGCGYGGSCFPKDMRALIHSAEEAHCSSDLLQAVEAINQRQKHKLFERINAFYKGELRGKTFAVWGLAFKPNTDDMRDAPSRVLLESLWAAGANVRAFDPEAMQETQNLYPDESKLMLMGTPESVLAGSDALIICTEWQQFKAPDFDLIQQRLKAPVIFDGRNLYDAERLARNGFHYFPMGRGESRTLPIPLQQWPHASDVA

SEQ ID NO: 14276 - protein, 346 aa, Rosa marretii
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAVLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPQVVADLQGSKNLKYTGGDMFEAVPPADTVLLKWILHDWNDEECIKILKRSRVAITSKDKKGEVIIIDMMMENQKGDEESIETQLFFDMLMMALVTGKERNEKEWAKLFTDAGFSDYKVTPIL

SEQ ID NO: 14277 - protein, 141 aa, Oryza sativa
  misc_feature (119)..(119): Xaa can be any naturally occurring amino acid
  misc_feature (121)..(121): Xaa can be any naturally occurring amino acid
MAAAWAAAVAVMFLWAPNNYGFSSDETKEMVYYQTVSPKSLVKSVLEEGGWSNLVCSREDHAKSVDVAVLFLGSKLQSSDISKEKQADSTLVDMLKNSFASSEFSMAFPYVAMSDDDNXEXLLSGFAENCTWSNNQSPTQN

SEQ ID NO: 14278 - protein, 388 aa, Streptococcus pyogenes str. Manfredo
MKNQLGQLALEQAKMFGGKLEVQPKVDIKNKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 14279 - protein, 557 aa, Vitis vinifera
MSSLSLRISSSVAATARSESDHRLRLLSSSSPTVATSPALHFCGLRTEALKLGANSNRWKVVSAAVAPQNGSASDEFDYNLVIIGAGVGGHGAALHAVEKGWKTAIIEGDVVGGTCVNRGCVPSKALLAVSGRMRDLQDEHHMKAFGLQVAAAGYDRQGVADHANNLASKIRSNLTNSLKGLGVDILEGVGTILGPQKVKYGKVGSSGNVITAKDIIIATGSVSFVPKGVEVDGKTVITSDQALKLEFVPDWIAIVGSGYIGLEFSDVYTALGSEVTFVEALDQLMPGFDPEIGKLARRVLINPRKIDYYTGVFASKITPAKDGKPVMIDLIDAKTKEPKDTLEVDAALIATGRAPFTKGLGLENIRVETQCGFVPVDEHMQVIDADGKLVPHLYCIGDANGKMMLAHAASAQGISVVEQISGKDNVLNHLSIPAACFTHPEISMVGLTEPQAREKAEKEGFEVSVAKTGFKANTKVLAENEGEGLAKLIYRPDNGEILGVHIFGLHAADLIHEASNAIALGTRIQDIKFAVHAHPTLSEVLDELFKSAKVSSSFPL

SEQ ID NO: 14280 - protein, 377 aa, Yersinia pestis KIM
MPAQNPLQHQRQHDGIYHIGYFVGGKWSQAQEQFDVYNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGIAMRWAVISSSQR

SEQ ID NO: 14281 - protein, 539 aa, Aspergillus oryzae
MADTQAPVNGNYPVPHAYHESYNHAHAVANNASNFQPAQSTTPTNVPSSEQKNAISKDEVGWYFVEQYYTNMSRSPDKLHLFYSRRSQLVFGTEAESVPVAVGQKAINEKIKQLDFQDCKVRVLNVDSQASFDNILISVIGEISNKSEPSRKFIQTFVLAEQPNGYYVLNDIFRYLVDEEDIVNEEPTPAATAASAAPAEPAEPAAEPAADEPTQPETESAPTVESQVADEVTVAKVDEKLDQAEEKAEEEQPEEPAPQANGTEAQTSEDVQEPVALAESEASKTEKPAAPEPTPAPTTQKENVAPAKEPAVPARAVPKTWANIASKSGATAPVVPAIPVAPAKPAPATSSAQSVPAPAAAAATPTPATDSTPSQPPSNDGSGWQTAGHDHKKTQPRASDDQNVMAYIKNVTDKVDATLLKQTLSRFGKLKHFDVSRQKNCAFVEFADPAGYAAAVAANPHQIGTEQISVEERRSRTSAYGGNTNYGAGRGGSGRGRGDRAGSQGRGGFQRDGRGGFAPRGRGGSGNVNAKARNQAQAA

SEQ ID NO: 14282 - protein, 464 aa, Aspergillus oryzae
MLSRSTFSRNAPRAVQKQCSAAGINSRRSMASAATPGLQYDVTEAAGVKLANREVAGPTATLALVAKAGPRYQPFPGFSDALEQFAFKSTLKRSALRINREVELLGGEVSSTHSRENVVLKAKFLSNDLPYFAELLAEVASQSKFAAHELNEVVIKHLKLRQQALAANPEQQAVDAAHSLAFHRGLGESITPSTTTPIEKYLSAEALAEFAQQAYAKSNIALVGSGSNSAELSKWVGQFFKELPSSGSSSQYQLRPGATSKYHGGEQRVSSKAGNAVVIAFPGSAAFGTSGHKPEASVLAALLGGESTIKWTPGFSLLAQATQGFSQVRASTKSHTYSDAGLFTISLSGKADHVASASKNAVDALKKVAAGEVASEDIKKAIALAKFRALESAQSLETGLEATGSALLSGGKPYQIGEIAQSIDAVTEAQVTDAAKNFLSDKASVASVGDLFQLPYGEDLGLTV

SEQ ID NO: 14283 - protein, 136 aa, Glycine max
  misc_feature (31)..(31): Xaa can be any naturally occurring amino acid
  misc_feature (91)..(91): Xaa can be any naturally occurring amino acid
MAMAFPSVTSVTVENVTFPPTVKPPCSPNTXFLAGAGVRGLQIHHAFVKFTAICIYLQYDALSFLSVKWKTKSTHQLTESDQFFSDIVTGXMIKPLTGQQYSEKVAENCVAIWRSLGIYTDSEAEAIDKFLSVFKD

SEQ ID NO: 14284 - protein, 582 aa, Dichelobacter nodosus VCS1703A
MANKQALTIPDIGDFADVDVIEVLVKVGDKIAVDQSLVVLESDKASMEVPASIAGTITSLTVKVGDKVSEGSVIGEIEVANGASAAKTEEKPAEKTAEKPAAAATPAEKTAVPDDAVDLVVIGAGPGGYSAAFRAADLGLKVTLIERYATLGGVCLNVGCIPSKALLHVAEIMEEAEWAKKAGVTFAKPSVDLDALRTHKEGVIKKLTTGLAGMAKARKVTVIQGVAQFTGSHSIHIKTVDGEQNLNFKNCIIAAGSESVKLPFMPTDPRVIDSTGALQLQDIPERLLVIGGGIIGLEMATVYHALGSKIDIVEMMDGLMAGADKDLVKVWQRRNPDLFEHIYLNTKTVAAEAKDDGIHVTFAGDKAPKEAQRYDRVLMAVGRRPNGKTLNVEACGVTVDERGFIPVDKQMRTNQAHIFAIGDIVGQPMLAHKAVHEAHVAAENAAGHQAFFDARVIPGVAYTSPEVAWVGVTESQAAKENIAVEKAVFPWAASGRAIANGCDEGFVKLIVDKASQRVIGGAIVGPNAGDMIGEIALAIEMNAVPADIALTIHPHPTLGETIGLAAEVFEGSCTDLPPQKKR

SEQ ID NO: 14285 - protein, 1400 aa, Oryza sativa Indica Group
MAWFWRMSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHRKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEMNPKGKRSSNCYFYLQLPETKDTCVISKFQCVISSVKSCPTCFIFNMPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRDPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 14286 - protein, 347 aa, Streptomyces avermitilis MA-4680
MARSINLAVIPGDGIGQEVVAQGLKVLSAALPSDVKLETKEFDFGARRYHATGETLTDADLDALKQHDAILLGAIGDPSVPSGVLERGFLLKLRFAFDHHVNLRPSKLLPGVETPLAGQPEIDFVVVREGTEGPYTGNGGTIRTGTPHAVATEVSLNTAFGIERVVRDAYARAQARPRKKLALVHKNNVLVHAGHLWTDIFNKVGEEFPDVTTEYMHVDAATIYLVTQPERFDVIVTDNLFGDIITDLAAAISGGIGVAASGNINPSGAYPSMFEPVHGSAPDIAGQGKADPSATILSVALLLRHLGYEAEAARIEEAVSADLAERVGKPARSTDEIGDALTVRVAG

SEQ ID NO: 14287 - protein, 755 aa, Dichelobacter nodosus VCS1703A
MNHSLKEEALHFHRYPTAGKISVTPTKSLTNQHDLSLAYSPGVAFACEEIQNDALQADFLTARANLVAVISNGTAVLGLGNIGALAGKPVMEGKGVLFKKFAGINVFDIEINETDIDKFVDIVASMEPTFGGINLEDIKAPECFAIEKKLQARMNIPVFHDDQHGTAIIAAAAVLNALKIQNKNCADVKVVVSGAGAAGLSCVDMFIAVGIKAEHIIVCDSKGVIYAGRDGLDERKAQYAAQTSARTLADAMVGADIFLGVSKAGLVSPEMVKSMAEKPLILALANPTPEIMPEEIKAVRDDAIIATGRSDYPNQVNNVLCFPYLFRGALDVGATTINEAMKRAAVEALATLAQLPADEEVISAYDGQRLIFGEEYIIPKPFDARLITTVPVAVAQAAMKSGVARRPIADMNAYIDQLKALFNPHYRVMKPILERAKAQPLKVVFAEGEDLRTLRAVLNCVQEKICTPILIGWRAAIVARLQEYHLPLDSDRDIQIIEPDLHYKNCWQTYQTLCANAGIDPEAIQNQPEMQATVLAALLVHLGHADTLICGTNGHYDHHRQQLDLILALKDGMKTSAALDMLLLPKESVFIADTHIHHQPNAQEITHITLLAEKMLRQLGITPRAALLSRSHFGECPDLESHRVMQEALAAIQKMQPNLEIAGEMQADVALSAEIRHHAGAEKGLNTSANLLIMPNVDAANIAYHVMKVWSNGSAVGSMLLGLQRPAQLMNQEVTARQIFTMAAIAVVAAQTDND

SEQ ID NO: 14288 - protein, 431 aa, Leuconostoc mesenteroides subsp. mesenteroides ATCC 8293
MTEIFKMPDIGEGMAEGDITSWLVKVGDTIAADDPVAEVQNDKLMQEILSPYGGKVTKLFVDAGTTVEVGDPLIEFDGDGSSENDSDNGHVAQPSTSSNVVETEQSTPKNTAPKETSTVQVANGHVLAMPSVRHLAHEKNIDLTQVPATGRHGHVTLADVENFQGSDNSAPTQTQTSTTSQTESSAAVHEEPTPALPLREGRQPMAPVRKAIARAMDRQAAIPTVTNFDSVDVRKLVGHRKAFKEMARDDKGIRLTYLAYAVKALAAVAKKFPELNASVDMKAQEIVYHDDVNMGIAVDAPTGLFVPVIKNADRKSIFTIAQEITDLAEAVRDGSITPAQMQGGTITISNLGSARGTWFTPIINGKEVAILGLGSILKEPIVNDDGELAVGQNMKLSLTYDHRLIDGMLGQSALNYLKQLLSDPAYMLMEV

SEQ ID NO: 14289 - protein, 469 aa, Leuconostoc mesenteroides subsp. mesenteroides ATCC 8293
MVVGAQAREIDTVVIGSGPGGYVAAIRAAELGQKVVIIERDNIGGVCLNIGCIPSKALINVGHRYREATEETPFGLLTSGATLDWQQTQDWKQNKVVHTLTSGVEMLLKKHHVEIVKGEAVFNDNETLNVLQEDGHELLQFNNAIIATGSRPIEIPTIPFGERIVDSTGALGFTEIPKRLIIVGGGVIGSEIGGAYANLGAQVTIIEGLDHTLNGFDAEMTKPVLDDFKAHGGTVVTSAMAKEATQTAKEVTLTYEADGKEQSITGDYLLVAVGRRANTDGLGLNNTDIKVDSKGLITTSDTMKTSVPHIYAIGDVVAGPQLAHKASFEGKIAAAAIAEDAQARDLHYSLPSVAYTQYELATTGETPESVKVNHLEAKISKFPFAGNGRAISMDQAVGFVRLISDKSSNALIGAQIVGPSASDLISELSLAIENGLTTKDISLTIHPHPTLGEAIMDAAELADGLPIHI

SEQ ID NO: 14290 - protein, 432 aa, Dehalococcoides sp. VS
MPDRTGYQPAVSDRKRFLNPFNFAGGVYLMPNARVEDAIADIKAGRFVIVVDDYDRENEGDLVMASEMVTPDAVNFMAKNARGLICVSLTAERLEQLKIPMMVTENTSPYSTGFTVSVEARKKVTTGISAADRAATVQVLIDTAATREDIAMPGHMFPLRAREGGVLVRAGHTEASMDLARMAGLYPSGVLCEIMNDDGTMARLPQLEQKATEWGIKIISVKDIISYRRRTEKMVKKITEAELPTSHGLFKAVAYKSQFDADEHIALVMGDISGPEPVLVRVHSECITGDVFGSKRCDCGEQLDMALNQIAKAGRGVLLYMRQEGRGIGLHNKLCAYALQDKGLDTVEANIELGFAPDLREYGIGAQILVDLGLSKIRMMTNNPKKVVGLEGYGIKVVETVPIIVEPNNYNRHYLETKQKKMGHILHVDKVN

SEQ ID NO: 14291 - protein, 478 aa, Bacillus clausii KSM-K16
MDAHNFIYGQWVPAVDGQTAKSINPGNLNDTVGTYQDSTEADVEQAVQAAQEAAKPWRKLSGAERGAFLYKTADIMEERLDEIAKTAAREMGKTLAETKGETLRGIAILRYYAGEGLRKNGDVIPASDAKALMYTTRVPLGVVAVITPWNFPIAIPLWKTAPAIIFGNTVVLKPASETAVTCAKVVACFEAAGLPPGVLNFITGSGAKVGQSLVEHHRVNAITFTGSNTTGKKIGQTALARGAKYQLEMGGKNPVIVAADADIEQAVDATLSGAFKSTGQKCTATSRAFVDRAVYSTFKKLLLEKTKEIVVGDSLDAKTWMGPLASQNQLANCLAYIEKGLSEKATLLTGGHAIDQEKGSFIEPTIFECRDHHSSIAQEEIFGPVLALFEVDGIEEALRLANDVPYGLSASIFTKNIANMLAFIEDMDAGLIRVNAESAGVELQAPFGGMKQSSSHSREQGEAAKEFFTATKTIFVKA

SEQ ID NO: 14292 - protein, 155 aa, Dehalococcoides sp. VS
MGKEFSGVLNGQGLKVALVVSRFNEFITSKLLSGAKDSLERHGVSADNTDVAWVPGAFEIPLVAQKLAKSGHYDAVICLGAVIRGSTPHFEYVSSEVSKGIARVGLDAGLPVIFGVITADSIEQAIERAGTKMGNKGFDAATQAIEVANLMKNLG

SEQ ID NO: 14293 - protein, 405 aa, Dehalococcoides sp. VS
MAIVVHKYGGTSVGDAERIKHVAKRIIAARQKGSDVVAVVSAMGDTTDDLIALAHKLNDCPEPREMDVLLSTGEIVSSTLLAMALKNMGQDAISLSGQQAGIRTDSAHSKARITGIDPKRIHEELDKGRVVIVAGFQGISDCQDITTLGRGGSDTTAVALAASLGASRCERYTDVDGVYTADPRLIPDARRLSEISYEEMLELSSYGAKIMHPRAVEIGQVYNIPILVASSFNENPGTLIHGGENMEIRNKVSGIAHDFEVAKITILGVPDKPGIAAGLFAPLAKAGVSVDTIVQNSSQDHITDLTFTVTKSDLGKALEVIGPIAKEIQAREVLSDSKIGKVSIIGTGMLNAPGYAARMFKALSDAGINILLISTSEIRITCIIEEDKVKDAVRAIHKAFEMEKD

SEQ ID NO: 14294 - protein, 367 aa, Dehalococcoides sp. CBDB1
MAVTIGIIGLAKSGRTTIFNAATRSNAATGSYSQSSSANVGIVKVPDARLSPLEEMFHPKKLTPAEIKYFDVGASLKGGTKDSSFSGELLTQLQNVDALLNVIRAFEDTAIPLPAGGINAERDLTTMNAELIFSDLTIIEKRLNRIGSQMKSAKPPERAALEREKELMARIKEAMEKDIPVRDMEVDEEEAKILSGYQFLSNKPVLMVINIGEDDLPKAAEMEAELNTRYGGKNYRVIVMCGKLEAELINMDEAEATEFRSSYGLKETGLDRTIRASYDLLDLISFFTVGPDEVRAWTITRGTISQKAAGKIHSDIERGYIRAEIVHVGDLLTAGSLAEVRKRGQLRLEGKTYIVQDGDTANFLFNV

SEQ ID NO: 14295 - protein, 346 aa, Rosa roxburghii
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILERSGEAITSKDKKGKVIIIDMMMENQKGDEESIETQLFFDMLMMALVTGKERNEKEWAKLFTDAGFSDYKITPIL

SEQ ID NO: 14296 - protein, 213 aa, Candida glabrata CBS 138
MGVCVFFPLCLPCPGALTYIREAQFISSWTPADPRHKQLKMFLQRFVTVGGAAIGARSTMGAMGAIGAIGAKGTMNNIGRRMYHPKVIEHYTHPRNVGSMDKTLPNVGTGLVGAPACGDVMRLQIKVNDKTGVIEDVKFKTFGCGSAIASSSYMTELVHGMTLDDAAKIKNTTIAKELSLPPVKLHCSMLAEDAIKAAIKDYKSKRTSTTTLH

SEQ ID NO: 14297 - protein, 346 aa, Rosa rugosa
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECIKILKRSRVAITSKDKKGKVIIIDMMMENQKGDEESIETQLFFDMLMMALVTGKERNEKEWAKLFTDAGFSDYKVTPIL

SEQ ID NO: 14298 - protein, 346 aa, Rosa rugosa
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNNEECVKILKRSREAITSKDKKGKVIIIDMMMENQKGDEESIETQLFFDMLMMTLVTGKERNEKEWAKLFTDAGFSDYKITPIL

SEQ ID NO: 14299 - protein, 97 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCG

SEQ ID NO: 14300 - protein, 496 aa, Rhodobacter sphaeroides 2.4.1
MISLTTYRQEWLGNLRGDLLSGIVVALALIPEAIAFSIIAGVDPKVGLYASFSIAVITAIAGGRPGMISAATAATAVLMVTLVRDHGLEYLLAATVLAGLIQTSAGFLRLGFVMRYVSRSVMTGFVNALAILIFLAQLPELDPRTVPPLTYLLVAGGLAIIYLFPRITRAVPSPLVTIVVLTALTFALGLDVRTVGDMGALPDTLPMFLIPDIPLTFETLQIILPYSIAVAVVGLLESLMTQNIVDDLTDTRSNRNQECIGQGLANTATGFIGGMAGCAMIGQSIINVKSGGRGRLSSFAAGVYLLFMVVVLGDLVSRIPMAALVAIMIMVSIGTFSWSSVKSLRTHPRSSSVVMLATVATVVWTHNLAIGVLVGVLLSGIFFAAKIAQLFGVTSELSKDGRERIYRVEGQLFYASVEDFMAAFDFREALDRVVIDVSRAHIWDISSVQALDMAVLKFRREGAEVRIVGMNEASETMVDRLAIHDKPGAMDRLVAH

SEQ ID NO: 14301 - protein, 285 aa, Staphylococcus epidermidis RP62A
MNEQWMSALPLDNVKDISPVSGGDVNEAFKVTTVEEDTFFLLVQRQRSEAFYAAEIAGLNEFENAGITAPRVIASGEINGDAYLLLSFLEEGSQGSQRELARLVARMHSQYQQDNKFGFRLPHEGADISFDNSWTETWKEIFINRRMDHLQDELLRVGLWKQEDKKMYERVRKVIVDELSNHTSKPSLLHGDLWGGNYMFLTNGQPALFDPAPLYGDREFDIGITTVFGGFTQEFYDEYNQQLPLAKGSQKRIEFYRLYLLMIHLLKFGGMYADSVQRSMKIILE

SEQ ID NO: 14302 - protein, 211 aa, Triticum aestivum
STVRFPAHIQQLDMESNGKRVNINGVVLPFETGEIIFGEPGTNGQHSFYQLMHQGRVIPTEFIGFSKSPQPVHLPGEAVSNHDELMSNFFAQPDALALGKTVAELVAEGVPPHLQPHKEFPGNRPSVSLLFPELNAYRCGQLLALYEHRVAVQGFIWGVNSFDQWGVELGKVLATKVRQQLAAAHRTGNLELDGFNASTSSLLQIYLQHQS

SEQ ID NO: 14303 - protein, 213 aa, Oryza sativa Japonica Group
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPCFWQIRTLKVLW

SEQ ID NO: 14304 - protein, 341 aa, Haloarcula marismortui ATCC 43049
MNGEADLTYVKDAGRNVASVLRSGDTVILESTVPPGTTTEVLAPILSREGLDVGDDVELGYTPETVMPGNTLSELRTNDRIVGGVDEASVRTIKALYESLTSGEIHVSADPTTAEFVKLAQNAKRNVSIAYANTLALLAENYGVDVRSAISLANNHPRVDILNPGPGVGGHCLPVDPHFLSDGTGATELLDVASQVNDRMPEHVVRMVEDAVGSLHGKTVAVLGITYKGNVSDTRNSPGLEVAKLLGDITTEARTAVDGGWGESSVTIHDPRATDSRLQLVSLETAVDGAHAVIFGASHDEFGDLDPEAIGSKMSGRTVIDPVDVIDAERWTDHGFDVRTI

SEQ ID NO: 14305 - protein, 269 aa, Oryza sativa Japonica Group
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 14306 - protein, 329 aa, Yersinia pseudotuberculosis
MSLNVKLHPSGIIFTSDGTSTILDAALDSNIHIEYSCKDGTCGSCKAILISGEVDSAENTFLTEEDVAKGAILTCCSKAKSDIELDVNYYPELSHIQKKTYPCKLDSIEFVGEDIAILSLRLPPTAKIQYLAGQYIDLIINGQRRSYSIANAPGGNGNIELHVRKVVNGVFSNIIFNELKLQQLLRIEGPQGTFFVREDNLPIVFLAGGTGFAPVKSMVEALINKNDQRQVHIYWGMPAGHNFYSDIANEWAIKHPNIHYVPVVSGDDSTWTGATGFVHQAVLEDIPDLSLFTVYACGSLAMITAARNDFINHGLAENKFFSDAFVPSK

SEQ ID NO: 14307 - protein, 955 aa, Yarrowia lipolytica CLIB122
MSLEHIAPLDLENRPQRAIARYKSLEALRGRKDSYPPLRNSVIQETQDDSALDLELSEHSDPNDTNDPNDTNNSNDTSLFATDLSPAASAPVLGTVPPLIPPIVTNTTPFSVPISPRLSTSSSPRFSPRFSPSSLANTLASSLSISPTLGSTVMELPTALARKLSRRGLSTSPPFRSRSSSCPSVEMPITRHKNSEEQSAGNVATVSSILSSESAEVTVPLVLQQGMPFLRITHKKKVQRMFKIDPVTGKVSWDDKKASACFSVDTICEISLQENARNHREELKVSSNHESRWVTITYMKNKRRKPLHLVAPTKEEFTLFVDALQNLVYFRQELMRGFQSSNPKIASVHWKSYAAKEQGEERLTFEAVQRLAQRHHVLCSKAYLKSKFDEADVDKSGFLEFNEFKIFVKLLKRRPEIVTLYYQTLGKPEPANIWSDDRMTRDDLLGFLDHVQRTRFEPHIFEKIWAKFAPKDDTFDSSLDYWTVDSFNDFLLSSYNLFVKPETNLNRPLNEYYISTSHNTYLIGRQVADTSSEEGYIRALQSGCRSVEIDIWDGPDDRPVVKHGRTFTSSVSVEDVCSAIRKYGFIASPNPLILSLEIHCSASNQLKVVDILKGTFGENLVTQPLVPGALNLPSPHELKHRVLIKVKAGREPVAGDKNNGASFSSSYTSSSTTTASEFDDLSGTPSVSGGGKRKDTSGTTKKIVPALGELGVYVQGLKFRNFAFPESKTTNHCFSFSERKFISICKDPENREQMMKHNRRYLTRIYPSGYRVKSSNLNPLYFWQNGAQMVALNWQTYDLPAQLNDAMFAARGGYVLKPPYLRHLKSPRSGHSVNLSFISAQQLPRPKDLGKSSFDPYIVAQLHGPGENHKLKTSPVIDNGFNPRWNKDWSLSLSPEDYEFSFVQITLYTQDRPFAVSCLRLSSLNEGYRHVPLNDLQGEEYLFSTLFMKVSKISN

SEQ ID NO: 14308 - protein, 269 aa, Solanum tuberosum
MVGSVNIDQQGKGGYVSDEILGTFLPIVVYWVYSGLYLMLGTMDNYRLHSKKDEDEKNLVSKKEVVKGVLLQQIVQAAVATVLFAVTGDDGESGGDRHASIFVLGRQLFVAMLMLDTWQYFMHRYMHQNKFLYKHIHAQHHRLIIPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDRILGTYMPYELERRPEGGFEAKPVKDCKEH

SEQ ID NO: 14309 - protein, 148 aa, Glycine max
MARQTFIMIKPDGVQSGLIGEIISRFERKGFYLKGLKLVTVDRPFAEKHYADLSAKPFFSGLVDYIVSGPVVAMIWEGNVVTTGRKIIGATNPAQSEPGTIRGDFAIDIGRNVIHGSDSVESANKEIALWFPEGPANWQSSQHSWIYE

SEQ ID NO: 14310 - protein, 409 aa, Bordetella petrii
MSTDLTQAPAFRRARRIASIAVSEILRIGARAAQLKREGRDVIVLGAGEPDFDTPDNVKEAAIRAMRAGDTKYTLLDGTLALKAAIARKFERDNGLSYGLDEITVGAGAKQVIHNALMATLDEGDEVVVGVPYWTSYADMIAIAGGKTVEVACREDNGFRMAPADLERAITPRTRWVMLNSPSNPTGAAYAEADLRGLADVLLRHPHVWLICDDIYEHLIYGDFAFRTMAQVEPRLKARTLTINGLSKAYAMTGWRIGYGGGPKELIGAMAVVQSQSTSNPCSISQAAAIEALDGPQDVLAERRASFQARRDLVVDGLNAIDGLACRRPEGAFYTYASCAGVLGRRTPGGQRLETDADFCQYLLQDHDVAMVPGTVFGLAPYFRISYATSQAQLQTALDRIARAVALLS

SEQ ID NO: 14311 - protein, 344 aa, Oryza sativa Indica Group
MALSSFSMSLPFAKLPSTSKSTRFLPIRASSAAAAAAASPSFDLRLYWTSLIADVEAELDAAMPIRTPERIHSAMRYAVLPGAGNEGTAKRAPPVLCVAACELLGAPREAALPAAVALEMLHAASLVHDDLPCFDAAPTRRGRPSTHAAYGTDMAVLAGDALFPLAYTHVIAHTPSPDPVPHAVLLRVLGELARAVGSTGMAAGQFLDLAGATALGEAEVMKVLTKKFGEMAECSAACGAMLGGAGPDEEAALRRYGRTIGVLYQLVDDIRSASGNGKMRSNASVLRALGMDRALGIVEELKAQAKMEADRFGDKYGERVLPLYSFVDYAVERGFELQDAATTP

SEQ ID NO: 14312 - protein, 1491 aa, Gibberella pulicaris
MATPDANMSSTRSEQSSHDTIVNNELSTNEKPLQSAPAPGDQTSSTDDEDDGPQTEEMVRRHSIVRDLARNYTNTSHHFNGSNADLFNAADPASPLNPSSENFNARAWAKAMSKSMNENGAGFRQSGLCFQDMNVFGYGAETDYQKDVGNVWLGLPSMAQQLFKPNAGKRRIDILRGFDGVVNAGEMLVVLGPPGSGCSTFLKSISGETNGIYVDDSTYFNYNGIAADEMHKHHKGETIYTAEVDVHFPMLSVGDTLTFAARARCPQNLPSGINHNQYSEHMRDVVMAMYGISHTVNTQVGDNYIRGVSGGERKRVTIAEATLSNAPFQCWDNSTRGLDSANAIEFCKTLRLQSELFGQTCAVSIYQAPQTAYDLFDKALVIYEGRQIFFGPADEAKAYFIGLGFECPDRQTTPDFLTSMTAPSERVVRPGFENKVPRTPDEFATCWKQSQQYQIVRAEVESYKSLYPINGSSADAFRENKQSAQAKGQRLKSPFTLSYMQQVQLCLWRGFKRLVGSPGVTIFQLIANTVVALIASSLFYNMEPTTGDFFKRGAVLFLAVLSNAFASALEILTQYAQRPIVEKHARYAFHHASAESFASILVDMPYKITNSILFNLTLYFMTNLNRDAGAFFFYLLVSFIMVLAMSGIFRSIASISRTLSQAMVPASLLILALVIFAGFVVPVDYMLGWCRWINYLDPVAYAFESLMVNEFSGRNFTCTGFVPNPLIPGYADVDDMNRACSTVGAVPGQSWVNGDDYLNLEYKYFHSNKWRNVGILIAMTIFNHIVYIVATEYISAKKSKGEVLVFRRSNMPANVKSDPEAASSGPIPVTEKNNNEVANIQGSTSVFHWNDVCYDIKIKGEPRRILDHVDGWVKPGTLTALMGVSGAGKTTLLDCLADRISMGVITGEMLVDGKLRDDSFQRKTGYVQQQDLHLETSTVREALTFSALLRQPASTPREEKIAYVDEVIKLLDMQEYADAVVGVLGEGLNVEQRKRLTIGVELAAKPPLLLFVDEPTSGLDSQTSWAILDLLEKLSKAGQSILCTIHQPSAMLFQRFDRLLFLAKGGRTIYFGDIGKNSETLTNYFVKNGSDPCPKGENPAEWMLEVIGAAPGSHTEIDWHQTWRESSEYQEVQGELQRLKAEGNANGGAEIHDAESYREFAAPFGEQLRIATTRVFQQYWRTPSYIYSKAALCIQVGLFIGLVFLNAPLSLRGLQNQMFAIFQVLTVFGQLVQMQMPHFVTQRSLYEVRERPSKTYSWKVFMLSQIMAEIPWNTLMSVFLFVCIYYPVGFQKNAEFAGQTAERGGLMWLLFWQFLIFTCTFAHAAIAITDTAEAGGNLANVVFMLSLFFCGVFGSPDNMPGFWIWMYRVSPFTYLVSAILSTGIGNAEVTCTAQELTTFNPPNGTTCGEYLESYIAQAGGYLTNNDATSDCKFCTIKDTNVYLEALSSSYDNRWRDFGIGMVYIVVNIVGALFLYWAFRMPKNKNKKQKKA

SEQ ID NO: 14313 - protein, 159 aa, Schizosaccharomyces pombe
MFSGIKGPNPSDLKGPELRILIVHARGNLQAIEPLVKGAVETMIEKHDVKLENIDIESVPGSWELPQGIRASIARNTYDAVIGIGVLIKGSTMHFEYISEAVVHGLMRVGLDSGVPVILGLLTVLNEEQALYRAGLNGGHNHGNDWGSAAVEMGLKALY

SEQ ID NO: 14314 - protein, 362 aa, Schizosaccharomyces pombe 972h-
MSATRRIVLGLIPADGIGKEVVPAARRLMENLPAKHKLKFDFIDLDAGWGTFERTGKALPERTVERLKTECNAALFGAVQSPTHKVAGYSSPIVALRKKMGLYANVRPVKSLDGAKGKPVDLVIVRENTECLYVKEERMVQNTPGKRVAEAIRRISEEASTKIGKMAFEIAKSRQKIRESGTYSIHKKPLVTIIHKSNVMSVTDGLFRESCRHAQSLDPSYASINVDEQIVDSMVYRLFREPECFDVVVAPNLYGDILSDGAASLIGSLGLVPSANVGDNFVMSEPVHGSAPDIAGRGIANPVATFRSVALMLEFMGHQDAAADIYTAVDKVLTEGKVLTPDLGGKSGTNEITDAVLANIHN

SEQ ID NO: 14315 - protein, 175 aa, Streptomyces avermitilis MA-4680
MSKHTLSVLVENKPGVLARITALFSRRGFNIDSLAVGVTEHPDISRITIVVNVIEALPLEQVTKQLNKLVNVLKIVELEPSAAVQRELVLVKVRADNETRSQIVEIVQLFRAKTVDVSPEAVTIEATGGSDKLEAMLKMLEPFGIKELVQSGTIAIGRGARSITDRSLRALDRSA

SEQ ID NO: 14316 - protein, 315 aa, Haemophilus influenzae 86-028NP
MPDIKLFAGNATPELAKRISERLYISLGDATVARFSDGEIQVQINENVRGADVFIIQSTCAPTNDNLMELVVMVDALRRASAGRITAVIPYFGYARQDRRVRSARVPITAKVVADLLSIVGIDRVLTCDLHAEQIQGFFDVPVDNVFGSPVLIHDILKKSDLENPIVVSPDIGGVVRARAVAKLLNDTDMAIIDKRRPRANVAQVMHIIGDIADRDCILVDDMIDTGGTLCKAAEALKERGAKRVFAYATHAVFSGAAAKNLASDAIDEVVVTDTIPLSEEMKAIGKVRVLTLSSMLAEAIRRISNEESISAMFN

SEQ ID NO: 14317 - protein, 363 aa, Magnaporthe grisea 70-15
MADTFKESPIKSVQVEALVVMKIAKHCSSSFPTIATGSIVGMDNDTLVEVTNSLNFPTVDVANVDSHQSERDASAQAAAAPRSKANLMYQAEMIKHLREVNVDANCVGWYTSATMGNFVTMSFIENQAHYQRENPKAIALVHDVSRSSQASLSLRAFRLSTAFMTALKENKFTTENLQKTKLTYKDILIEMPVVIHNSHLLTTYLHQIPSAPAAGSETTIPTSLAALQREPVNIPPYPSIDSLELSIDPFLEKTCDLLLDSIEAHYTDLNNHQYYQRQMTREQAKITAWQAKRKAENAARAAAKQEPLPDDEWKRLFKLPQEPSRLEGMLNARQVEQYSKQVDGFTANVSAKMFAVRGSLLTE

SEQ ID NO: 14318 - protein, 228 aa, Schizosaccharomyces pombe 972h-
MVQAKIAPSLLAGDFANLEKEVGRMLKYGSDWLHVDVMDAQFVPNLTIGPIVVKAMRNHYTKEEAFFDCHLMVIEPERYIDQLADAGASLFCFHYEATEKHEEIISRAHEKGMLVGCALKPKTPVEVILPFVEKLDMVLVMTVEPGKGGQSFMPECLPKVEFLRKKYPTLNVEVDGGLSLKTVDAAADAGANVIVAGTAVFHAQSPEEVISGLRNSVMKAQETKPWFK

SEQ ID NO: 14319 - protein, 449 aa, Xanthomonas axonopodis pv. citri str. 306
MRVAIFGTGYVGLVTGACLAEVGHQVVCVDIDQAKLDALNRGLIPIYEPGLEPMVKANHAAGRLRFTSDAAAAIAHGEITFIAVGTPADQDGSADLQYVLAVARTVGRHIDGPAIVVNKSTVPVGTADRVRVAIQEELAARGVAHDFDVVSNPEFLKEGDAVADCMRPDRIVIGAKKPAAIARMRRLYAPFNRNRDRIVEMDVRSAELTKYAANAMLATKISFMNEIANIAERVGADVEQVRNGIGSDPRIGWHFIYPGAGYGGSCFPKDVQALAKTAEQYGMQPTLLNAVESVNNAQKGHLFELVQRHYGTEGAGIVAGKTFAVWGLAFKPNTDDMRAASSRRLMEQLWEAGATVRVYDPEATREARRIFGERDDLTFCDNAFSALEDADALVVVTEWKQFRSPDFGKIKQALKDDVVFDGRNLYDPQEIEAAGLAYYAIGRGRSLYA

SEQ ID NO: 14320 - protein, 308 aa, Oryza sativa
  misc_feature (32)..(32): Xaa can be any naturally occurring amino acid
MAGRKENPVLTACQAPSGRITRAQAAANRGRXPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNS

SEQ ID NO: 14321 - protein, 157 aa, Dehalococcoides sp. CBDB1
MRIGNGYDVHRLAPGQKLVLGGVEIPFECGLIGWSDADVLTHAIMDSLLGAAALGDIGLYFPPGDPKYKGISSLKLLEQVTDLLAKKGFGIINVDSVIVAEEPKLRGHIDTMRKHLAKAMGIDPGRVGIKASTSEQLGFVGRQEGMVAWAVALVDEK

SEQ ID NO: 14322 - protein, 352 aa, Xanthomonas axonopodis pv. citri str. 306
MLPVHRVLRYLGLAVARRTGGGTRMSASKHQVVCFGEALIDMLALPQARPDEARTFAQYAGGAPANVAVAVARLGGAAHFVGMLGRDMFGDFLLQSLQQSGVATDGIVRTDQAKTALAFVALDDAGERSFSFYRPPAADLLFRPEHFAADGFTQAAVLHVCSNSMTEPEIAQCTLDGMRRARADGAIVSLDLNLRPMLWPQDVEPAPLLWEALALADVVKLSREELEYLAGTLDSDASAVTQKLWQGRASWLLVTDGGGPVHWQTRTDSGQVPAFQVQVRDSTAAGDAFVGGLLYQLATRAASLEQLCGDPAVINEVIRFAAAVGALAVTRKGAFAAMPSIDEVHSLIQEQS

SEQ ID NO: 14323 - protein, 462 aa, Cryptococcus neoformans var. neoformans
MHPQNSSTPSTNSPSTFSLPKSSISRKKPPGLDISKSILRPTRTAPVLPANGSSPSNFVSEADRLRDDIANLQLSSRSTGSNHSPEALDSPRAFQSDSSVASGLAKKEKSRDGKERGDKEKRKKKHKDKDGEDLVKDEDLEILHDLGAGNGGTVTKVWNKKRKCVMARKLILVDAKPSIRKQILRELQIMNDCDSPYIVGYYGCFPVDVHVGIVMEFMDAGSLDYIYRHHGAIDIDIVGKVAQAVLEGLIYLYDKHRIIHRDIKPSNVLANTRGEIKICDFGVSGELINSIANTFVGTSTYMSPERIQGAPYTIKSDIWSLGISLIELAVGRFPFSDSPDSEELSPSVSDFDPDPTLPRSVRRPKIESNSRHNGVSQSGGPHAMSILDLLQHIVNEPAPRLASRRRRFPQEAVAFVEGCLIKDPDQRRSPKELLSSSWITNLKTTKEDLQTWAQSMVGPREE

SEQ ID NO: 14324 - protein, 335 aa, Rhodobacter sphaeroides 2.4.1
MARIAINGLGRMGKLLLRELIDRGMGDGIMLLNDAEGDPAQHALLMEFDSVHGRWTTPVTHDAESLTLAGHRIPLRRERRIEDLPLGELGVDLVVDCTGVFKTAAKIAPYFEAVKKVVVSAPVKDGGALNLVYGINHQLYDGSQRLVTAASCTTNCLAPVVKVIHERLGIRHGSITTIHDVTNTQTIVDRPAKNMRRARSALANLIPTSTGSATAIGLIYPELKGRLNGHAVRVPLLNASLTDCVFEVERPTTAEEVNALFAEAAAGPLKGILGYEERPLVSSDFLNDPRSAVVDAASTMVVGGTQVKIYAWYDNEWGYACRMADITRLVAESLT

SEQ ID NO: 14325 - protein, 509 aa, Solanum lycopersicum
MPLNDEEEHHQLLADRLLEEESAYEYSDKVHIIGVDDDDDFTKTPPFSWKKLWAFTGPGFLMSIAFLDPGNLEGDLQAGAIAGYSLLWLLFWATAMGLLVQLLAARLGVATSRHLAELCRDEYPKWARLLLWVMTELALIGADIQEVIGSAIAIKILSRGFLPLWSGVVITALDCFVFLFLENYGVRKLEALFAVLIAVMAVSFAWMFGETKPNGVELLVGVVVPKLSSKTIKQAVGIVGCVIMPHNVFLHSALVQSRDIDNRKIGRVREALNYYSIESTIALAISFMINLFVTTVFAKSFYGSEIANSIGLENAGQYLQDKYGGGSFPILYIWAIGLLAAGQSSTITGTYAGQFIMGGFLHMRLKKWQRALITRSCAIVPTLIVALAFDTSEKSLDVLNEWLNVLQCVQIPFALIPLLCLVSREEIMGVFKIGSTMKVISWLVAVLVMLINGYLLMDSLSSAVSGMLFTSVVVAFTGAYIAFIVYLISRGITFPNWFVKNKSISSIDN

SEQ ID NO: 14326 - protein, 170 aa, Mycoplasma mycoides subsp. mycoides SC str. PG1
MNLKEFVVDVKDFPKQGIVFKDITPLLNNKDAFKYTIDQMADFIKQLDVDVVVAPEARGFLLASAVAYAANKRFVLVRKPNKLPREVYDVEYSLEYGTNHQQIHVGDLKPNDKVVVIDDVLATGGTMQAIIDLVKLSKAEVIGMSFLIDLTFLHDVNLFDQYKVQKLIKY

SEQ ID NO: 14327 - protein, 188 aa, Haemophilus somnus 129PT
MKFNIPTILTLFRVGLIPFFIVTFYLPFHWAPFLTTIIFFIASITDWLDGYLARRWNQSTPFGAFLDPVADKVMVIAALTLVVEYQHVFWVTIPAIIMIFREIVISALREWMAEIGSRGIVAVSWLGKIKTASQMLALGGLLWHYNTLMEITAIVFLYIAAILTVWSMFQYLAAAKKYLLADDKQKSE

SEQ ID NO: 14328 - protein, 330 aa, Dehalococcoides ethenogenes 195
MANEKNLYETLGVAKTASADEIKKAYRKLARKYHPDLNPGDKTAEETFKKINQAYEVLNNPENRAKYDKYGDQWQYGEQFEKARASQQQTQGNPFGGYDFSFGGSEGGGFEDILSQMLGGRMGGRRSRPQPGQSIEQPVDISLEEAASGTSRLLSFQMQKPCETCGGSGAKDKKVCPTCQGTGINPGIERLEVKIPAGVKNDSKIRLAGKGGYGQSGGQRGDLFLRIHVRPNDRFERKDDDLTVNVPVNLTTAMLGGEIFVPALKGKLALKIPAETQNGRTFRLKGQGIPHLGKDGSGDLLAKINIVLPEKLTAAERDLFEKLRQLRPDS

SEQ ID NO: 14329 - protein, 122 aa, Dichelobacter nodosus VCS1703A
MAISKEDILNAISEMTVMEIVDLISAMEEKFGVTAAVAAAPVAADAAPAAEEKTEFDVILTEAGANKVAVIKVVRAVTGLGLKEAKAAVDEAPSTIKEAASKEEAEKIKKDLEEAGAKAELK

SEQ ID NO: 14330 - protein, 404 aa, Streptococcus pyogenes MGAS8232
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYLKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 14331 - protein, 337 aa, Physcomitrella patens subsp. patens
MGIYLSSPKTDKTSEDGENAELRFGLSAMQGWRESMEDAHTAILDVDNTSTSIFGIFDGHGGKLVSKFCAKNLHRQVLKSDAYARGNLGASLEHSFLRMDEMMKGERGWRDLQLLDEKSKMSALRDGQGNDESDSTYWLLQGDHKDYLGPSSGSTAVVALIRSNKLFVANAGDSRCIMSRRGQAVNLSVDHKPELELEKERINKAGGFIHGGRVNGSLNLTRAIGDMEFKYQTNLAPDKQIVTCCPDIREEDLGPDVEFIVLACDGIWDVMSSQQVVDFVRKRLTTANTLSSICEDILDNCLSPSTRQQEGCDNMSIIIVQFKQSSGVASSSADSSL

SEQ ID NO: 14332 - protein, 331 aa, Prochlorococcus marinus str. NATL2A
MTSFITAANPEPTSLEHDTNRLRLISGTSNTALAKEIATYMGITNVPLVSKRFADGELYVQIQQSIRGCDVFLIQPTCAPVNDSLMELMIMVDACKRASARQITAVIPYFGYARADRKTAGRESITAKLTANILVKSGVDRVLAMDLHSAQIQGYFDIPCDHIYGSPVLVDYLSTMKLDEIVVVSPDVGGVARARAFAKQMKDSPLAIIDKRRSGHNVAESLTVIGEVSGKTAILIDDMIDTGGTICAGAELLRKEGAKKVIACASHAVFSPPAYARLSKEGLFEQVIVTNSIPVPSNLDFSQLKVLSVANMLGEAIWRIHEESSVSSMFR

SEQ ID NO: 14333 - protein, 650 aa, Listeria monocytogenes str. 1/2a F6854
MEIFELILLMLSAVFLSNVLSRFLPSIAVPLIQVVLGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAILSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYIIGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKVTADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVIQKLQELDSNEYNPEIISLYLMNFERALGRGKNKKESNDEALQTTIDLASQIERETIQRYFEKGTITRKEMKVYRDNLLAIEANMQLEF

SEQ ID NO: 14334 - protein, 96 aa, Physcomitrella patens subsp. patens
SMSSAVDFVEGGTQDPCEDACSICLETFCEDDPATVTSCKHDYHLQCILEWSQRSTECPMCLQPLSLKDPDSQELLKAVGQERTLRRNKMQASHIY

SEQ ID NO: 14335 - protein, 159 aa, Schizosaccharomyces pombe
MFSGIKGPNPSDLKGPELRILIVHARWNLQAIEPLVKGAVETMIEKHDVKLENIDIESVPGSYELPQGIRASIARNTYDAVIGIGVLIKGSTMHFEYISEAVVHGLMRVGLDSGVPVILGLLTVLNEEQALYRAGLNGGHNHGNDWGSAAVEMGLKALY

SEQ ID NO: 14336 - protein, 462 aa, Glycine max
MGEDGNSWIRRTNFSHTVCHRLDPARLGSIPISVQSEQKSRPSSKAQRHPMTYKQRSLSPLPETYLSEAFREARHEQKRFSTPNPRREKRIMGKLLNKDSRETKESSSKSPSHSPNRQVKSKNRKDSAWTKLLDNGGGKITAVETAEEWNVDMSQLFFGLKFAHGAHSRLYHGVYKDEAVAVKIIMVPEDDGNGALASRLEKQFIREVTLLSRLHHQNVIKFSAACRKPPVYCIITEYLAEGSLRAYLHKLEHQTISLQKLIAFALDIARGMEYIHSQGVIHRDLKPENVLINEDNHLKIADFGIACEEASCDLLADDPGTYRWMAPEMIKRKSYGKKVDVYSFGLILWEMLTGTIPYEDMNPIQAAFAVVNKNSRPIIPSNCPPAMRALIEQCWSLQPDKRPEFWQVVKILEQFESSLASDGTLSLVPNPCWDHKKGLLHWIQKLGPLHQNSGPVPKPKFT

SEQ ID NO: 14337 - protein, 372 aa, Schizosaccharomyces pombe 972h-
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 14338 - protein, 328 aa, Leuconostoc mesenteroides subsp. mesenteroides ATCC 8293
MQKVIIDTDPGIDDSLALLVALKSPELDVIAITVVEGNVPTKIGVQNTLKVLEEVGRTDVPVFEGAHEPLQHEYISAQDTHGLDGLGQSNIAVPMIEASTISAHSAYNQLLTNHNDVWVLALGPLTNIALAMQENPKVWQNMSRLIIMGGSYLSNGNTSPVAEYNFWVDPNAADYVLKNSPIVAEIVPLDVTRKMLLTPNILSLMQRLNPEQSIFITKIIKFYFDFHWQQEHVMGAVINDPLVIIHALYPEYTRGISKYVTVVTEGVALGQSIVDIADFWKKEANAVILTEVDSLHVMAEIIARLLEISSATILTELTNIATDLEVLS

SEQ ID NO: 14339 - protein, 159 aa, Schizosaccharomyces pombe
MFSGIKGPNPSDLKGPELRILIVHARWNLQAIEPLVKGAVETMIEKHDVKLENIDIESVPGSYELPQGIRASIARNTYDAVIGIGVLIKGSTMHFEYISEAVVHGLMRVGLDSGVPVIFGLLTVLNEEQALYRAGLNGGHNHGNDWGSAAVEMGLKALY

SEQ ID NO: 14340 - protein, 1095 aa, Magnaporthe grisea 70-15
MGMRVAAKAVGIDQDAKSRHLPDDLKARALGAVMPLDPFFEEDPTVKEWLLEQRPTLAGTSRYITSITLGFVVVPQAMAYAILAGLRPEFGLYTSFTGAALYWLFGTSKDIAIGATAVVSLLVGKIIEAARAENPESAPEEVSKTIAALSGCFLLVFGMLRLDWLIEFIPHVAIASFVTGASVTITISQMPTVLGIADKINTRDAPYAVFVNTCRALPKATVGAAVGLTAILILHVIKSFCARMAVKQKHKAKMWDTISSIRMTFVILLYTLISFIVNRGLSPEEAKFKILGPVPTGFQAAGTPSFNPDLVKFLIPQLPALLIILIIEHIAIGKSFARLNNYTIVPSQEIISIGAANLLGPFLGGYAATGSFSGTAILSKAGVRTPLAGVFNGLILILALYALTSVFYFIPSAALAGLIVHCVSNLITPPATLVKYWQLAPLDVFIYFVGVFLSIFLSLETGIYATVGLSFLILLLRIARSQGRFLGRARMHVLSSHSKGGGRRPSDASEHWEQRLPSQSSQHSSSLGHGWVNNGREVFLPLDRRDGSNPAVDVSSVHPGVFIYRFTEGCTYLNQAQCVDHIVAHITSHTRKTNMNEYKRPGDRPWNEAAVKKTDQPSDYPNEQNLPLLRAVICDFNTVNHVDSSAVEGLMDMRAQLDRWAAPAAVEWHLAGVRSRWTRRALVAAGFGYPSAVTSGGFWIPGFDVGATSSGDTATVVAEPPRKHPVSRADQECADIADATTRVNSVEDLADCELGLGDRLSSSGTATPGSVAGHLRHVCDEGHADQITNIPNIKCPLRIELVGMLAIRVALFLVPSLVSLLFDTLIPSLAESIKFEGASSLPPRDASQLARTVGLVLVNLALETSVQAGVSTSYTLLTKSPLLQTSTTLPLPWAIIKHVGAMLAAREVLTYLIHRHVLHNRKDGGRVARWHGTYGAHARSGGAAPYSLLLCADHPVSFLLHRFVPLYLPALVLRPHLLTFLLVAALATAEETLAMSGYSVVPGILMGGIARRTAVHCCCSGGARQQGNFGAWGLLDWMCGTSIGKDVMADVRDEAEKHRVKERGEKAASDGVGMIQGGIDGLRRSQRNRNSRRVD

SEQ ID NO: 14341 - protein, 329 aa, Propionibacterium acnes KPA171202
MKILITGGAGYIGSTVGSACEEAGHEVVVLDDLSAGRREFVRDRTFYEGDIADQDLLDRVFSENQIDAVVHCAAKIIVPESVDEPLTYYGNNVGKTVALLKGMERNGVHRILFSSSASIYATDEEFKVTEESALDPGSPYATTKFMVEFILRDAAHASDLKALSLRYFNPIGSDPKLRTGQQIEHPTHVLGKMIDAWMEGSTFTVTGVDWPTRDGSGIRDYIHVWDLARAHVAALEHLDEVTTDDPYQVFNIGTGSGVTVKELVKAFEEGTGKSLNVVYGPPRPGDVAGAYTVSRRAKDLLGWSAELTQADGIRDAIAWLPERKKILGY

SEQ ID NO: 14342 - protein, 181 aa, Nicotiana tabacum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNISNKA

SEQ ID NO: 14343 - protein, 346 aa, Rosa luciae
QKWSNGEHSNELLHAQAHIWNHIFSFINSMSLKSAIQLGIPDIINKHGYPMTLSELTSALPIHPTKSHSVYRLMRILVHSGFFAKKRLSKTDEEGYTLTDASQLLLKDHPLSLTPFLAAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVEILKRSREAITSKDKKGKVIIIDMMMENQKGDEESIETQLFFDMLMMALVTGKERNEKEWAKLFTDAGFGDYKITPIL

SEQ ID NO: 14344 - protein, 480 aa, Desulfotalea psychrophila LSv54
MIVPVIMAGGSGTRLWPLSRALYPKQFLPLVGEETMLQATLNRLAGLDVTAPITVCNEEHRFIVAEQLRFLDQLGKIILEPAGRNTAPAVALAASIALEKGEDPLLLVLAADHVIEDSAGFVQAIQQALPLAEEGCLVTFGIVPTSAHTGYGYIRRGGPAAVGFRVEEFVEKPDAAVAKQYFEGGEFYWNSGMFLFRASTYLAELRKHRADIADACLASLVSTCHDGDFIRVDKDYFLACPEESIDYAVMEKTEDAVVVPLDVGWNDIGSWSALWEVGDKDAQGNRVRGDVFLQETTNSLVHGGDRLIATIGLDNVVVVDTKDALLVATKDRVQEVKQIVQRLKDEGRSEARLHREVYRPWGKYDSIDAGGRYQVKRISVKPDAKLSVQMHHHRAEHWIVVSGTARVTKGEDVFLVTENESTFIPVGVLHALENPGKVDLELIEVQSGPYLGEDDIVRFEDLYGRIESCSDAQSKKKREV

SEQ ID NO: 14345 - protein, 346 aa, Rosa odorata
QKWSNGEHSNELLHAQAHIWNHIFNFINSMSLKSAIQLGIPDIINKHGYPMTLSELSSALPIHPTKSHSVYRLMRILVHSGFFAKKKLSKTDEEGYTLTDASQLLLKGHPLSLTPFLTAMLDPVLTKPWNYLSTWFQNDDPTPFDTTHGMTFWDYGNHQPSIAHLFNDAMASDARLVTSVIIDDCKGVFEGLESLVDVGGGTGTVAKAIADAFPHIECTVLDLPHVVGDLQGSKNLKYTGGDMFEAVPPADTVLLKWILHDWNDEECIKVLKRSRVAITSKDKKGKVIIIDMMMENQKGDEESIETQLFLDMLMMALVGGKERNEKEWAKLFTDAGFSDYKITPIL

SEQ ID NO: 14346 - protein, 345 aa, Rosa odorata
QKWSNGEHSNELLHAQAHIWNHIFSFINPMSLKSAIQLGIPDIINKHGPMTLSELTSALPIHPTKSHSVYRLMRILVHSGFFAKKKLSKTDEEGYTLTDASQLLLKDHPLSLTPFLTAMLDPVLTTPWNYLSTWFQNEDPTPFDTAHGMTFWDYGNHQPSIAHLFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECIKILKRSRVAITSKDKKGKVIIIDMMMENQKGDEESIETQLFFDMLMMALVRGQERNEKEWAKLFTDAGFSDYKITPIL

SEQ ID NO: 14347 - protein, 321 aa, Streptococcus pyogenes MGAS8232
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLITLGIPVVLVSRCFNGMAEPVYAYEGGGAMLQEAGVMFVKELNAPKARLKLLIALNAGLTGQELKDYIEG

SEQ ID NO: 14348 - protein, 346 aa, Rosa odorata
QKWSNGQHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 14349 - protein, 241 aa, Frankia sp. CcI3
MVSRAGLDKRPRDVASMFDGVANRYDLTNTVLTGGLDRTWRRAAAGALDLRPGLRVLDLAAGTATSSRAFALAGTDVVACDFSLGMLRAGQRRLASRPLPGEAGRILLTAGDGLRLPFRDETFDRTTISFGLRNVADTFGCLTELRRVTRPGGMLVVCEFSRPVWALWRTVYVEYLMRALPAVARAVSNSPDSYVYLAESIRAWPAQAELAGLLREAGWSRVGWRNLTGGVVALHRGHAPD

SEQ ID NO: 14350 - protein, 203 aa, Vitis vinifera
MSSLANLARFLRVRPTTSLVVGVQKNSKAWYSTVSFDGGDGDGKNGEGEESDNDLVTEKPNLQLQGVDPRKGWGFRGVHKAIICGKVGQAPVQKILRNGRTVTIFTVGTGGMFDQRIGGKDLPKPAQWHRIAVHNEPLGAYAVQQLVKNSSVYVEGDIEVRVYNDSINGEVKHVPEICIRRDGMIRLIKTGESISNISVDELR

SEQ ID NO: 14351 - protein, 239 aa, Triticum aestivum
  misc_feature (8)..(8): Xaa can be any naturally occurring amino acid
  misc_feature (16)..(16): Xaa can be any naturally occurring amino acid
PAFGGTVXSWEGEGAXPFDETDQDITHQIVDRPTQSHVFLSRHYVQPQWIFDCVNILKVIPTDDYIVGRVPPPHISPFVDNDKEGHIPDYAVTLEGYKSAGQNQVMPLPGLGDEDLGNSIVEAKSEHNEFAKKKKELEMQEKKYHEELKMEIEGTTFSNLSNKKADSAADVADEDEAQAAIDQAEKDADDIAKSVVSRRKRGLIEAMQISNDRKKSKVELLKQRKKAAESSASAKAKRR

SEQ ID NO: 14352 - protein, 337 aa, Microcystis aeruginosa PCC 7806
MSESRRLQFTPDLEICRILNGMWQVSGSHGSIAPQKAIPSMFSYLDAGFTTWDLADHYGPAEDFIGEFRRQLVAQRGIDALNNLQAFTKWVPRPGKMTKEIVAKNIAISLRRMDVDSLDLLQFHWWDYRDKNYLDALYFLGELQQEGKIKHLALTNFDTEHLKIILSAGIKIVSNQVQFSLIDRRPLVKMAQFCQEHNIYLLAYGTLAGGLLGAKYLGHPEPNAMSLNTASLRKYKNMIDAWGNWQLFQELLTVLKAIADSYHVTISNVAVRYVLEQKAVAGAIIGVRLGVAEHIAENARIFDFQLSPQDYQKIDHVLEKSRDLLQLIGDCGDEYRR

SEQ ID NO: 14353 - protein, 534 aa, Artemisia annua
MLSFWSLFWEIHNQNQELAHMILTVSIVVLVLLWYKWTIPYTRKEKTRLPPGPYGLPIVGYLPFLGSNLHEKFTNMADTYGPIFSLRLGTKLHVIVNSMDLAKVIAHDLDHTFANRVPPLTALTITYGASDVIWSNNNTHWRDMRKLLDSQVLSNTSINACQIFRTRAVRNMMNGVYAKIGTKVDINKIAFDTDLDLVTSMLWGCSEAGEGDDSIFTGGGFREVEYKIVELLGAPNISDYLPLLSCFDLHGRQREMQRQLEYVDRNFNNIIKERIKVNSRNIERGDKKDETKDFLQILLDIEDQKDTETSLNTDTATSFNIIHIKALLLDMVTAATDASSTMVEWVMAEIMHNPSVKKKVQDELTMVIGKNVVEESHLPKLSYLDAVIKETFRLHPPLPLLIQRSPDETCKVGGYTIPKGTSVSMNIWAIHRDPKNWSNPLEFKPERFLDGKWDYYVNNMKYVPFGSGRRICPGIVLGEKMLMYIVSSLLHSFDWRLPEDEVSDLSEEFGFVTKKKNSLMAIPSQRFDDDSLYI

SEQ ID NO: 14354 - protein, 507 aa, Prochlorococcus marinus str. NATL2A
MSMPVTNPLRIGLRQERVVPPQCLVIFGASGDLTHRKLVPALFELFKQRRLPSEFAILGCARRPWTDEIFKEKMEEALSSQIKESPKEWELFSQNLFYEPVDLQQPEHLVKLGERLEIIDKLKATHGHRTFYLSVSPKFYGSGCRALAAAGLLKDPKRSRVVIEKPFGRDFNSAQSLNSLVQGCAQESQIFRIDHYLGKETVQNILVLRFANTIFEPIWNRNYISSVQITSSETVGVEDRAGYYESSGALRDMVQNHLTQMLALTAMEPPGHFDPEAIRNEKAKVLQAVKLANEEKPWECCVRGQYSKGGSDEEPLLGYRDEPGVDPNSTTETYVAMKLFIDNWRWQGVPFYVRTGKRLAKRLSEVVLTFREAPVHLFDAAGGCPTSNQLILRIQPNEGAEFSFEVKSPGSGMRSRPVNMEFSYDESFGEPSDEGYVRLLADAMLGDPTLFTRSDEVEAAWRLYTPLLEKIEDSPWELPIYPYESRTWGPTESDLLIGKDQLLWRRP

SEQ ID NO: 14355 - protein, 286 aa, Arabidopsis thaliana
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQCDKSCDNSVLRQVSSLLRRLPAMESERFQDNFLMEYNDKLLITYLAMITNCSSNMNEMVDKFNTAYDRNTRRGGRTAFM

SEQ ID NO: 14356 - protein, 463 aa, Listeria monocytogenes str. 1/2a F6854
MTKVNSFFRKKSFHNPATDKHHLNKSLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYDPSAGTYFDLLAFVVVMVIGILLSFGIRESTRVNNIMVLVKIAVVVLFILVGAFYVKPNNWTPFLPFGVQGVITGASTVFFAYIGFDAVSSAAEEVKNPQKNMPIGIISSLAVCTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFKTPFYPVVPALSFLLCVYLMINLSKTTWIAFGIWFVIGILVYTFYGRKHSALRIK

SEQ ID NO: 14357 - protein, 159 aa, Schizosaccharomyces pombe
MFSGIKGPNPSDLKGPELRILIVHARWNLQAIEPLVKGAVETMIEKHDVKLENIDIESVPGSWELPQGIRASIARNTYDAVIGIGVLIKGSTMHFEYISEAVVHGLMRVGLDSGVPVIFGLLTVLNEEQALYRAGLNGGHNHGNDWGSAAVEMGLKALY

SEQ ID NO: 14358 - protein, 172 aa, Candidatus Protochlamydia amoebophila UWE25
MKEYKGKLNISKARIGIVISRFNETITKNLLEGSLDELERYGISTQNLPVAWVPGAFEIPLIAKQMALSGEFDAIICLGAIIRGTTPHFDYVASQSAAGILNVSLEINLPVVFGILTTDTVEQAMERSGVKMGNKGREAVQTAIEMIDLTDQLSLLRNHPHSSTANNTSVCK

SEQ ID NO: 14359 - protein, 464 aa, Pseudomonas syringae pv. syringae B728a
MAVYNYDVVVLGSGPAGEGAAMNAAKAGRKVAMVDSRRQVGGNCTHLGTIPSKALRHSVKQIIQFNTNPMFRAIGEPRWFSFPDVLKNAEMVISKQVASRTSYYARNRVDVFFGTGSFADETSINVVCTNGVVEKLVANQIIIATGSRPYRPADIDFSHKRIYDSDTILSLGHTPRKLIIYGAGVIGCEYASIFSGLGVLVELVDNRDQLLSFLDSEISQALSYHFSNNNVMVRHNEEYEKVEGLDNGVILHLKSGKKIKADALLWCNGRTGNTDKLGLENIGLKANGRGQIEVDETYRTSVSNVYGAGDVIGWPSLASAAYDQGRSAAGSMVDNGSWRYVNDVPTGIYTIPEISSIGKNEHELTQAKVPYEVGKAFFKGMARAQISGERVGMLKILFHRETLEVLGVHCFGDQASEIVHIGQAIMSQPGEANTMKYFVNTTFNYPTMAEAYRVAAYDGLNRLF

SEQ ID NO: 14360 - protein, 412 aa, Candidatus Protochlamydia amoebophila UWE25
MKTYRLEDALLALKEGKFVIVVDDENRENEGDLILAAEKAHPSSLGFMIRHTTGIICLAMKGQRLDELKLPPMVTDNTDRKQTAFTVSVDYLHQGVTTGVSAEDRTKTILSLIHPHTKPEDLGRPGHIFPLRYKEGGVLKRAGHTEAAVDLTNLAKLYPAGILAELINEDGSMMRLPELEKFSDLHQIPIITIAELIRFRRRHEKLVSCFSQSPIPTPFGDFNAYVYESQLDGIQHIALVKGEIKNQKNILVRMHSECLTGDVFGSKRCDCGSQLKLAMEKIEQEGRGVIIYLRGHEGRGIGIGHKLKAYNLQDQGKDTLEANLELGFPIDSREYGIGAQILVDLGLSTIRLMTNNLAKYNGLAGYDLEITERVPLPVCVTKENKHYLQTKKDKLGHLIDLSEDKLEIHHST

SEQ ID NO: 14361 - protein, 412 aa, Bordetella petrii
MSNHPRAYAVLYSSTFAFTVCFVVWMMFGVLGIRIRQELGLNAFQFGLLTSTPVLTGAVFRLPLGMWTDRYGGRAVMTVLLVGCAIPVYLVSYAQALWQFLLIGLFLGLVGASFAVGTPYVARFFSAERKGFAMGFFGAGTVGAAVNLFVTPILLETYGWRAVPKIYAVALLVTAALFWFVAAPDPGAGKAGGKLLDQFKILKNPRVWRYCQYYSITFGGFTALSLWIPQYFQAEYGLSLVAASALAAGFSLPGAVLRAVGGSLADRYGAHKMTWWCLWLAWICLFILSYPNTTLTVQTLNGSAAFHIYLPIWLFTLLLFVLGAMFAFGMASTFKYVADDFPENMGVVTGIVGLAGGLGGFLLPLMFGAMADLLQIRSSCFMLLYGVVWVSLIVMYLSEVRRVEISGEVAAK

SEQ ID NO: 14362 - protein, 117 aa, Brassica napus
  misc_feature (35)..(35): Xaa can be any naturally occurring amino acid
GPGGFWLRKLKGVGTGLTDNSGDFLTKDIEVGVVXNKNGEPQGLNFNVGGGLGRTHKMEFIFAGLAKQLGFVPKEDILIAVKVMVVTQRDHGRGDNVNFSRMKFLVSSWGIEKFKDV

SEQ ID NO: 14363 - protein, 133 aa, Triticum aestivum
  misc_feature (16)..(16): Xaa can be any naturally occurring amino acid
  misc_feature (22)..(22): Xaa can be any naturally occurring amino acid
  misc_feature (104)..(104): Xaa can be any naturally occurring amino acid
MDECVRRAEVWAGQPXHCIRQXPPEHIYAALAVIIVTILVLVTSTCLKSSKPNTIVLYGLRGRGTTVLCYQLHDGPSHHGSVTPMTHNSATSVLQSDVARKGKXPVHGINVPEHAGLRDIRTSGHQGGPETST

SEQ ID NO: 14364 - protein, 67 aa, Triticum aestivum
MTTSRRVADRKIAVFEKNITKRGSVPETVKKGNDYPVGPIVLGFFVFVVVGSSLFQIIRTASNAGLF

SEQ ID NO: 14365 - protein, 112 aa, Candidatus Protochlamydia amoebophila UWE25
MKKIFVGNLSWKTSEEQLKAHFEAFGKVVSAKIVTDQMTGKSKGFGFVEMESANDAENAIRELNGKPLVDRSLRVSLAQERDRSERREPRSFGGGDRDRSSFGGDRRSNYRS

SEQ ID NO: 14366 - protein, 245 aa, Magnaporthe grisea 70-15
MPAPTAVKPTAAIEDGAAVAPVADNGSMAVEADQAEEFMLDTTDQTLPAASDIAAPTEENTEMAVDEESRPKFSAAKDEGPSVMKETRKVPIPPHRMTPLKKDWTQIYEALVEHLKLQYGSNMLPTEDFVKAYTLGFEVQDAIALIRVPELYIQTFEIKDVKSLTGDHLARGVGRIAGKDGKTKFAIENASRTRIVLADSKIHILGSFRNVRMAQESIVDLILGKPPSKVYGNLRTISARQKERF

SEQ ID NO: 14367 - protein, 327 aa, Listeria monocytogenes str. 1/2a F6854
MGIAVLGGAGYIGSHAVDELITRGYEVVVIDNLRTGHRESIHKKAKFCEGDIRDKAFLSSVFEKEKVDGVIHFAASSLVGESMEVPLDYLNNNVYGTQIVLEVMEEFDVKHIVFSSSAATYGEPERVPITEDMPTNPESTYGETKLIMEKMMKWCDKAYGMKFVALRYFNVAGAKADGSIGEDHKPESHLVPIILQVALGQREKLAIYGDDYNTPDGTCIRDYVQVEDLIDAHIRALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 14368 - protein, 473 aa, Leuconostoc mesenteroides subsp. mesenteroides ATCC 8293
MKKTKIVSTLGPSSSDVETIVKLIQAGANVFRFNFSHGDHEEHLGRMNAVHEAEKITGKTVGILLDTKGAEIRTTKQADGKIEFHTGDTLRIAMDENLEGTKEKIAVTYAGLFDDVKEGGQVLFDDGLLGTTVIEKDSATRELVVRVDNDGILGSRKGVNAPGVSINLPGITEKDADDIRFGLDHEINYIAASFVRKPEDVLEIRGLLKEKNMEHVQIIPKIESQEGIDNLDAILEVSDALMVPRGDMGVEIPAENVPLVQKDMIRKMNKAGLPVITATQMLDSMEENPRPTRAEASDVANAVFDGTDATMLSGESANGDYPVESVATMAAIDEKAETSLRENGRHEDIFFDETDSTEAVAASVARIARNVNAKAVVVSTNSGYTARMVSKHRPDVNILAVTYSERVQRGLTLNYGVVPVVYDAPKTIDEMVDLAKKAVKDQGLANSGDTIVIAAGVPMSQSGTTNMLTVQTV

SEQ ID NO: 14369 - protein, 393 aa, Schizosaccharomyces pombe 972h-
MDKKVYQCTVSAPVNIAVIKYWGKRDVALNLPTNSSISVTLSQDDLRTVTTASCSEKFENDTLWLNGNAEEIFANKRLRVCVEELRKARLDLEEENDDLDKIGALKLHVVSENNFPTAAGLASSAAGYAAFCEAIARLYDLPWTPTQLSRIARQGSGSACRSLFGGYVAWEMGELHSGADSVAVQVEPVENWPEIRVAVLVASAAKKGVSSTAGMQATVASSTLFQHRIQNIVPQRIQEMKTAIRERDFETFAKLTMTDSNQFHACCLDTFPPIFYLNDTSRAVIRVVENINATAGKTIAAYTFDAGPNAVIYFLEENSEIVLNTLYAVTKNAEGWSKQYGSSPVTVDSAAANIVSSGISRVILTRVGNGPRVLTIDESLIDASGNPKFIGSH

SEQ ID NO: 14370 - protein, 422 aa, Oryza sativa Indica Group
MEAQADAGGDDLAAMREQCRSLEEAIGFRRETQMGLVASLQRLVPDLVPSLDRSLRIIAAFNDRPFVPTPNPDGGHGKSPAALKPHHRRALPDPARSTRRKTSPGSSPASVAAAPGGLDAVRTMVAVCLLELVPFAEIDAAALARRLQAESSSASEAERTALADLAAELGGSAASAVVLALRRIAEDTGGVQIEEAMIGGKSMTMVWAIDRNKLLKELPESATLPLLQPPPAPQMPPSETDAGSAMIPRTPQQQQPQPDMWPHSMPPIFPRPRGMTMQGMQRVPGVPPGLMPLQRPFMGPAGVITMGGGVGPSPNQQKQKSEEDELKDLELLLNKKTYREKQNTKTGEELLDLIHRPTAKETAVAAKSHTVSPVVVNELAVADLGFEPRGLNVKTIAYEEMGDTRSKSSKIYIMVSEQDDPA

SEQ ID NO: 14371 - protein, 485 aa, Propionibacterium acnes KPA171202
MMTNDRSLPSDLPTQLLIDGEWVDAEASRTFDVINPATEKPLVAIADASVDQGTDALDAAVRAQHSWADTAPRERAEILRKTFNLVTERKDDFARLMTLEMGKPLAESYGEVTYGSEFLRWFSEEAVRIRGDYGLLPEGNIRQLVTKRPVGPCLFITPWNFPLAMATRKIAPALAAGCTVVIRPASATPLTTLLLAKTFLEAGLPAGVLNVITGLDHAVTDAILEDPRLRKLSFTGSTGVGANLLGKAAKHVLRTSMELGGNAPFIVFDDADLDQAIIGAKGAKMRNMGEVCIAANRFIVHESVAEEFTDKMIEMMSGLVVGDGLDEKSEVGPMITERDREKVDGLVRSAIEAGATLRCGGEIPEDKGWFYPPTVLSGVPADAEIMQTEIFGPVAPITTFRTEEEALALANSVPVGLAGYVFTSDTARILRMGQKLETGMIGANLGVFSNAAAPFGGVKESGLGREGSYQGIEEFLETIYVALPA

SEQ ID NO: 14372 - protein, 279 aa, Saccharum officinarum
DACEKWGFFEILNHGISTELMDEVEKLTKDHYKRVREQRFLEFASKTLKDAQDVKAAENLDWESTFFVRHLPESNIAEIPDLDEDYRRAMRQFTGELEALAERLLDLLCENLGLDRGYLARAFAGPRTGAPTFGTKVSSYPPCPRPDLVSGLRAHTDAGGIILLFQDDALGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKQYVRHKFEAKEPRFE

SEQ ID NO: 14373 - protein, 336 aa, Buchnera aphidicola str. APS (Acyrthosiphon pisum)
MVKNMTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 14374 - protein, 345 aa, Rosa odorata
QKWSNGEHSNELLHAQAHIWNHIFSFINSMSLKSAIQLGIPDIINKHGPMTLSELTSALPIHPTKSHSVYRLMRILVHSGFFAKKKLSKTDEEGYTLTDASQLLLKDHPLSLTPFLTAMLDPVLTTPWNYLSTWFQNEDPTPFDTAHGMTFWDYGNHQPSIAHLFNDAMASDARLVTSVIIDDCKGVFEGLESLVDVGGGTGTVAKAIADALPHIECTVLDLPHVVADLQGSKNLKYTGGDMFEAVPPADTVLLKWILHDWNDEECIKILKRSRVAITSKDKKGKVIIIDMMMENQKGDEESIETQLFFDMLMMALVRGQERNEKEWAKLFTDAGFSDYKITPIL

SEQ ID NO: 14375 - protein, 373 aa, Desulfotalea psychrophila LSv54
MSALRVFISYCCAIIADISEMRIFYFQVELFSLFICLYLSELSQIIGGSTMAGSCGSSCSSQESQQAAMAQQENAITKSLGKIKNKIIVMSGKGGVGKSTVSVNLALGLANRGHKVGLMDVDIHGPDVVRMLNMTGSLEPPESPDDLVATLDYNENLKVVSIEYMLRDRDEAIIWRGPMKIQAIRQFISDMDWGELDYLIIDAPPGTGDEPLSVAQTIPNLKAIVVTTPQQLALADVRKSINFCKVVKLDVIGMVENMSGFVCPECNAVVDIFKSGGGEALAREYDLPFLGRIPMDPRIVIAGDDGAPYLVTDAKSPAVDAFTKVLEAVENRVPPVAPIQMAAPGAVAPKVAPKAASSCGCGTGGCDTEKCDC

SEQ ID NO: 14376 - protein, 346 aa, Rosa odorata
QKWSNGEHSNELLHAQAHIWNHIFSFINSMSLKSAIQLGIPDIINKHGYPMTLSELTSALPIHPTKSHSVYRLMRILVHSGFFAEKKLSKTDEEGYTLTDASQLLLKDHPLSLTPFLTAMLDPVLTKPWNYLSTRFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKNGKVIIIDMMMENQKGDEESIETQLFFDMLMMALVTGKERNEKEWAKLFTDAGFSDYKITPIL

SEQ ID NO: 14377 - protein, 346 aa, Rosa odorata
QKWSHGEHSNELLHAQAHIWNHIFSFINSMSLKSAIQLGIPDIINKYGYPMTLSELTSALPIHPTKSHSVYRLMRILVHSSFFAKKKLSKTDEEGYTLTDASQLLLKDHPLSLTPYLTAMLDPVLTNPWNYLSTWFQNDDPTPFDTAHGMTFWDYGNYQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLRWILHDWNDQECIKILKRSRVAITSKDKKGKVIIIDMMMENQKGDEESIETQLFFDMLMMALVGGRERNEKEWAKLFTDAGFSDYKITPIL

SEQ ID NO: 14378 - protein, 483 aa, Staphylococcus epidermidis RP62A
MGSFFNRMTRKENPTIYQNKDGHLKRTLRVRDFLALGVGTIVSTSIFTLPGVVAAEHAGPAVALSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRE

SEQ ID NO: 14379 - protein, 445 aa, Staphylococcus epidermidis RP62A
MSKVNHLIVEDERYFAHSGRIKYYPLVIDHGYGATLIDVDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKHYGPLLNGFYHIPFPDKYRGMFEQAKPNTVEEYLAPLKEMFAKYVPAEEVACIVVETIQGDGGLLEPVPGYFEALQELCHAHNILIAVDDIQQGLGRTGKWSSVDHYYFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEQALEKLERGELNQYDISGQGW

SEQ ID NO: 14380 - protein, 216 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKEPFVNIPDDKIREALKVVLDPRNQPLLIHCKRGKHRTGCLVGCLRKLQKWCLSSVFDEYHRFAAAKARITDQRFMELFDVSSLKHLTPSHC

SEQ ID NO: 14381 - protein, 346 aa, Rosa odorata
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKQSREAITSEDKKGKVIIIDMMMENQKGDEESIETQLFFDMLMMALVTGKERNEKEWAKLFTDAGFSDYKITPIL

SEQ ID NO: 14382 - protein, 569 aa, Yarrowia lipolytica CLIB122
MNCPTKDTDKTWARPGYNQNPRRFDSNLISNVFFSSGNVPKPATGCDDEDGGKGIPLDAIEERSVNENGSGGSEGPKDQVINHACPSAPPPPPLAPTVLQTIQMAFLKYVRFLGPGLMVSVAYMDPGNYSTAVAGGANHQFALLFVILLSSIIALVLQSLAIKLGSVTGMDLARCCREYLPKWMSITLYIFAEIAIVATDIAEVIGTAIALDILLHIPLIAGVCMTIVDVLIVLFAYRPGGGMRVVRFFEYAVAALVLGVSICFIILLCRIPHQSVRKIFRGFAPSRALIQGTGIVDSAGILGATVMPHSLFLGSGLVQPRLREWDVANGTAPAPDSSKDSEEEYFAYKPTIGAIKYCLKYSIIELVTTLFTLALFVNSAILIVSGATLYGNSDASTADLYGIHSLLRQYISKGAGTIFMLALLLSGQSAGIVCTIAGQMVSEGFLRWTIRPWLRRIITRSIAVVPCVVVAAAVGKEGLNSALNYSQVALTLLLPFLTFPLIYFTNSKKLMKVARDPSVTADDASETTVLAQWLDYSNHWVLAIVCWALWLFIAILNVYLIVQLGMGNY

SEQ ID NO: 14383 - protein, 346 aa, Rosa odorata
QKWSNGEHSNELLHAQAHIWNHIFSFINSMSLKSAIQLGIPDIINKHGYPMTLSELSSALPIHPTKSHSVYRLMRILVHSGFFAKKKLSKIDEEGYTLTDASQLLLKDHPLSLTPFLTAMLDPVLTKPWNYLSTWFQNDDPTPFDTTHGMTFWDYGNHQPSIAHLFNDAMASDARLVTSVIIDDCKGVFEGLESLVDVGGGTGTVAKAIADAFPHIECTVLDLPHVVGDLQGSKNLKYTGGDMFEAVPPADTVLLKWILHDWNDEECIKILKRSRVAITSKDKKGKVIIIDMMMENQKGDEESIETQLFLDMLMMALVGGKERNEKEWAKLFTDAGFSDYKITPIL

SEQ ID NO: 14384 - protein, 299 aa, Prochlorococcus marinus str. NATL2A
MQEAIASFDFAEYLEKARTRVEDALDASLGPEKPEKLRESMRYSLLAGGKRLRPILCLAACELAGGELEKALPTAVALEMIHTMSLIHDDLPSMDNDDLRRGRPTNHKVYGDAVAILAGDALLTRAFEMVSIRTEGIPSERLLKIIGELSLAAGAPGLVGGQVVDLDCEGKEVDLETLEYIHLHKTGALLKACVTCGALIGGADEKLLEALSIYARGIGLAFQIIDDILDVTASSEVLGKTAGKDLIADKTTYPKLLGLDESRRRADLLVAKAKSALDPWPEKSKPLLALADYITSRDR

SEQ ID NO: 14385 - protein, 1390 aa, Arabidopsis thaliana
MAQTGEDVDKAKSFQVEFACGNGVDDEEKLRSQWATVERLPTFKRVTTALLHTGDDSSDIIDVTKLEDAERRLLIEKLVKQIEADNLRLLRKIRKRIDEVGIELPTVEVRFNDLSVEAECQVVHGKPIPTLWNTIKGSLSKFVCSKKETKIGILKGVSGIVRPGRMTLLLGPPGCGKTTLLQALSGRLSHSVKVGGKVSYNGCLLSEFIPEKTSSYISQNDLHIPELSVRETLDFSACCQGIGSRMEIMKEISRREKLKEIVPDPDIDAYMKAISVEGLKNSMQTDYILKILGLDICADTRAGDATRPGISGGQKRRLTTATTLLMDEISNGLDSSTTFQIVSCLQQLAHIAGATILISLLQPAPETFELFDDVILLGEGKIIYHAPRADICKFFEGCGFKCPERKGVADFLQEVMSRKDQEQYWCHRSKPYSYISVDSFIKKFNESNLGFLLKEELSKPFDKSQTRKDSLCFRKYSLSKWEMLKACSRREILLMKRNSFIYLFKSGLLVFNALVTMTVFLQAGATRDARHGNYLMGSMFTALFRLLADGLPELTLTISRLGVFCKQKDLYFYPAWAYAIPSIILRIPLSVLDSFIWTVLTYYVIGYSPEVGRFFRHFIILLTFHLSCISMFRAIASICRTFVACSITGAISVLLLALFGGFVIPKSSMPTWLGWGFWLSPLSYAEIGLTANEFFSPRWRKLTSGNITAGEQVLDVRGLNFGRHSYWTAFGALVGFVLFFNALYTLALTYRNNPQRSRAIVSHGKNSQCSEEDFKPCPEITSRAKTGKVILPFKPLTVTFQNVQYYIETPQGKTRQLLFDITGALKPGVLTSLMGVSGAGKTTLLDVLSGRKTRGIIKGEIRVGGYPKVQETFARVSGYCEQFDIHSPNITVEESLKYSAWLRLPYNIDAKTKNELVKEVLETVELEDIKDSMVGLPGISGLSTEQRKRLTIAVELVSNPSIIFLDEPTTGLDARAAAIVMRAVKNVAETGRTVVCTIHQPSIDIFETFDELILMKDGGQLVYYGPLGKHSSKVIKYFESIPGVPKVQKNCNPATWMLDITCKSAEHRLGMDFAQAYKDSTLYKENKMVVEQLSSASLGSEALSFPSRYSQTGWGQLKACLWKQHCSYWRNPSHNLTRIVFILLNSLLCSLLFWQKAKDINNQQDLFSIFGSMYTIVIFSGINNCATVMNFIATERNVFYRERFARMYSSWAYSFSQVLVEVPYSLLQSLLCTIIVYPMIGYHMSVYKMFWSLYSIFCSLLIFNYCGMLMVALTPNIHMALTLRSTFFSMVNLFAGFVMPKQKIPKWWIWMYYLSPTSWVLEGLLSSQYGDVEKEITVFGEKKSVSAFLEDYFGYKHDSLAVVAFVLIAFPIIVASLFAFFMSKLNFQKK

SEQ ID NO: 14386 - protein, 432 aa, Yarrowia lipolytica CLIB122
MSTAAIERENKHSAHNYHPLPVVFTKALGAKVWDPEGKEYLDFLSAYSAVNQGHCHPKIVKALCDQAQKLTLSSRAFHAEIFGEFAEYITNYFGFDKVLPMNTGAEAVETGIKIARKWGYLKKGIPAGEALVLAATENFHGRTLAIVSMSTDNEATDNYGPYLEGVGPFIPDSNGKIDPKTAKPLRYNNIGDVEEAFNNAGSKIAAFLVEPIQGEAGIIVPDKEYLQQVRKLCDKHNVLLICDEIQTGIARTGKLLCFEHSEIRPDMVLLGKAISGGVTPVSAVLADNAVMDVITPGTHGSTYGGNPLACAVAMAALDVVKDEQLVERADRLGNEFRAALEPLIKESNGIVTTVRGKGLLNAIVIDSSKANGRSAWDLCVLMSNKGLLAKPTHENIIRLAPPLVITDEDMKKGLEIIRESVLELPNAPHAAH

SEQ ID NO: 14387 - protein, 471 aa, Vibrio fischeri ES114
MTNSTPIRSTHFDAIVIGSGPGGEGAAMGLTKANLNVAIIEREPSVGGGCTHWGTIPSKALRHAVSRIIEFNSNPLYCKNNTSLHSTFSDILGHAKSVIDKQTRMRQGFYDRNQCSLIFGEASFVEKNTVAVTAKDGSIETYTADKFIIATGSRPYRPEGINFNHSRVYDSDSILSLKHDPRHIIIYGAGVIGSEYASIFRGLGVKVDLVNTRDRLLSFLDNEMSDALSYHFWNSGIVTRNDENFEHIEANDDGVIMHLESGKKMKADCILFANGRTGNTDKLNLSAVGLEADSRGQLKVNDNYQTDVEHIYAVGDVIGYPSLASAAYDQGRFTAQAITKGKAEARLIDHIPTGIYTIPEISSVGKTEQELTAAKVPYEVGRSSFKHLARAQIAGKDIGSLKILFHRETKEILGIHCFGERAAEIIHIGQAIMEQKGEANTIEYFVNTTFNYPTMAEAYRVAALNGLNRLF

SEQ ID NO: 14388 - protein, 515 aa, Methylobacillus flagellatus KT
MSTDVSITLSNLQFSDLGLAEPILRAIADTGYTHPTPIQAQAIPLVLNGGDLLAGAQTGTGKTAGFTLPVLHLLHAKPVKVKPGQPRCLILTPTRELAAQVEESVQTYGKHLKLTSMVMFGGVGINPQIERLKKPLDILVATPGRLLDHAAQKTIDLSAIEILVLDEADRMLDMGFIRDIKRVLALLPKKRQNLLFSATFSDEIKELADGLLHNPGFVEVARRNTASELVEQAVHLVSQGHKRDLVAHLIRHHDWKQVLIFTRTKHGANRLAEKLSKDGIAAAAIHGNKSQSARTKALAEFKNGTLPVLVATDIAARGLDIDQLPQVVNFELPNVPEDYVHRIGRTGRAGCSGAAVSLVDGEEIKLLKGIERLIKREIPRLDIPGAFVPSDKPGVESRPPRQQPAQARQTKSNRPQAQRERSDAAGNSAEPRSGNKPRQGRNHQAKAQGQPQPQAQRSKPQGQGQAVQAKKKPEPLLSEAARHQAMPQVGLFVPPQPPKRQFHNTSGQRPNRGRR

SEQ ID NO: 14389 - protein, 407 aa, Oryza sativa Indica Group
MARPRGRRRGERRQRRCRHGWACAWREPGGRRPTDAAGGAGARVAASPDSGSTGVAPASRLEGALSPLFKTKGGSQLKEYCTNLTKEDCRRQSGSFVACDKVHFRRIIAPHTDTNLGDCSFLDTCRHTKTCKYVHYELDQTPDIPPMMAGALAPPRQIRLQRAEYCSEVELGEAQWINCDIRNFRMDILGQFGVIMADPPWDIHMELPYGTMADDEMRTLNVPALQTDGLIFLWVTGRAMELGRECLELWGYKRVEEIIWVKTNQLQRIIRTGRTGHWLNHSKEHCLVGIKGNPLVNRNIDTDVIVAEVRETSRKPDEMYPMLERISPRTRKLELFARMHNAHAGWLSLGNQLNGVRLVDEGLRARYKAAYPDSEVQPPSPPRASAPIDGDQGTSQKPTVSDGERPA

SEQ ID NO: 14390 - protein, 202 aa, Oryza sativa
  misc_feature (178)..(178): Xaa can be any naturally occurring amino acid
MVKNAIQYAVVDAFAAEPFKGNPAAVCLLEGEDAAAAADERWMQSVAAEFNLSETAFLIRDPSSSAAAADAAPRFRLRWFTPVAEVASPFPPTLGFLLLVSRVFIRTRRRRCLQVNLCGHATLASAHFLFTTVLEKQQHAAAAMVEFVTRSGLSGPQRRVLLRRPPGNEGRASPGEEXKLFIPVGFSPFDLIFGGFTKSRGR

SEQ ID NO: 14391 - protein, 549 aa, Pseudomonas syringae pv. syringae B728a
MRWTPRAKPFVFCQRETLMFDDLDYNQPYASARSPVMGNNMVACSQPLAAQAGLDMLRRGGNAVDAAIAAAMVLTVVEPTGCGIGSDAFAIVWDGSKLQGLNASGRAPQAWTPEYFEGQSQMAQRGWPAVSVPGAVSAWVELSARYGKLPFATLAEPAIGYARDGYQVTPIIAELWKRGAHLLKDQPGFAECFMPGGKAPMAGEKIRLKDHARTLELIAQTKGEAFYRGELAQTIIAHANANGSVMSLDDLATHTVDWIDTLSVPYAGAVVHELPPNGQGIATLAGLTMLEALGVGEHPVDSLETVHPVLEAMKLALADLDEHVADSEHMRVPSADLLGKAYLTERAGLITDQAANPGHGSPKPGGTVYLSAADESGMMISFIQSNYMGFGSGVVVPGTGISMQNRGAGFSLDPQHVNYVAPRKRPFHTIIPGFVMNADGTPLMSFGLMGGPMQAQGHLQMMMRILRYKQNPQAAADAPRWRIEAGLKVAVERAFDPEVVKALRAKGHDIDVEEPSGVFAFGGAQIIQRTAHGYVGGTDPRKDGTVAAY

SEQ ID NO: 14392 - protein, 310 aa, Bacillus clausii KSM-K16
MATYLITGGAGFIGSNIAKALVAKGEKVKILDNFNTGKKDNIAEFIDDVEVIDGDFTNEKTVQSALKQVDVVFHQGAIPSVPKSIQNPIESNHANVSGTLQLLQGAVEARVSRFIYAASSSAYGDSETLPKHEQLPGNPMSPYAVSKYTGELYCKVFYNLYGLETVSLRYFNVFGPRQDPNSKYAAVIPSFIKAMLNDKPPTIFGDGTQSRDFTFIDNVVAANLLAANAPKLQGESVNIGGGASIDLNSLVDEINVLLGKQIQANYGSERPGDVKHSLADIHLAEKLIAYRPTVSFQEGLRQTVEWFKHH

SEQ ID NO: 14393 - protein, 225 aa, Candida parapsilosis
AQLYADLDKGFTPINFVFPHLPLPHYWKRDAAQQKISETYMTEIARRRETGDIDENRDLIDSLLVNSTYKDGVKMTDQEIANLLIGVLMGGQHTSATTSAWFLLHLAEKPQLLDELYQEVLNALSGKGGNLDDLSYEDLQQMPLVNNTIKETLRLHMPLHSIFRKVVSPLVVPNTKYIVPRGHHVLVSPGYAHTNERFYKDASDFNPHRWDESASTNDAGEVDYG

SEQ ID NO: 14394 - protein, 320 aa, Leuconostoc mesenteroides subsp. mesenteroides ATCC 8293
MKKILVLHTGGTISMHEDADGDVETGDENPLVQAKVTFPNIELEVENIFNLPSEHIGPSHMLQLQKRISEAKNDFDGVVITHGTDTLEETAFFLDSTLKVSFPIVITGAMRSSNELGSDGLYNYQSALRVAADDTSKNRGVIVVMNDEIHAARFVTKTHTTNVATFASPLSGTMGLLTKRQIIYFYDLPQREVLPDVDINKNIPVLKAYAGMDGQLLKILADANIDGIIIEALGAGNLSREAARGVAYLLAKNTPVVIVSRSFNGVAAPVYDYLGGGVQLEKSGAIFASSINGPKARLKLLIGLSNNLSKEHLETYLHGI

SEQ ID NO: 14395 - protein, 230 aa, Escherichia coli
RPVDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 14396 - protein, 110 aa, Zea mays
  misc_feature (102)..(102): Xaa can be any naturally occurring amino acid
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNXFEVFLPQL

SEQ ID NO: 14397 - protein, 420 aa, Buchnera aphidicola str. APS (Acyrthosiphon pisum)
MKKINILVPDLPESISDATVVKWHKKIGDTVHCDDNIVDIETDKVMLEVSSPCDGILQSILEKEGKVVISQQTLGEINKSTVVDNHLSNNHIIEKEDNLLKKEEKYITTEEKKEIEYLLKDNHKHLTPSMRRSVKIHNINNGFLNQVIETSKKTNFENIIKEEKKESNQILFNHNIFNANENNKNNNNKVTNRVKMTRLRQRIAERLLDSKNNTAMLTTFHEVNMKPIILLRKKYGEDFEKKHNVRIGFMSFFVKAVIQALKNFPEINAYIDQTDIVFYKNFDISIAISTPRGLITPVIRNADTMTMAEIEKKIKDFSIKGLQNKINIKELMGGNFTITNGGVFGSLMSTPIINPPQTAILGMHVIQERPVVVNGQIKILPMMYLALSYDHRLIDGKESVGFLINIKNILEDFNRIAIDV

SEQ ID NO: 14398 - protein, 310 aa, Pichia anomala
EFVKGALTRDAFKSYVPQIREEIIHYFQNSKNFKFGERKHGISNVMATQPEITIFTASRSLMGKQMRERFDESFAGYYSDLDKGFTPINFVFPNLPLPSYRRRDYAQQKISSTYMGLIKERRENNDIKDRDLIDTLMKTSTYKDGVKMTDQEIANLLIGVLMGGQHTSAATSAWFLLHLAEKPELQEEIYQEIMKVTGGEDVTYDDLQEMPLVNNVIKETLRMHMPLHSIFRKVKNPLPVPGTSYVVPKGHHVLVSPGFAMTNENYFPQPEVYNPHRWDEDSTSKAAQDSSTVDYGFGAVSKGVSSPYLP

SEQ ID NO: 14399 - protein, 525 aa, Glycine max
  misc_feature (139)..(139): Xaa can be any naturally occurring amino acid
  misc_feature (157)..(157): Xaa can be any naturally occurring amino acid
  misc_feature (297)..(297): Xaa can be any naturally occurring amino acid
MGRKEKQNTKAIEEERDQDNFNGASTPPLVFSSDDDEANQDLSLKIIKKAMRMRTAKHAPNDDVSSPFSQKPDLALPPSGGVSDGPSAIADSEVMEKKKTAKLKVEAGDQSVVIAEEQEMEETINATENHVEGRPEIGXNMVLRKLLRGPRYFDPPXNSWGACFNCGEEGHAAVNCSAVKRKKPCYVCGCLGHNARQCSKVQDCFICKKGGHRAKDCPEKHTSTSKSIAICLKCGNSGHDIFSCRNDYSQDDLKEIQCYVCKRLGHLCCVNTDDATAGEISCYKCGQLGHMGLVAGXIASGATPSSCFKCGEEGHFARAAPGSINFPPQSGKGNWESSRTKDKRSQKENRYMGNRSAPNDISGARRKKRSPTEERGFSTPKKSKSRGGWMAEYPTKERGFTTPKKSKSRGGCTTEHPSEQQDYATPKKSKSRGGWTSEHPEEFFPPLSSRSKGYRSPGTPSSRNDRIHSFGGGSHTPSYKSSKVWNGHTGTSMSQGSARSNHHRYSASRFGNSSSDGHGRNYNWW

SEQ ID NO: 14400 - protein, 231 aa, Buchnera aphidicola str. APS (Acyrthosiphon pisum)
MKINQVVLIRHGQSEWNTLNKFTGWHDAELDKKGKDEAKFAAILLKKEKFFFDCAHTSLLKRAIHTLQYILDELNQTWLSVKKSWRLNERHYGALEGLNKDEVIEKYGQKQVLLWRRSFDISPPQINIKDKRFPGNDPRYSHLNIHDIPLGESLEKTAKRVIPYWNKIVYPELKNNKKILIVAHGNSLRALIQHLYKIDNKAILDLNIPTAQPIILDFDNEKNPIKWHYLT

SEQ ID NO: 14401 - protein, 451 aa, Leuconostoc mesenteroides subsp. mesenteroides ATCC 8293
MKVTKFGGSSLANGQQLQRVYDIIRADDDRKVVVVSAPGKRFKDDRKVTDLLISYAQATLADEDTTEIIETIKHRYHSIGEYFELPDYELADLDEQIEHLARKHYRSFDYLYAAFAAHGEYLNAQLIAKVFNHLGMPARFVDPKEIGLVVDDNARSATFDAASYTTIGELDLSTSERLIVPGFFGYTKNGDMATFSRGGSDITGAIMARGLRADLYENFTDVSAIYAVNPSIVEHPAAIQQMTYDEMRELSYAGFAVFHDEAIIPAIQGGIRINIKNTNDPDAPGTFIVPPTEVQQTRPVTGIANSNRFAALYLHRYLLNKQVGFTLRILEILKRHNISYEHMPSGIDDLTIIFDKTMLTQEQVDNMLSDIAAEIKPDTLKWIPSYGIIMVVGEGMRNRVGALTEIVAPLKERNISLQMVNQGASEISIMLGIQPDLSDSAVEAIYTNIFK

SEQ ID NO: 14402 - protein, 519 aa, Oryza sativa
  misc_feature (245)..(245): Xaa can be any naturally occurring amino acid
MEKERKQGFFAALKEEVVRGLSPARSRGKSPARSASPGRMLIPRRRKEKQQQPPPEKLLQQYFAEPLISRSGSLRPGGEALAPLIEGPDPERLAAGGDFAGGEESARREGFGRWVRGQLARTPSVASSAAAAAAASPGGSGDSFRRSDLRLLLGVMGAPLAPIPSKLADPLPLLSIKGTPIESSSAQYILQQYMAASGGYRLLQSVRNAYAMGKVRMVASEFETATRVVKNRGPSGRGAASVEQXGGFVLWQMAPDMWYVELAVGGSKVHAGSNGRLVWRHTPWLGAHAAKGPVRPLRRVLQGLDPLTTAGLFAEARCVGEKKVNGEDCFILKLSADPQTLKQRSEGPAEIIRHVLFGYFSQRTGLIVHIEDSHLTRIQPHSGGDAVYWETTISSALEDYRPVEGIMIAHAGRSAVTLFRFGEAAMSHTKTRMEEAWSIEEVAFNVPGLSVDCFIPPADIRSGPVGESCELPPPAAAPHGERARHPARVAAVDRAPPHHNAGGANVGRRGDKIMWRVEV

SEQ ID NO: 14403 - protein, 395 aa, Desulfotalea psychrophila LSv54
MAISSKMKIFAEKSSWIRKMFEQGGKMKAEFGAENVFDFSLGNPDAPPPAQFDQVLAKIAADNGPGTHSYMPNGGHLWVREAVAGQMAKEQGVKVVASDMLLSCGAAGGINVIMKSLLNPGDEVIFLAPYFVEYDFYVDNHGGKSRVVQTDENFNPDMAAIREAISEKTKAIIINSPNNPTGQIYSKEILAELGLLLTEMGEKFGSTIYLISDEPYRKITYDGIEVPSIFAAYSNSIIVSSYSKDLSLPGERIGYVAVHPGISEKAELVSAMTLANRILGFVNAPALMQRVIAELQGISVDNERYARRREAFCQILTEAGFDFVPPKGAFYIFPKSPIEDDVAFCAILQEEKILAVPGRGFGAPGYIRLAFCVPDETIAGSAAAFKRAYQKALKA

SEQ ID NO: 14404 - protein, 522 aa, Xanthomonas axonopodis pv. citri str. 306
MNTSGIGGYFRQGLFGRDLLASVVVFLVALPLCMGIAIASGMPPAAGLITGIVGGLVVGFLAGSPLQVSGPAAGLAVLVFELVREHGAVALGPVILVAGAIQLIAGLCRAGVWFRMTSPAVVAGMLSGIGILIVASQAHVLMDAAPKARGLENFAALPGVLWQAISEGTGRNALFVGLATIGIILAWDKLRPQRLRFLPGALIAVVVVTATVQLQGLNVNKVDVPTNLFSAISIPSISDIFGVFNHTLLVSAVTFAFIASAETLLSAAAVDRMHQGARTQYDRELAAQGVGNMLCGFLGALPMTGVIVRSAANVQAGAATRASTILHGSWLLVFAMLLPWLLRMTPVACLAGILVYTGVKMIKIGQVKELATYGRGTAAIYLATTFAIVATDLLTGVLIGFGLSLFRLALHSSRLKVEVREHADKKDEMHLTLQGSATFLKVPAMARTLESVPPNTALHLDVAKLHHVDHACIELLRDWSRNAASRGCELVVDWKELDRRVEGQPTVDGVLVEQRVEQAKAA

SEQ ID NO: 14405 - protein, 255 aa, Buchnera aphidicola str. APS (Acyrthosiphon pisum)
MKKFFITANWKLNGNIKMISSFFKYLKLYSSSYLEKNTVIIAPPTIYLERVCKNISNMNIFLGSQNVDINLNGAFTGETSILMLRDIGVKYVIIGHSERRFLHHETDDIIAKKFHLIKKSNLTPILCVGETEIEKKHNQTEQVIQRQLNLILKNLGTSAFKNIIIAYEPIWAIGTGVSADPEHVQLIHVFIKNYILKYSSINRNDIIIQYGGSINHTNVKKFIEQPDINGLLIGNSSLSAKEFLEIIKIAHEHYS

SEQ ID NO: 14406 - protein, 355 aa, Gibberella zeae PH-1
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 14407 - protein, 272 aa, Agrobacterium tumefaciens str. C58
MVYKASGPLVLVGAGNMGGAMLSGWLKKGVPGSKVIVIDPRPSDAMRTTIAEAGATHSESVPEGVKAGILFVAVKPQMMDAILPSLKPLLGPETVVVSIAAGTTIATFVSHFGAVAAVRAMPNTPAMVGRGVTGAYANDLVTAELKTVVDGLLKVSGPVEWVEAESDIDAVTAVSGSGPAYVFYLVECMAEAGRKAGLPADVAMRLARETVAGAGELLHQSPEEAARLRQNVTSPGGTTAAALSVLMAEDGMQPLFDRAVAAAKTRAEELAG

SEQ ID NO: 14408 - protein, 331 aa, Magnaporthe grisea 70-15
MEPASRRHFFKHGGQDPSIGLNSAEIQECHWCQLRSFANHEKYPISIINTTKDGASLPPDFRFISERILGEGVSRAEASFLSGCECTSNEDCMYGGCECLSDLPDSGLESDGDADFRRSRNNRIKKFAYYSSGERAGLLRESYLDTRTAIYECHEQCSCGPDCPNRVVERGRTLPLQIFRTDDGRGWGVRATVDIKCGQFVDTYIGEVITDSEAVERRKATRKKDLYLFDLDKFWEVIQDDQSRLVIDGEYRSGPSRFFNHSCDPNMRIFARVGAHAELNLHDLAFFAIRDISNGEELTFDYVDGQVLPDGESLDDECLCKSTNCRGVLWS

SEQ ID NO: 14409 - protein, 206 aa, Brassica napus
MQAVIRSFVSGGNVVRSSLLQHLRVVNPAIQPSVLSTRYESTQPARMEEHGFESTTISDVMNAKGKSADGSWLWCTTDDSVYDAVKSMTQHNVGALVVVKPGEQQSLAGIITERDYLRKIIVQGRSSKSTKVGDIMTEENKLITVTPETKVLVAMQLMTDNRIRHIPVIKDKGMIGMVSIGDVVRAVVTEHREELNRLNAFIQGGY

SEQ ID NO: 14410 - protein, 310 aa, Agrobacterium tumefaciens str. C58
MKVFAGNSNRHLAEAICKYLNVPLGNATVKRFADQEIFVEISENVRGEDVFIVQSTSFPANDHLMELLIMIDAMRRSSAKRITAVLPYFGYARQDRKAGPRTPISAKLVANLITEAGADRVLTLDLHAGQIQGFFDIPTDNLFAAPILARDVKDHYDTNNVMVVSPDVGGVVRARALSKRLDCLLAIVDKRRDRPGESEVMNVIGDVSGKDCILIDDIIDSGGTLCNAAEALLKKGATSVTAYITHGVLSGGAVARVASSKLRELVITDSIQPTTGVQSAHNIRVVSTAGLLGEAINRTAQEQSVSGLFD

SEQ ID NO: 14411 - protein, 506 aa, Rhodospirillum rubrum
MLYAAPGTADAIFAFKPRYDNFIDGTWQPPVRGEYFDNVTPITGKVFCKAARSTEEDITLALDAAHAAADRWGRTTAAERALILNRIADRLQDNLETLAYVESIDNGKPIRETLAADIPLAIDHFRYFAACIRAQEGSLSQIDETTIAYHFNEPLGVVGQIIPWKFPILMATWKLAPALAAGNCIVLKPAEQTPISILVLTELIADLLPPGVLNVVNGFGLEAGKPLASSKRIAKIAFTGETATARLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 14412 - protein, 412 aa, Mycoplasma mycoides subsp. mycoides SC str. PG1
MDDQFNKIRKQFPLLKKHPDLIYFDNGATTLKPNSVINAQTNYLKNISTNPHSSDYKIGYQSLEILNNTRELVKNFINANHTSEIIFTSGTTQSINMIVKGLINLIKQDEEILITSLEHSSNLVPWIWLKQKTNAVIKNLELTNDFGIDINKLDKIITLKTKIISFAHISNTTGYINDVKKIIQKIRSINQNVIIVVDVAQSIAHFKVDVKDWDVDFIVFSAHKMYGPFGVGILYGKYQLLDKLEPLNLGGGSSLTISKDFTSYTLKSLPEKLEAGTLNISNIYGFKKAIEFILKIGINNICLYETKLKQYTRQQIKANHLENKITFYNLNNDSPLLLFNVNQINAQDISSFLDVKYNITSRSGAHCVRRLEDVIHIKSALRISFAIYNTTDEIDKLIVALKNTDKFLDIYF

SEQ ID NO: 14413 - protein, 505 aa, Agrobacterium tumefaciens str. C58
MNIQVQQKAGEAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 14414 - protein, 105 aa, Oryza sativa
  misc_feature (39)..(39): Xaa can be any naturally occurring amino acid
ITWVVINFCHIRFQKIMRVQGIPRSELPYLAPLQPYLSXYGAFFVGLITITCGFTAFIDWSVADFFSNYISLMLFAALYVGHKLICRTKVVPLAEVDLSKGREEM

SEQ ID NO: 14415 - protein, 107 aa, Prochlorococcus marinus str. NATL2A
MSTASAVTDSSFEQEVLQSDVPVLVDFWAPWCGPCRMVAPIVEEISKDFEGKIKVYKLNTDENPNVASQYGIRSIPTLMIFKGGQKVDTVVGAVPKATLSGTISKHL

SEQ ID NO: 14416 - protein, 339 aa, Lactobacillus acidophilus NCFM
MTKIAVLGNGSWGSVLGSMLADNGNDVVLYGNIESVNDEINATHTNSHYMKDWKLNENTRATGDLEDALDGAEVVLFVLPTKAVRIVAKNVREILDKSGAKPLLVTATKGIEPGTKKLISEILTDEIYPNDEDKIVAISGPSHAENVAQKDLTAIACASTNEENAKKVQKLFSNDYVRFYTNDDLVGVEVGGAVKNVIAIAAGILVGQGYGDDAKAALMTRGLAEITRLGVNYFGAKPMTFSGLSGIGDLIVTCTSVNSRNWRAGKQIGEGKSLDYVLKNMGQVVEGATTVKAVHELCEEKNIDMPISEAIYRVLYEGTDVETEIKKMMGRAPKPEIRL

SEQ ID NO: 14417 - protein, 230 aa, Methylobacillus flagellatus KT
MNDKQLVAIQAAQHVQDGMVVGLGTGSTANYFIEELARRHRDEGLHITAAASSVASTIQAQTHGLPLVALEHLGRLDLYVDGADEVTTNLALLKGRGYDLVREKLLARASERFIVLVDKSKLVGHLGEKFPIPLEVIPFAWQLVQASLQQLGIASSLRQNAAKDGWAITSHGSLVLELTLPKTFKSDELNRLLNDIPGIVEHGVFDELADAVFVADNGQVEEIWKRPGNI

SEQ ID NO: 14418 - protein, 381 aa, Lactobacillus acidophilus NCFM
MSTEMLGLILAGGKGTRLGKLTSDQAKPAVPFGGRYRIIDFTLSNCANSGVKNIGIITQYQPLLLNEHIGNGVSWGLDGLNASATILQPYTDNSGSKWFEGTAHAIYQNIDYIDSKDPEYVLILSGDHIYKMDYESMLEEHIKNGASLTVAVIDVPMKEASRFGIMNTDVSGRITEFEEKPEHPKSNHASMGIYIFNWKRLREVLTTGFTTNDDMVDFGKNVIPYYLKSDERVFAYHFSGYWKDVGTIDSLWAANMEFLDGSDGLNLYDRSWRIYSKNPIDPAQVITENAEVNNSMIVDGCYVDGTINHSILSTDVDVQRGSEITDSVIMPGVKIGKDVVIKHAIVGENAQIGDGAVVEGNKDNIKVIGNSERIGVLPNED

SEQ ID NO: 14419 - protein, 380 aa, Lactobacillus acidophilus NCFM
MKTNKMAAIFSNQHEYNELRPLTDERSLSALYFAGKYRIMDFALSSIVNAGINNVYTLISQEKVRSYLDHLGGGKEWGLDTIGSYAYLDFYQKLLQSQANGGEYFNDLITFLATANAPYTVFLENKIVANVDLQSVLHFHQENGNRITAVFKRVSKKNVAPDDQLYILDEENTIMSCQQAIDTQSQDSYNLGLNIYVADTKWLIAELKKAQKCGAPIDIGQRFASLAAKYRTNAYEYTGYLHNVHDIKSYYDSNIEMLDKKNRDSLLHGNQRIITRIRNEVGTYYTTSSKVKNSLFATGCRINGTVENSILSRRIDVAEDSNVKNSIVMASCTLEAGSSVEYAILDKNVVIKKDVVVKGTPDNPVVIKKGDVVTKDLIVE

SEQ ID NO: 14420 - protein, 336 aa, Pseudomonas syringae pv. syringae B728a
MAFNMRNRSLLSLMHHTPRELLYLLDLSRDLKRAKYTGTERQHLKGKNIALIFEKTSTRTRCAFEVAAHDQGAHVTYIDPVSSQIGHKESMKDTARVLGRMFDAIEYRGFAQDIVEELAHFAGVPVFNGLTAEFHPTQMIADVLTMREHSDKPLHEISYAYLGDARYNMGNSLLMIGAKLGMDVRIAAPAALWPHTDFIAQCKAFAEESGARITITEDPLQAVKGVDFIHTDIWVSMGEPVDAWDERIGQLLPYQVNPAMMKASGNPRVKFMHCLPAFHNSETKVGKDIATRYPNLANGVEVTEEVFESPANIAFEQAENRMHTIKAILVSALADI

SEQ ID NO: 14421 - protein, 658 aa, Yarrowia lipolytica CLIB122
MSTTIASPMSTPTTQDPGPTNNPFRHLQTNYSQLPRHMISPSLDKFSDSSSSYWGSRRSTGTKEPVGLAPEVPQNVVDDELQIIGAQVLRDASPGDGDDEDNSSEHTTASTSGSSTGGSPSKKHQPNWHDFYKNGYPDEVIVIDSDSDDDHGDDVNNTQVAQVATTATTSKTTINRRISSAADLPVKRRKFSQSSTSGSTTATHNTSSSDQQLDTNTHTTLDQDSDKNLLDDDENDTPLTPPPKLRRKIPEVYVRPVADAKKLLASQYDDKDGHYVTTFSDVFTERYVIRKLLGQGTFGKVVSAYDKQTDSLCAIKIIRAVPKYRDASKIELRVLTALADYDAMNKNRCIHLRECFDFRNHVCIVTDLLDISVFDFMRDNRFQPFPGSHIQKLAKQLIKSVAFLHGLGLIHTDLKPENILLKKAAFVRVANKNLGPSSIRKHNYYRAHDPKKTEPKTRNVLKDTCIHLIDFGSAIFDDEYHSSVVSTRHYRAPEIILGVGWSYACDMWSIGCILVELFTGDALFHTHEDFEHLALMEAIIGYPFPKAFVKEMISKKPSAQVGNFFNARSGKLGYPNKDTTTSSRHYIRDTLCLTDLIHTSTQSTKSRSEGANPDGQFWDLFLDLVRKMLVFDPRERITAREALQHDWFKCGISDEGSV

SEQ ID NO: 14422 - protein, 373 aa, Sclerotinia sclerotiorum
MAETTTAAAEERQFVAHFSQKQHVSSPKEIQQNSRDKELGASSGSLSVRDFELVRTLGTGTFARVWLARLANPAEEDRDKVFALKVLRKVEVIKLKQVDHVNHERSVLADVAGHPFITTLITSFADHDSLYMLLDYCPGGEVFSYLRKAKRFDENTARFYAAEIVLILEFLHEREGVAYRDMKPENLLLDAEGHIKLVDFGFAKRLGNRETYTLCGTPEYLAPEVIQSKGHTTAVDWWALGILIYEFLTGYPPFWHSNPIEIYKQIVTKPVSFPAEPAISSAAKDIIRQFCTVDRSHRLGNISGGAARVKDHPFFQGVIWEDVYYRKYRGPIIPPLRYPGDAQNFDLYPDEKEGREPYTEELAAKWDDCFKEF

SEQ ID NO: 14423 - protein, 403 aa, Arabidopsis thaliana
MATTISNLPRELIEEILSRVPLRAMKAMRLTCKSWNNLSKSESFMKMHIGKAATREEKTMMVAVMPHTLALVSVVVDGVNPSTELKGQFSFLDKEFFIYRVIHYEGLLLCILKDATRIVVWNPYLGQERWIQIRYSHRPHGVDHFKYAVGYADKVSCRSVKLLRFLDYFHKASDKPFFWYEIYDFDSCLWTTLDITPHWGISWTYPRVSLKGNTYWPAREMNTKGFQDHIICFDFTSERFGPLLPLPRAQGCHVSLSCVKEEKLAVLLKHRLHHDSYEYEFEIWITTKIDVEMVSWSKFLRMDMRPKIKLPLSFYVDEEKKVFMGFDHGEYPKLFLNIIGETGFLRKLDLGVHEGHRSPCSYVPSLVQIKHPAGDKMIKQSSLEDRRFAQNSLRLAAIEKLIN

SEQ ID NO: 14424 - protein, 110 aa, Triticum aestivum
MATATRRLLPALLKTLAPAGARGLSTEKAVGAAAVVGSHTAKWMQDTSKKSPMELINEVPPIKVHGRIAVCEGASEGVGLGHPIEYICLDLEAPNVCKYCGLRYVQVHHH

SEQ ID NO: 14425 - protein, 392 aa, Ruegeria sp. PR1b
MLSDLGSVPSDEILTLMQMHREDPRRDKIDQTVGVYRNELGQTPVMQAVKAAEYKIWQDQTSKSYTGLLGDPEFLEVMQALVLGPEAPPCTAAAVPGGSGACRQAFELIRQATPGARVYVSDPTWANHTTMLAHTGLARETYRFRDPATGGLNFDGMMQDLGTARAGDVVLLHGCCHNPTGISLTRTQWRALADRMAKNGLVGMIDLAYLGFGDGLEEDAWGTRHLAETLDECLIAVSCSKNFGLYRERAGALLVTARNPALLAHTREVLAYLNRQAYSFPPDHGARIVTSILKDPALREVWTQELHGIRNSIAALRLQLCNAFAEKTGTRRFDYIREHKGMFSCLGATPEQVRTLRAKHGIYMVTDSRLNFASLSQQNVERIVDAVTDVGI

SEQ ID NO: 14426 - protein, 447 aa, Bacillus clausii KSM-K16
MCSQEKPQHYDPVHTKVGVIGLGYVGLPLALLFTKKGYHVTGIDIDATKVASLQQASSYIPDIENRELAQVLATNKLTFAADYSGIEDLDIIVICVPTPLASDNKPDLRYLKHVSEDLYPRLQEKQLVIVESSTYPGTTREVIQPILEKSNLIPGKTLHLAYSPERIDPGNKSLSIEEVPKIISGLSEQCLMRITAFYERVFNTIVPASSLEVAELAKLLENSYRFINISFINEMAMFCDKLGIDLWEAIATANTKPYGYQAFYPGPGIGGHCIPIDPLYLYWVGAQRGFHTQFLSLSEQMNQTITSYVIEQIKKLAETDKPISDAAIVLYGLSYKKDSNDVRSSPALDIMKALIQTGANVSYHDPHVPSVEVGQTLYSSQPLTKELLEKADLVAILTDHSNLPITSILEHAKVVYDTKNVTKGYKSKAKTVVLGGGVTHYLADGKS

SEQ ID NO: 14427 - protein, 356 aa, Dehalococcoides ethenogenes 195
MANKRDYYEVLGIERSASDEDIKKAFRKMAMKHHPDRNHEDGAAEKFKEINEAYEVLSNPEKRAAYDRFGFSAGSDAFGQGGFENFDFGGLGSIFETFFGGATQSAKRGPRRGPDMSYDIRITLEEAATGVEKEITTERLEYCSECSGTGAKAGTSLVKCTNCNGTGQVYQVQKSVFGRFTSVTPCPKCRGEGTIIGEPCAKCRGTGKEYVKRTVQVKIPAGVADGNQIRLNGYGGVGDKGASAGDVYINVSIASHADFKRDGDDVIYELEINFAQAALGTEVNVPGLSTSHKLKIPSGSQNGKYFVLKGKGIPHLNRFGSGDEMVHLNVVTPEKLSRKQKQLFEELEKSFAEDKK

SEQ ID NO: 14428 - protein, 466 aa, Escherichia coli
MGQSSQPHELGGGLKSRHVTMLSIAGVIGASLFVGSSVAIAEAGPAVLLAYLFAGLLVVMIMRMLAEMAVARPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIGKILRAEGSEIRLRMWLYPWLTWLVIGFITFVLVVMLFRPAQQLEVISTGLLAIGIICTVPIMARWKKLVLWQKTPVHNTR

SEQ ID NO: 14429 - protein, 359 aa, Dehalococcoides ethenogenes 195
MSKVCIIGTTTWGITLGTVIAHKGREVMLWARTEDEAALLSAQRRPADFLPEDYYFPEYLNVTASLEEALSGADMVLMAVPSQRMRPNIRLAAPLLTKNMLVCSASKGLEIGTAKRMSQVIADEISPDFSQNICVLSGPNLAMEILKGLPAVTVLAADTEKTAKKAAKLVTASNFCAYTNTDIIGVELGGSLKNIIALGAGIADGLSFGNNAKSALITRGLTEISALGAALGANPLTFSGLAGLGDLIATCSSNLSRNHFVGVELTKGRSLNDIMYSMSNVAEGVSTTAVAYELARSMDLEMPVTENIYNVLYNNADPKEAARKLMAAQAAHELAGRKWDLFKMFRRRRTRKTPELNPD

SEQ ID NO: 14430 - protein, 506 aa, Oryza sativa Indica Group
METLVCVAVWAVAMAMVVASVMWAYRWSHPRANGRLPPGSLGLPLLGETLQFFAPNTTCDISPFVKERLNRYGSIFKTSVVGRPVVVTADPELNYYVFQQEGKLFESWYPDTFTEIFGRDNVGSLHGFMYKYLKSLVLRLYGQENLRAVLLDETDRACRASLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWAEYKSMTFTSQVTLEMVRLANIVPGIFRKALQDIEFKGYTIPAGWGVMVCPPAVHLNPEIYEDPLAFNPWRWQMQLTLVVLILSGLSVGLIPKIYRVQQDKVEITGGSKHFMAFGGGLRFCVGTDLSKVLIATFIHHLVTKYRWKTVKGGNIVRTPGLSFPDGFHVQFFPKN

SEQ ID NO: 14431 - protein, 1051 aa, Ustilago maydis 521
MPHHHRASSLRQSNKAFKSKHATKTTLREASKGRSASDVSNTSRLNSHKASPLSASGNEAGSRQHRRNHAKQAQRWKRNALIQSNRVFSASSSSSREGKDGLSKGLAGAGAGAPRICAVVDLAEDGDPWEAVRRIQEEGIQGGVQPVAGRSVQEALAQSLPYCELEATRFRQTIQFLPLPYGALYPILDACKCADFVLLVLSATTAIDPGSWGELCLRTLQAQGLPTVVVAVPTLQPDGATGVGGSKKPGAALKAANEVRKSLLSFAKYFSPDVDKVHALDDRAERGALLRTLATATPKRVAWRDFRAWMVTEGAEWEPTLQAHDNGNADAGDANGSSQDAQRGMLKVQGWIRGAPMSADRLIHLPDFGDFEIDRITYAPPPNARTKRSKASATTASTDVQDTAMVDAEATQDAPLTPGDVLQSRDDEFADDLVSENEPDDMGNEQTWPTEEEMQAAERFAQQRADGEMPPPPALPGTTPKTIIKGSGNAKDNAKYRAAWIIESDQEDDDEDEDEHDNDEDSLMTDDDDECIEQGDMEVNEAIDDYERMKAAAIAQQNQHAQASEAASEMAFDDVDDAQAEAEYLAYQEQRKRQREERDDAEFPDEVDTPLEIAARTRFARYRGLKSFRTSPWDPYEDLPRDYARIFQFEDFHKTRRRVEGAALLDGVQPGFRVTVWIKDVPRAAAIRARACNVDELATVDCAVPFVLFGLLRHEHKKSVLNFTVTRNTEYEAPVRSKDALVLCLGPRRFRVKPIFSQHSRGGGKGVNNVHKFERYLRQGVSASVATVYAPITFGGSTAPAVLLRERRLDGESGYDQRGVSAAQMPHLVGFGNLLDAGPTRINAKRILLSGHPFKVHKKTATIRFMFFNPEDVYWFKPITLHTKLGRTGHITESLGTHGYFKAHFDGPISQMDTVLMNLYKRVYPKWSEPFTQAYEELPLPRSQVLGSNDEAKDEVSNSTHGLEGVSGNCAAPLDKMRRTRKVRRQPHEKRGEPSETGAAKRPTDCDRRRVAQTQIELRFVIGSIVYVSVLGVRLASRDSRDSGLTTIHDS

SEQ ID NO: 14432 - protein, 478 aa, Haemophilus influenzae 86-028NP
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLTSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 14433 - protein, 315 aa, Bacillus clausii KSM-K16
MDVVSIGETMVLFASKEDGQLRYASNFSARVAGAETNTLIGLAKLGHKTGWISRVGADELGAKIIQSVRGEGVDTTYVAMDEQAPTGLFLKEQTTVKTANILYYRKGSAASRLEPADINEDYVKNAKFLYLTGITPLLSKSCEQTTFVLIEMAKKHHVKIVFDPNIRKKLLTEEKQKHLLERLIGTADIVLPGYGEGHYLFGTNNSEEIADRCLQLGAQLTVVKLGEKGAYYKSTDQSGYVAPIPVKEVVDPIGAGDGFAAGVLSGLLDGLAIKEAVGRGCAIGAFVTQVHGDIEGLPSRQTLHAFQQNREDVNR

SEQ ID NO: 14434 - protein, 361 aa, Oryza sativa Indica Group
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNNQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIQ

SEQ ID NO: 14435 - protein, 480 aa, Buchnera aphidicola str. APS (Acyrthosiphon pisum)
MLNRLRRTKIVATLGPSTDINNNLEKIIRSGVNVLRFNFSHGSKDEHKSRANQAREIMTRLNFHIALLGDLQGPKIRISKFIKNNIFLNVGDFFILDANLDQNNGNQERVGIDYKQLPYDLKVGDVLLLDDGRIQLKVIKSTGHEILTKVVIGGILSNNKGINKLGGGLSADALTEKDKKDIILATEINVDYLAISFPRCSNDLKQARKLAKEFGSNAKIIAKIERAEAVLNQNTIEDIILASDAIMIARGDLGVEIGDSELAGIQKKLIRTARQLNRIVITATQMMESMITNPLPTRAEVMDVANAVLDGSDAVMLSAETASGEYPAETVIKMAKICKGAEKVPSINVSRHRIHAKFDDIEEAIAMSAMYVANHLKGITAIITMTESGKTALMTSRITSGLPIFALSKNKETLNLASLYRGVTPIYFNSKNNNFKAANEAIVLLRKRGFLCRGELVIITQGDIMGKIGKTNTSRILKVV

SEQ ID NO: 14436 - protein, 491 aa, Buchnera aphidicola str. APS (Acyrthosiphon pisum)
MIIETNHACDLVIFGAKGDLTKRKLLPALYKLEKSKKIHKYTRIIASGRADWSTEDYIEKIKTEVKNFLNEEINDLIWKNLSSRIFFCNIDVHEPLHFFRLKTILKQKKNIIVYYCAVPSNTLNSIFIGLGNAHLNSVPSRIVLEKPLGVCLKTSKKINDQISKYFLESQIFRIDHYLGKESILNLFALRFSNTCLFYNWNNKTIDHIQITVSEEVGIEDRWNYFNMMGQMKDMVQNHLLQILTILTMDQPKNISSESIQHEKVKILRSLNPINIHNINKKTVRGQYCSGVINEKKVPSYLEENGANKNSLTETFVAIKVDLNNKQWSGVPFYLRTGKRLAHKYSEIVVFFKKKPTNLFKNLNSELLQNKLIIRLEPNPNIIFDFSVKAPGLEQEYKIENSQLKSSQFSKKYSKNSIDAYERLLFEIMRGVQSLFVCRDEIEAAWKWIDPIIHAWKNSKNNAPQLYMSGTWGPKNSDLLLAHDGRVWYEFH

SEQ ID NO: 14437 - protein, 299 aa, Oryza sativa
RRWRGPPQDPCQGVPLLALRRRGGGGHVPHRRRQDAPPAPPRYRGQRRGRRGRHARRWRARTRRGNLPGPLPRRTPAPLLHPAPHRGVRAPPVHLRQRWTRRGPPREGACWGCLRRCRTVQVVASPADLIKVRMQADSRLLSQGIQPRYTGIFDAFTKIVRAEGFRGLWKGVVPNAQRAFLVNMGELTCYDQAKHFIIRKQICGDNLYAHTLASVASGLSATTLSCPADVIKTRMMNQGKDAKVLYRNSYDCLVKTVKHEGLTALWKGFLPTWARLGPWQFVFWVSYEKLRQASGISSF

SEQ ID NO: 14438 - protein, 367 aa, Agrobacterium tumefaciens str. C58
MGFKCGIVGLPNVGKSTLFNALTKTAAAQAANYPFCTIEPNTGEVAVPDPRMQQLAAIAGSKEIIPTRISFVDIAGLVRGASKGEGLGNKFLANIREVDAVVHVLRCFEDDDITHVEGRINPVGDAETIETELMLADLESLERRVEQTRKRATSKDKESLAQLPVMEAVIALLNDGKPARLLLKTLADEEIEILKGLNLLTSHPVLYVCNVSEADASSGNEHTAAVAEMAKQQGAECVIISAAIEAEVAQLPADEAEEFLSALGLNEAGLDRLIRAGYHLLDLITYFTVGPKETRAWTIVRGTKAPAAAGVIHTDFERGFIRAFTIGFDDYIAYKGEVGAKEAGKGRDEGKEYVVQDGDVIHFRFNT

SEQ ID NO: 14439 - protein, 887 aa, Oryza sativa Japonica Group
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 14440 - protein, 180 aa, Agrobacterium tumefaciens str. C58
MTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 14441 - protein, 471 aa, Mycoplasma mycoides subsp. mycoides SC str. PG1
MYKFKALLDGKLFDNNRILEIINPVDFSVAGQVVSLTKQDINDAFIAAKSSQKAWENTDLEKRISILDKWKQLIDQNKEELAQIIMSETAKPYKDCLTEVIRSVEYIDQTFYEVRNLKTLIIDGAKYGAKNKIGTFMRVAKGVGVAISPFNYPINLAVSKIFPCLVTGNTIVFKPATQGSLIGAKLGELAYQANLPKGIFNVVTGRGREIGDDIITNKLADFISFTGSVEVGKRLLEISSTKDVVLELGGKDPAIVLDDLDLEKYAKEIISGAFSYSGQRCTAIKRVITTDKIADQLVPLLKEKINKLTVGLPKDNCDITPLIDQKTADFVYGLIDDAKKKGAKIIIGDKQEKNLIYPTLVDHVTSDMRLAWEEPFGPVLPIIRTNSVDQMIELANKSNFGLQASVYTKNLDQALTIAQKLEVGTVNINGKSQRGPDVFPFLGVKDSGFGVQGIVDTLLFLTRYKGIVINN

SEQ ID NO: 14442 - protein, 245 aa, Oryza sativa Japonica Group
MLCGTASFKHVVDDDDPAARGTGGGSPRQPRRKHGGGGGGKINPYAERGLDKFSTVLSELEARRDKILRRVGSGGGLVMVRFVQSNGALEPIIVKLPDEQRRPKDDAAAKKPRPSSPSTAAAQQQGASAARATRAPPPAPAASRVSSFSWGRMRRPACYWPAVMVLMLVCLAVFGRVFAICCTSIWWYLAPTLLSNGGAGGEDAARRPLGSPRKSPPPASGKKLAGRRGTREVGSSPRGHTKKGT

SEQ ID NO: 14443 - protein, 705 aa, Emericella nidulans
MSAETSTTPAPAENTNGTPDNAPAPEVTAVEAPATTSQPHSASLYVGELDPSVTEAMLYELFSSIGQVASIRVCRDAVTRRSLGYAYVNYNDTAHGERALDELNYTLIKGKPCRIMWSQRDPALRKTGQGNVFIKNLDSAIDNKALHDTFAAFGNILSCKVAQDEFGVSKGYGFVHYETAEAANNAIKHVNGMLLNDKKVFVGHHISKKDRQSKFEEMKANFTNIYIKNIDPEVEDEEFRKLFEKFGEITSATLSRDSEGKSRGFGFVNFSTHESAQAAVEEMNDKEVRSQKLYVGRAQKKHEREEELRKQYEAARMEKASKYQGVNLYVKNLTDDVDDDKLRELFGPYGTITSAKVMRDTAPVETATPESETKESANKENEKAAEGEKEPAAEEKEKEEEKEAEQKPEKKPLGKSKGFGFVCFSSPDEASKAVTEMNQRMVNGKPLYVALAQRKDVRRSQLEASIQARNNIRQQQAAAAAGMGQAYMAPAVFYGPGQQGFIPGAQRGGMFPPQPGMMMGMPGRPGQYPGPFPGQQGGRGVGPNQQIPPNFQGLPMGAMQGPGIPNGMGYPMVQGQFGGGRGRGQVPGMGGPMRGGYGGGRGGVPLGGQMRPGQGGRGQAVGQPGPETPVGVLTAQALSAAPPQQQKQMLGEALYPKIQATQPELAGKITGMLLEMDNTELLGLLRMTRLCAPRSTKPLAFMTST

SEQ ID NO: 14444 - protein, 328 aa, Dehalococcoides sp. CBDB1
MSIEPEIRETLGKINVAASGRTLANLNLLRDIEVKPDKIKISVAGAGLSASSQQILRQDISLCLKPLLNKQTLEIEYISVPLNELNHVKKVVAVMSGKGGVGKSLITGLCAVALNRQGYRVGILDADITGSSIPKMFGANQHLAGNEEAILPAQSRAGISLVSTNLLLTNQDDAVIWRGPLISKMINQFWDDVLWGELDYMVVDLPPGTSDASLTVLQSLPISGILVVFTPQGLVEMVARKAVSMAEKMGKPIIGLVENMAYLKVPELDKKIEVFGTGHGEELAKSIGVPFIGQMPLDPALAALCDSGDIEKYQHPLLDELEGAISRS

SEQ ID NO: 14445 - protein, 179 aa, Triticum aestivum
  misc_feature (62)..(62): Xaa can be any naturally occurring amino acid
NKFVQKSRLVPVRNSRDIVDPRVRGNNKVRVRNKRCLPSRERERWRRRRRRTTTAAATAAAXVGPGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLQRGCLVIT

SEQ ID NO: 14446 - protein, 545 aa, Zea mays
MSMGYQVVAAQLKVASSADHASVVIITLFVALLCACIVLGHLLEENRWLNESITALIIGLCTGGVILMTTKGKSSHVLVFSEDLFFIYLLPPIIFIAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 14447 - protein, 272 aa, Zea mays
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVVACFLLQFATGGLAVPAFGLSAGVGTLNGLVFEIVMTFGLVYTVYATAIDPKNGSLGTIAPIAIGFIVGANILAGGAFSGASMNPAVAFGPAVVSWTWTNHWIYWAGPLVGGGLAGLIYEFVFINQNGHEQLPTTDYCLLKTAKTQYDLICFYFAS

SEQ ID NO: 14448 - protein, 355 aa, Magnaporthe grisea 70-15
MASATLDIMRNNPLTASVADVYSSFHERRAKLGLTNPGTVENLAKEVQRDVFTNNYAFSGLRGDFTRAFNLNPLFQVSHNFAVGERMPPYTFAAMYGSSKVFMQGSVDNDMQVNARFNWRWSDALVSKTQFSLGTGNQDMAHLESEYTGSDFTTSIKALNPSFFEGGLTGIFMGSYMQSVTKKLALGMEGVWQRAALSQPPDTVMSYVAKYKSDDWIATGQLAGAGALSTTFWRKISEKCQAGIEMTLSLAPGDPAGGMMMGGPSIQAEGVTTAAVKYDFRMSTLRMQVDTKGKMTCLAEKRIAPAIMMTIAAEVDHPTGAAKLGLGVSLESGGEELQERQEALGAAAPSPNIPF

SEQ ID NO: 14449 - protein, 195 aa, Lactobacillus acidophilus NCFM
MLVPTVIEQTARGERAYDIYSRLLKDRIIMLSGEINDQMANSIIAQLLFLDAQDNTKDISLYINSPGGVITSGLAIMDTMNFIKSDVSTIAIGMAASMASILLTSGTKGKRFALPNSTVLIHQPLGGAQGQQTDIQIAANEILKSRKKINEILHETTGQPLEKIQKDTERDNYLTAEEAKEYGLIDEIMVNKKSN

SEQ ID NO: 14450 - protein, 402 aa, Frankia sp. CcI3
MAAMSRISHRIGGIAPSATLAVDATAKAMRAAGRDVIGFGAGEPDFPTPDHIVAAAEKACREPRMHRYSPAAGLPELKQAIAEKTARDSGVIVSPSQVLVTNGGKQAVYAAFATLLDPGDEVLLPAPYWTTYPESIRLAGGVPVDVVTGPEAGYRVTVEQLEAARTPRTKVLLFNSPSNPTGAVHTPEEVRAIGRWAEQAGIWVISDEIYEHLVYGETRFASVLAEVPELAERCIIVNGVAKTYAMTGWRVGWLVGPADAVAAATNLQSHATSNVSNVAQAAALAAVAGPLDAVATMRTAFDRRRQTMHRLLSQTPGIRCPLPDGAFYCYPSVRDVLGRTLRGRIPTTSADLCQLILEEAGVAIVPGEAFGTPGFARLSYALSDDDLVKGVSRLSALLAEAA

SEQ ID NO: 14451 - protein, 222 aa, Oryza sativa Japonica Group
MRGNAHFVVPASKFTLAAGAGESLTTYTFGTHTAKHTFCRVCGITSFYTPRSNPDGVAVTAACVDPGTLAHVEYRHADGRNWEKWFSRSDISDFSKPKAPPPPPPRDIGDCQRCSVALCAGGFSDATFLQAADLLSAMASLTHGRHGTDLRPTDDEEGHDKGMLDLLHLEFSTSFSNHSRLMWFSKDGESLNFTVGLLEFVEKAKCHSGATCLSIVPFYSAF

SEQ ID NO: 14452 - protein, 415 aa, Eremothecium gossypii
MSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 14453 - protein, 464 aa, Pseudomonas syringae pv. syringae B728a
MKISVFGSGYVGLVQATVLAEVGHDVVCMDIDQAKIDQLRQGQVHIYEPGLANLVRENLDQQRLCFTTDEQLAVEHAEVLFIAVGTPSRADGSADLSGFFAVGEAIARHRREPLIIVEKSTVPVGSGDALRSHIDKALRQAGRLLQFDIVSNPEFLKEGSAVNDCRRPDRIVIGCENEAVRNVMRELYAPFNRNHERIMFMDLRSAELTKYAANCMLATKISFINQIAELAEHLGADVESVRLGIGADSRIGYDFIYPGCGYGGSCFGKDIRALIHSAREAHCSNDLLSVVEAINERQKNKLFERVNAFYQGDLRGKTFALWGLAFKPNTDDMRDAPSRVLMEALWEAGASVRAFDPEAMQETQRIYGHRKDLMLMGTPESALNEADALIVCTEWQQFKAPDFELIQQRLNAPVIFDGRNLYDTERLAKRGFHYFPIGRGESCDLPIPQKQWTACNPLVSSQVV

SEQ ID NO: 14454 - protein, 511 aa, Cryptococcus gattii
MFARQPLSQHLLRPLSRPSSSFSRPSTLPKLAFLQSARGFASASEPYDVVIIGGGPGGYVAAIKAAQLGFKTACIEKRGALGGTCLNVGCIPSKAMLNNSHIFHQTQHDLKNRGIDVSGVQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGSIGAGMDGEVGKQFQRILTKQGFKFKLNTKVVSGHREGDIVKLKVDSAKGGKEETIEADVVLVAIGRRPVTKGLNLEAIGVETDKKGRIVIDNEFNTSAKGVKCIGDVTFGPMLAHKAEEEGIAAVEILKTGHGHVNYDAIPSVVYTHPEVAWVGKNEEELKAAGIQYKIGKFPFAANSRAKTNQDSEGFVKFIVEKDTDQVLGCHIIGPAAGELIAPAVLAMEYKASAEDIARTCHAHPTLSEAFKEAALSSYDKPINF

SEQ ID NO: 14455 - protein, 104 aa, Streptococcus pyogenes MGAS8232
MALEVTDATFVEETKEGLVLIDFWATWCGPCRMQTPILEQLSQEIDEDELKILKMDVDENPETARQFGIMSIPTLMFKKDGEVVKQVAGVHTKDQLKAIIAELS

SEQ ID NO: 14456 - protein, 519 aa, Medicago sativa
MDSLLKFPIMVNLKEEPFLMAIMVIVPLTLLLGLMSRILKRPRYPPGPKGLPIIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDYAVRTVSDNIGNPVNIGELVFNLTKNIIYRAAFGSSSREGQDEFIGILQEFSKLFGAFNISDFVPCFGAIDPQGLNARLVKARKDLDSFIDKIIDEHVEKKKSVVDEETDMVDELLAFYSEEAKLNNESDDLHNSIKLTKDNIKAIIMDVMFGGTETVASAIEWVMAELMKSPEDLKKVQQELAEVVGLSRQVEEPDFEKLTYLKCALKETLRLHPPIPLLLHETAEEATVNGYFIPKQARVMINAWAIGRDANCWDEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 14457 - protein, 338 aa, Lactobacillus acidophilus NCFM
MTVKIGINGFGRIGRLAFRRIMDLGEKSKDIEVVAINDLTTPALLAHLLKYDSTHGTFDHEVSSTEDSIVVDGKKYRVYAEPQAQNIPWVKNDGVDFVLECTGFYTSKAKSQAHLDAGVKRVLISAPAGNDLKTIVYSVNQDTLTADDKIVSAGSCTTNSLAPMVNALQKEFGIEVGTMTTIHAYTSTQMILDGPVRGGNLRAARAAAINIIPHSTGAAKAIGLVIPELNGKLNGHAQRVPVPDGSVTELVSILGKNVTADEVNEAMKKYESPSFEYEPNNVVSSDILGRTAGSIFDPTQTMVTTAGDKQLVKTVAWYDNEYSFTCQMVRTLLHFATL

SEQ ID NO: 14458 - protein, 519 aa, Medicago sativa
MDSLLKYPIMENFKEEPFLMAIMFILPLILLLGLVSRILKRPRYPPGPKGLPVIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDHAIRTVSDNIGNPVNIGELVFNLTKNIIYRAAFGSSSREGQDEFIGILQEFSKLFGAFNISDFVPCFGAIDPQGLNARLVKARKDLDSFIDKIIDEHVQKKKSVVDEETDMVDELLAFYSEEAKLNNESDDLHNSIKLTKDNIKAIIMDVMFGGTETVASAIEWAMAELMKSPEDLKKVQQELAEVVGLSRQVEEPDFEKLTYLKCALKETLRLHPPIPLLLHETAEEATVNGYFIPKQARVMINAWAIGRDANCWEEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 14459 - protein, 468 aa, Kluyveromyces lactis NRRL Y-1140
MNNIVVFAGSSHLDLVNKICENLGIERSQVKLGKFSNGETSISIEESVREKDVYVIQSGCGHVNDNFMELLILINACKTADASRVTAVMPYFSYSRQPDIPYTAKGAPLISKPKEKYTFESHPGTPIPQSMLTVEKPMSPNSSRLDAASSASSSGPQSLQSPTPLRPVELRPTSSTSSRIPMIPNGKAEHPSEQEQDSNADALFNASNSSYKLWVAQAGTLIANLLTTSGADHVITMDLHDSQFQGFFDIPVDNLYCKPITQAYIQHHIPNYQDCVVVSPDAGGAKRAAKIADVLELSFAMIHKERRSQLLKGPPGATLTSGGGVPVSTKPLIESLDIRTSLSNNGNNKYVNTTMLVGDVRNKECIIVDDLVDTSYTITRAAKLLKDQGATKIYALITHGIFSGDALNRIGQSVIDKIIVTNSIPQDETIKVLGADRVEVLDVSNIFAEAIRRIHNGESISILFEHGW

SEQ ID NO: 14460 - protein, 448 aa, Oryza sativa Japonica Group
MEKSELLLGSYSYAALCGVTLIIGWLAHWVYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWRTVSKSIIGTKGGKSKASEARAPPLSSIRTLCNYAALGY

SEQ ID NO: 14461 - protein, 1362 aa, Ustilago maydis 521
MNPSYTERRASAHPTMSSSAHHASSTPSAASIDPTTSHAISSGIPITSPAALSYFAAHPRRQQVHFGNYLLLQTLGEGEFGKVKLGVHKEWGEEVAVKLIKRDKVANDAAPLHLDDSAQKDPAKMSKVEREIQVLKDVRHPNIVRLYEVIESDRYIGIVLEYASGGELFDHILAHKYLKEEHACRLFAQLISGVSYLHHKKIVHRDLKLENLLLDRNRNVIITDFGFANNFEHKRNDLMATSCGSPCYAAPELVVQDGLYAGSAVDVWSCGVILYAMLAGYLPFDDDPANPDGDNINLLYKYILATPLSFPEYITAQPRDLLSKMLVPDPTRRATLEQVMQHSWLRHYRELFKFSVDDLERAAMEQQTKKRQMYRQQMMYQQQLQEQQRRQQMERSQSVRHNVSHLPVGTAYTANTAVSAVSAANVAHRQTLPISATVPDRLYEPIGSASRGADHSVTPQRAPTASSHQPPVAPTASADAAIAPLPRASTHNNVAAAADAAAAVAAAPSPVDPVTALGNARGEPRTRLDDAVPTIAAAYETEPRQLAAQKVQRHTIQLEYGGDERPRKESAPGSRQASQTQRNASASSTSSKLAEIERTKTAADKPAANANAIVPPSVLQSTSVQVPATSVVVPESEKANISKAGAPDMMRSVSASAASRVSVPPPIMEQTQPSVSAHRSTQPTSSSRVRAPSSASRNNADSGSTGHATRIPTSASQRVVSTSSAASEPVGFPSSATERTIPSADADAAAGRISASRRASNGAEITEPSHRSPSATRHATADNAPVTSASASARHRKGMSTDKFFLSRLLGSNSANQPNGAGVAGDKVSANGSDAAGDKTKRDSMNRPAPERAPSSSSTGKNGRRKAMSLVVGHASGEASSAAADRNRALKAGMPHSATRATFGTQVSGKADDSVSSAQKQRKGSASLASQTTSTSRAAQSSTRPQPLQPSLQQQQQQQDKAFNDGSTIASSSTAGPSSNAAKKVMDWFRKKSLSRGTFNEQPPLGLFERSPTSSYMHGSASQTPSVIVTSAPNGTSRHAEAPSGGSSVPSSRSTSGTHSENSEATEMTQLTNLSDASHQEGDGLKSSASTVQQQATPKASLSAVSNVSDASAAGSLVSTRSQQQQRPQPRVATATSASTTPARFNEARLRYHLGAVDQSALTSRSPIEVLKEVQRVLYEMGIDVRTEKDEDFKLECVRRKRAKTLMSATHGFGMSIRSSVFPPTQADVERSSRMSHRDSLTPSASSPGGGSLRSFLKRSSLQPGATSPKMGSSTLPSSATVTSNLGGAVHDENQPPPLYGDASVDGGQEIRFSVEVTRIKNLTGLYSLDIRRMKGNLWAYKFVYQALLDRCQLGSSTAAVG

SEQ ID NO: 14462 - protein, 359 aa, Coccidioides immitis RS
MSSALFGSTTSTTGDLSKDVALSSPPEDSISDLAFSSVSDHLAVASWDKKVRIYEINEQGMSEGKALFEHQGPVLNCCWSPDGTKVVGVGADKAARMLDLAGNPSNPVQVAAHDAPIRCCRMISNPANSSQPLLVTGSWDKTVKYWDLRQSTPIASLDCQERVYTMDVRNKLLVIGTADRYINIVNLDQPTKFYKTMQSPLKWQTRVVSCFTDATGFAVGSIEGRCAIQYVEDKDSSSNFSFKCHRESPSGSTTISNVYSVNSIAFHPTHGTFSTAGSDGTFHFWDKDAKHRLKGFPNVGGTISCSTFNRNGNIFAYAVSYDWSKGYTGNTPQTPNKVMMHPVAAEEVRPRPSNARRTR

SEQ ID NO: 14463 - protein, 224 aa, Oryza sativa Indica Group
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMACDPAVGGGEDDNDGEVQLWSY

SEQ ID NO: 14464 - protein, 439 aa, Kluyveromyces lactis NRRL Y-1140
MIPSSCVIGRSFGYNLIHQNISSKLRGIFKHYTKSSTANTIKITNTNTISNMSPASDRLKQTSSILSKSVEPQADAPFKVTVVGSGNWGTTIAKVVAENCALRPNLFVNRVDMWVFEENINGEKLTEIINTRHENVKYLPGIKLPSNLVANPDLVDAAKDADILVFNIPHQFLPRICSQLKGNVKPQARAISCLKGFDVGKDGVKLLSTYIKETLNIECGALSGANLAPEVAKENWSETTVAYQIPEDYKGPGKDVDHSLLKALFHRPYFHVNVIEDVAGISVAGALKNVIALGCGYVEGLGWGNNASAAIQRVGLSEMIKFGRTFFPECKVETYFQESAGVADLITTCAGGRNVRVAKHMAITGKSAEEAEKELLNGQSAQGIITTKEVHEWLATCGKTAEFPLFEAIYQITYGNASMEQIPDMIEDFEGIDYNVKKH

SEQ ID NO: 14465 - protein, 144 aa, Escherichia coli
AYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 14466 - protein, 373 aa, Oryza sativa Japonica Group
MARRSAPLLRRILSSPAPAPAHHGGAGARRTVTYMPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 14467 - protein, 467 aa, Staphylococcus epidermidis RP62A
MNDTGDKKLSRTSLIGLVIGSMIGGGAFNIQSDMGGHAGGLAIIIGWLITAIGMISLALVFQNLTNERSDLDGGIYSYAQAGFGDFIGFASAWGYWFSAFLGNVAYATLLMSSIGNFFPIFKGGNTFPSIIVASILLWSVHFLILKGVETATLINSIVTITKLIPILLVIICMIVAFNFNTFKIGFFGMDGYGSLSFHFANTMSQVKSTMLVTVWVFIGIEGAVVFSGRAKNKKDVGTATVIGLISVLLIYFLLTVLAQGIVIQNHISKLEAPSMAQILAYIVGDWGATFVNIGLIISVLGAWLGWTLLAGELPFIVAKDGLFPKWFAKENKNGAPMNALFITNVLVQIFLISMLFTKSAYHFAFSLAASAILYPYMFSAFYQVKYTIEHKLTATPKQWIIGILASIYAIWLVYASGIDYLLLTMLLYIPGIIVYIVVQKNNQKRLTQFDYIFFSLIVILALIGLLR

SEQ ID NO: 14468 - protein, 78 aa, Triticum aestivum
  misc_feature (4)..(4): Xaa can be any naturally occurring amino acid
  misc_feature (25)..(25): Xaa can be any naturally occurring amino acid
  misc_feature (40)..(40): Xaa can be any naturally occurring amino acid
  misc_feature (55)..(55): Xaa can be any naturally occurring amino acid
MTVXTCCLGAGYVSGPTMAGIALRXPDIQVVVVDTTKYRXNAWNRDTLPIYEPGXLDEDPKHCRGKNPFFSSDIEKHS

SEQ ID NO: 14469 - protein, 330 aa, Agrobacterium tumefaciens str. C58
MGMLVEGVWKDVWYDTKETKGHFKRSASQFRNWVTVDGAVGPSGEGGFEAEKDRYHLYVSFACPWAHRTLIFRKLKKLEDLISVSVVDPLMLENGWEFKPEGERTPGATQDHLFGSSTLWQVYTKADPTYSGRVTVPVLWDKKRGTIVSNESAEIIRMFNVAFNDLTGSDADYYPKALRAEIDALNDVIYDTVNNGVYKAGFATTQDAYQQNAVKVFETLDMLEDRLKDRRFLFGSEQTEADWRLFTTLVRFDPVYVGHFKCNIRRIHDYPHLTGYLRDLYQTPGVPDTVDMRHIKEHYYRSHRTINPTGIVPIGPELDLTMAHGREALS

SEQ ID NO: 14470 - protein, 481 aa, Coprinopsis cinerea okayama7#130
MGFVPGPSDPFYELMQPPPDETPAQATARQKRELDAQRINDRIDEEIKQERARAKKERNVIKLLLLGQSESGKSTTLKNFRMRYAKEEWEEERSGWRSVVQLNIVRSITTIIRIVEAEMNGDAADSEEEQIIAMEERDQEENEGLKFTDRHQLLMIRLAPLLGVEAELKRRLGAGAAEPMQTAPMAATPFELPQQPNPRRKKAAEFSVRSWKDVLDKESRIQSSDAAATGVDLPTMTLAALKDDMKALWQDKTIQQALQRNKVQLSDSAGFFLNDLDRIATRDYVVTDNDIVRARLRTVGIQEHKLVFSHGGGHHGWEWRIFDVGGCRTLRAAWLPYFEGVNVIIFLSPVSVFDQWLEEDPRVNRLEDSIILWTSICQSKLLAKTQLILFLNKCDLLRRKLKRGVKVNQYLPSYGDKPNEVISVVKYLREKFKDIQKQCSPEHRSAYIYPTTVTDTEATAITLESVRDGVLRENLAASQLI

SEQ ID NO: 14471 - protein, 256 aa, Citrobacter freundii
FVIVAAGIKEIVLVTHASKNAVENHFDTSYELESLLEQRVKRQLLAEVQSICPPGVTIMNVRQAQLLGLGHSILCARPIIGDNPFVVVLPDVVLDTASADPLRYNLAAMVARFNETGRSQVLAKRMEGDLSEYSVIQTKDPLDNEGKVSRIVEFIEKPDQPQTLDSDLMAVGRYVLSADIWAELEKTAPGAWGRIQLTDAISEPAKKQSVDAILMTGESYDCGKKMGYMQAFVKYGLRNLKEGPKFRKSIEKLLAM

SEQ ID NO: 14472 - protein, 403 aa, Lactobacillus acidophilus NCFM
MAKLIISDLDVKGKKVLVRVDFNVPIKDGVIGDDNRIVAALPTIKYIIEHGGKAILLSHLGRVKSDADKKELSLKPVAERLSELLDKPVTFVPSNEGKEVEEAIDNMKDGDVVVLENTRFQDIDNDFGKRESGNDPKLGEYWASLGDIFVNDAFGTAHRSHASNVGIATAMKENGKPAAAGYLLEKEIKYLGDAVDNPVHPFVTILGGAKVSDKIGVIENLIPKSDHILIGGGMAYTFLAAQGHKIGKSLFEADKVDLAKELLEKAGDKIVLPVDNVAATEFSNDASREVVGDDIPDNMMGLDIGPKTIAKFKDILKDAKTVVWNGPMGAFEMPNFAEGTLEVGRALANLTDATTIIGGGDSTAAAKQLGIAPKISHISTGGGASLNYLEGKVLPGIACVSDK

SEQ ID NO: 14473 - protein, 130 aa, Frankia sp. CcI3
MAKLSTEELLDAFKELTLLELSEFVKQFEETFGVTAAAPVAVAAAPAAGGAGGEAPAAEEQDEFDVILESVGDKKIQVIKEVRALTSLGLKEAKDLVDGAPKPVLEKVAKEAADKAKAALEGAGATVTVK

SEQ ID NO: 14474 - protein, 252 aa, Lactobacillus acidophilus NCFM
MSRTPIIAGNWKLHMNPEQTTEFVDAVKGKLPDPSKVESLICAPAVDLDALRKAAEGSNLHIGAENCYFEDEGAYTGETSPKVLKEMGIDYVIIGHSERRGYFHETDEDINKKAKAIFANGMKPIICCGESLETREANKQEDWVVAQIKAALDGLTAEQVSSLVIAYEPIWAIGTGKTASSDQAEEMCKTIRETVKDLYNEETAENVRIQYGGSVKPANVKELMSKPDIDGGLVGGASLDPESFLALVNYQD

SEQ ID NO: 14475 - protein, 426 aa, Triticum aestivum
MALYRRAASAIRRRGAGGLPLLPARAMASLFGHVEPAPKDPILGVTEAFLADPSPDKVNVGVGAYRDDSGKPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKNVWLGEVKGMADRIIGMRKALRENLEKLGSPLSWEHVTNQIGMFCYSGMTPEQVDRLTSEYHIYMTRNGRISMAGVTTGNVAYLANAIHDVTK

SEQ ID NO: 14476 - protein, 606 aa, Arabidopsis thaliana
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTYSRDPVPFSLAPRLSNKMGLEAAVEATLEFLNKAVKQVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAAETGDSWFNCQKLKLPKRYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKGETSKELLEWGHASLLLTAVLPNPQ

SEQ ID NO: 14477 - protein, 416 aa, Pichia pastoris
MSLSNKLSVKDLDVAGKRVFIRVDFNVPLDGDKITNNQRIVAALPTIQYVLDHKPKVVVLASHLGRPNGEVNPKFSLKPVAAELSSLLGKKVTFLNDSVGPEVEKAVNSASNGEVILLENLRFHIEEEGSQKKDGQKIKADKEAVARFRKQLTALADVYVNDAFGTAHRAHSSMVGFELEQRAAGFLMAKELTYFAKALENPVRPFLAILGGAKVSDKIQLIDNLLDKVDSIIIGGGMAFTFIKVLDNVAIGNSLFDEAGAKLVPGLVEKAKKNNVKLVLPVDFVTADAFSKDAKVGEATVESGIPDGLQGLDAGPKSRELFAATIAEAKTIVWNGPPGVFEFDKFAEGTKSMLAAAIKNAQNGGTVIVGGGDTATVAKKFGGADKLSHVSTGGGASLELLEGKELPGVVYLSKKA

SEQ ID NO: 14478 - protein, 342 aa, Pseudomonas syringae pv. syringae B728a
MILVTGGAGYIGAHIALELLEDGRDVVVLDNLCNSSREPLRRIEELCGRQVAFIHGDVRSKATLHRLFAQYPVKAVVHCAGLKAVGESVREPLRYFETNVSGSVNLCQAMAEAGVFDLLFSSSATVYGGCEQMPLDENCPLGLPTNPYGHSKLMAEHVMQSVARSDPRWSIGLLRYFNPIGAHPSGLLGESPCNTPNNLLPFLLQVANRLRPALHIFGSDYPTLDGTGVRDYLHVMDLAEGHLKALDKIHDERGVSVWNLGTGQGYSVLEVVHAFERISGKAVPLIFEPRRPGDIAACWSDPGKAARELDWRARFNLDSMLTDAWRWQCMNPQGYRPTALVS

SEQ ID NO: 14479 - protein, 329 aa, Lactobacillus acidophilus NCFM
MSVFSLFKEQVEQADEKKKIIFPESNDLRILTAVSNLNKDNIIDPILIGKREDIEKLAAENNLDLDGVKIYDQNNYAGLDEMAEAFVKARKKDTSIAEAKAKLAKGNYFGTMLVKMGKADGMVSGAAHSTANTVLPALQLIHAAKGMHRVSGAFVMEKGDERYIFADCAINIDPDEETLAEIGYQSAQTAKMAGIDPKVAFLSFSTKGSAEGPMVNKVHDAAAMFQKDHPEIPADGELQFDAAFVPSVGEKKAPGSKVAGHANVFVFPELQSGNIAYKMVQRLGNFTAVGPILQGLAAPVNDLSRGCSEQDIYDLAIVTAAQALAKDEK

SEQ ID NO: 14480 - protein, 186 aa, Agrobacterium tumefaciens str. C58
MSTATSKFLSYVLRHAPESIGLVLDSQGWADVADLLAKANASGTPLDEAGLRAVVAESDKKRFTLSEDGRRIRAAQGHSVKVDLGQPPVEPPPQLFHGTATRFLEPILREGLRPGERQQVHLSADRTTALAVGQRHGKPVVLIVDAGQMFADGCRFYLADNGVWLTDAVPFSYLTVSADSSAENDR

SEQ ID NO: 14481 - protein, 338 aa, Vibrio campbellii AND4
MQVGNEALVLSAVGVIGLGCQWLAWRMRLPAILFLLLAGIIVGPILQWLNPDDILGDLLFPLVSLAVAVILFEGSLTLNFKEIRGVSGSVWSIVSFGAIISWVTTSVATHYFLDFSWELSILFASLTVVTGPTVIVPLLRTVRPTSKLANILRWEGILIDPLGALFAVMVYEFIVSHSAVNSAEVFATIIAVGLIIGATSGAVMASVIRRAWLPEYLQPFGVLMVVLGVFSISNQIESEAGLLTVTVMGMWLANAKGINIQQILHFKEHLTILLITGLFIFLAARISLDDFAALGSGAALLFVFMQLVSRPLSIFVSTVRSQLTFKDKLFLSWVAPRG

SEQ ID NO: 14482 - protein, 566 aa, Chlamydomonas reinhardtii
MQALQRSAKTLPTTSQRVREIAAVTSAPRAVAGPLSARTTAPLVQPVSAPLASGRRVEARAASTASAPKSSKGNAPMAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 14483 - protein, 480 aa, Oryza sativa Japonica Group
MASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFICGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHSLVTKYSWRTVKGGNIVRTPGLSFPDGFHIQLFPKN

SEQ ID NO: 14484 - protein, 796 aa, Oryza sativa
MDGLIRPNWLDTPIQYLRGLFFGALGIEIHASEYRYWTAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNALSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGKGGKGIVYKVVVGNGATPVAVRRLGGGGGGGERCKEFAAEARAVGRARHPNVVRLRAYYWSADEKLVVTDFVGNGNLAAAMRELAGEAGVLAGRPGQTPLSWSTRLKIARGAARGLAYLHECSPRRFVHGEVKPSNILLDADFTPRVADFGLARLLAVAGCADDVVDAPPAAPSSGGLLGGAIPYAAKPASSVAADHRGGGYRAPEARTAGARPAQKWDVFSFGVVLMELLTGRGPGDHASPSTSASFSAPSSSSAATTDRSGSGEHGHGAGVGGAVVPEVVRWVRRGFEEEARPVSEMVDPALLRDAPPLPKKEVVAAFHLALACTELDADLRPRMKAVADTLDKIASS

SEQ ID NO: 14485 - protein, 490 aa, Chlamydomonas reinhardtii
MAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 14486 - protein, 462 aa, Hyphomonas neptunium ATCC 15444
MASPSHRLYRLWGTVTDVAAGMLGIAGVSELAGVGNEIVIEKQGQKIHGEILSVSGDSVTALLYSPSDIIRIGDVVHIEQEARIEPGDHWLGQIINYRGEVATEMPAGAGLTAKGVSRALRAPALPAHLRHRLGPRLATGWMVTDTLLPICRGQRLGLFAGSGVGKSTFLGSLAGGLEADRVVIALIGERSREVGEFVNVNLPETVRHKTVVVSATASESPGAKKRAAYCAMATAEHFRDQGHSVLFLFDSITRFAEAHREVALLAGETPALNAFPPSTVRVIAELAERAGPGTGAKGDITGIFSVLVAGSDLEEPVADMIRGILDGHIILSRNIAERGRYPAIDVLKSVSRALPAAANDWENDLLRDYRRMIALYDEVAPMLRASLFEFGRDKDADRAIALYPALDAFVSARNALGIDAAFSAMSEILNAGTFPAPGAPPAETPQPAAGQPVTRPPPRPRS

SEQ ID NO: 14487 - protein, 1186 aa, Cryptococcus gattii
MSVARPTPNLRTPRFPLDHRASLSDGHTNTSSSSRDDALSSHSTGTAFHKFQSYSSFAPHYLNAPPGLAFKTYLDKWGPEQVMGFLAIHGCEHHSGIFIKHSIDGKLLLDFDMSVLTSLGITKVGERIRLMGGIKCLRQRVAHEAKKHNIRSARICDGSLGTDQAKVMIHPKRSASLYAHCQNPFDSDGQSTACRSRLTPSSPADRESDPSPMQRSMNRSIITTFSRRQIIGSLPSEQIHNQSVDSSPTSSLCPPALQRLSPRSTGVSYSDITPKGTPPLITQSTNGAFDHTFSVTGPRDTTSPLGGHLHRPNFFYSTNDISQTCNRPANNTISEQPQRDRESSPSERKENGVICEDEAMGDNSLFAPTFANHPFAISITESNVLEYPRNLSIKNCLPLTSFPSPDKPAAEDTSVMNPSAPSLDDLRRQLIKFVNADDGTTRTVNVMEVTSGAEVLERALKKFGKTGSGRASFLDEDIYGDGKHEGFLCIDGWGVFAENLSGEEMGPMTEGDLLDICSSLRSGAAIQRDALVLRQTSKPQKRKDMRLYLGNTSVLPTPVNLPISFSSPYSGQFVQNSTLQYPAQHQPLLSTNRSRASMMSIMSGLGVSHPGIEKPTDESVQSSTSVTMPSSKKKSMYNFFGHRPPSELISSHLADYFPSAKKRDVAKARGSMLRLNTSHSTEGDPRDVETRPMIEVDDIFFPSTEESSTERRDHYFDPSTFQQRDTSSPRHVGNFTSNRGGSSKGNCKPHSDQKALSTLKTQELHSVNSVTPLLGASPPEVPLTYQPAWLTDFDRDPSFSQLQPLQHSSASSSKQPSSSNRRTMDEITAEMQHRQTSLSCDRPPSKVDSDISAPPSDSETSLGHSSDASDVLESSSGYSDDRSSVSSEDSEEDMAVHTRAFTSNGSKRNIKWIKGALIGAGSFGSVFLGMDAHSGLLMAVKQVELPRGIAKMEARRRDMLSALEREIELLKDLQHDNIVQYLDSSTDANHLNIFLEYVPGGSVAALLSNYGAFEEALAGNFVRQILTGLNYLHKRDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSCTFALDYRMRPSAASLLEHTFIIHDGRLNQEM

SEQ ID NO: 14488 - protein, 435 aa, Candidatus Protochlamydia amoebophila UWE25
MATNKMGLMSAILLGINMILGSGIFLLPGKVSELTGASSLYVYVFVSLLILSIAWCFAQCAALFDRNGGAYLYAKEAFGDFIGFEIGFMRWIAGAMAWASLIVGFVTALSSIWPNALTEPLRGFLILIFLALLILFNMGGTEKLKNINNVVTIAKVLPLLFFVLIGFFYTKGNFQAIDVSLSHLDSISFGNAAIVIFYAFGGFETLVIAAGEIKNPHRNLPIAVMAVISFCSFLYFLIQIIAMEILGPHLAESSIPLADATEQMIGSAGRWIVTLGMIISIGGVNLTASFITPRSGAALAEDGLVPRWIAKNNKAGVPVVAIFLTASLTTIAALSGSFTQLAVISVVSRFVQYGATCLAVFVLYYRNRATLKMLKKISLVIIPSLSLIGLIWMLFQASSSQLYWGLGALLPGIPIYFFQKWKNNLTLATVSEMGD

SEQ ID NO: 14489 - protein, 311 aa, Dehalococcoides ethenogenes 195
MNTKDLLSISDLSPDDIGRLLSDAIELKARGWNSCLSGKTLALVFEKPSLRTRVSFELAMKQLGGEALYLSPAEVGLGKREPVADVARVLARFVDVIACRTFGHDTLVQLAKYADIPVINALSDLEHPCQALADILTIYEKKGELKGLNLAYIGDGNNCANSLLLACAMTGINCRLASPEGYLVDKAIFAKAKAYAEDSGAELYSGTDLKAALRGADVIYTDVWTSMGQEAETEKRLKDFAGFQVNAKLVSMADKDAIIMHPLPAHYGEEVDREILECPQSVIFDQAENRLHAQKAVLRDMLGGLEIGGRH

SEQ ID NO: 14490 - protein, 643 aa, Cryptococcus gattii
MTFNGPSLTPSRPAPAPPGRGANQMPNSTIPHAKSALESSFSSTSYSSSFPSIFSSTVKSTTNIVFNKDAIVRSGAANVKEEGLKAFMWSKRWLVLRGSEFCIYKNENSPSPIYAFPLENVQDVQRVDLKPFCIEIETGDRLIYIAMRTDDDVYGWMEDIYSRSPRLGVSQPTNFVHQVHVGFDSKSGGFTGLPAQWSKLLTSSAITKEEAAKNPEAVLDVLQFYTQQHASDGAETVGPSSVPMLPQQSLSTSAAATRFEGFGLGGQQKMEHARDLRNDKTVPQSTSQMTFHHSCASDGRTLKKGKAVVRYEPSSGAERRLTHDLHHPPDPSSSSPMSIPLEKRISNMNESQIMGKLRSVVSVEDPTFLYSKIKKVGQGASGLVFVARTVSSGRKVAIKQMDLSQQPRKELIVNEIIVMKESQHANIVNFLDAFLLKGSELWVVMEFMEGGALTDVIENNKLTEDQIAAICLETCCGLQHLHSRSIIHRDIKSDNLLMNSQGEVKITDFGFCAKLTDQKSKRATMVGTPYWMAPEVVKQKEYGPKVDIWSLGIMTIEMIESEPPYLDEEPLKALYLIATNGTPTLKSPDTLSQNLKHFLSVCLCVDVAFRATSTELLKHEFLQIACPVKHLAQLLKFKQSSVS

SEQ ID NO: 14491 - protein, 144 aa, Dehalococcoides ethenogenes 195
MPSKRNLIAVLALLLTFCGVLTGCDTGSAVDDANLPAVQNISVAEAKALIDRNAVSADFIILDVRTPSEYAQGHIPGAVNLDYYASFEASLSAFDKTKTYLVYCRTGNRSASAARLMLDNGFAAIYNMQGGINAWISGGLPLET

SEQ ID NO: 14492 - protein, 286 aa, Kluyveromyces lactis NRRL Y-1140
MRLYVLRHGQSEVNQRNIFGGWVDVHLTEKGLDQARNSAILIKAYCQSQGLELPKLGYTSRLIRTEETMNEILKEFGKQPEFRIVSGELPPQQTSDNGKFPVYQSWRLNERHYGSWQGQSKHKMLEEYGEEQYMYIRRDYLGKPPKADLNREMVQDFDQGDTGYEFKEPNRHVKYLEEEITHDELPNGESLCDVVQRLKPLLENMILPNLKERGDSLIVGHGSTVRSLLKILEGISDTDIKEVNIPNAIPSVIELDDNFRFIRKFYLDPESAKVNAELVRQEGFKE

SEQ ID NO: 14493 - protein, 225 aa, Zea mays
MASSSCLASPSGATLCRPRRPRCRVACSAADAGGSTGPAWAKGAGRLACGVLAAWSVASASNPVIAASQRLPPLSTEPNRCERAFVGNTIGQANGVYDKPLDLRFCDYTNEKTNLKGKSLAAALMSEAKFDGADMSEVVMSKAYAVGASFKGTDFTNAVIDRVNFEKADLTGAIFKNTVLSGSTFDDAKMDDVVFEDTIIGYIDLQKLCTNTSISPDARLELGCR

SEQ ID NO: 14494 - protein, 446 aa, Staphylococcus epidermidis RP62A
MKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 14495 - protein, 254 aa, Streptococcus equinus
MVKVAIVTGAGQGIGFAIAKRLHADGFKIGILDYNQETAEKAVQELSPQDAYAVVADVSKREEVAKDFEQVVEHFGDLSVVVNNAGVAPTTPLDTITEEVFERTFAINVGGTIWGAQAALAEFKKLGHGGKIINASSQAGVVGNPNLTIYGGSKFAIRGITQTLARDLADYGITVNAYAPGIVKTPMMFDIAHEVGKNAGKDDEWGMQTFAKDITLKRLSEPEDVAKAVSFLAGPDSDYITGQTIIVDGGMQFH

SEQ ID NO: 14496 - protein, 600 aa, Dehalococcoides sp. CBDB1
MAKTKKPVEKLEPAEETKKDGKVVSTKRTKGSEFFWTQSRCTGCNRCASVCPVDAIKLERDKMPTKRVGTSPCTRACPAGLDIPRYVRFVADGNAPAATAVMREKIPFPSVCGYVCFHPCELECQRQKFDEPIAIRALKRYAAENDDGSWKNNLKIAPPTGKKVAIIGSGPAGLTSAYFLTLLGHEATIFESMEYAGGKMFYSIPEHQLPKEILNKEIKTITDLGVTIHTSCQVQSVQTLFKQGYDSVLLSTGVLGVDEGLLLPCDETTKSDLIKGSDFLKGIKSTTKETLGDKVIVIGGGSEAYNSAFAAKNLGVSEVNLVCSRHTGSKEASPEEVDRAIDAGVTVHPSLDFVKLVKLNDKIEGVELFRIRSYGYDKENKLHYEIINDTRRLISADTIITTVAQNDKPGSDYLSVVQPGVFAAGDGISGARSVIEAMAAGRSVAGLIDKYLGGEGNLDETLAPPEKTIKPLGEPKSQNRSQVELNLVKQAGGDKVEIEKTLSPNAAKKEAQRCLRCDIVHQVHDYSLDTSSCTYCGRCVDACYWDAITNGYGYEAAAKKRKAEAAALEEKNSVYNYAIRILPIAIGLMILAAAIAKLST

SEQ ID NO: 14497 - protein, 446 aa, uncultured marine bacterium 581
MSFSTLGLSESLLKAVADEGYTTPSPIQAQAIPAVLEGRDVMAAAQTGTGKTAGFTLPLLHGLSKGQSAKANQVRALVLTPTRELAAQVAESVDIYGKYLNLRSAVVFGGVKINPQMMRLRKGVDILIATPGRLLDLYQQNAMSFQKLEVLILDEADRMLDMGFIHDIRRIMKALPNKRQNLMFSATFSEDIRDLAKTIVNNPVEISVTPRNSTAVSVTQWIHPVDKNQKRHLLVELINQHNWEQVLVFSRTKRGANRLAEFLEKKDIQAAAIHGNKSQGARTRALSEFKSGKLRVLVATDIAARGLDIEQLPQVVNLDLPEVAQDYVHRIGRTGRAGATGQAISLVSADEAQLLQDIERLIQTLLPRKLVAGYEPESPLPELALRPPAKPKKPKKPKESTPPRTASEKSPTATDKKRHPNDAHSPKRRRSNHRSSPKSARPTGNQ

SEQ ID NO: 14498 - protein, 728 aa, Staphylococcus epidermidis RP62A
MKNKKNSYSIRKLSVGASSIIVASMLFIGGGSVHAAESNHLENQEQSEVSVSHSIEMQHKNQETQQPENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKIKESREQEITNEQKQLQSKDIKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHTAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 14499 - protein, 160 aa, Glycine max
MNALAATNRNFQRAARILGLDSKLEKSLLIPFREIKVECTIPKDDGTLVSYVGFRIQHDNARGPMKGGIRYHPEVDPDEVNALAQLMTWKTAVADIPYGGAKGGIGCNPRDLSISELERLTRVFTQKIHDLIGVQRDVPAPDMGTNAIIKTFHIDIRVIL

SEQ ID NO: 14500 - protein, 393 aa, Streptococcus mutans UA159
MTKLSRRVLEMEESVTLATSARAKTLKAQGRDVLELSLGQPDFVTPKNIQEAAMKSIRDGRASFYTIASGLPELKDAISQYFEKFYGYSVERKQIVVGTGAKFILYALFAAVINPKDEVIIPTPFWVSYADQIKMNDGVPVFIRTSEENHFKATVEQLEAARTNKTKMIVLNSPSNPTGMIYSKKELEAIGNWAVKHDILILSDDIYGRLVYNGARFTPISTISQPICQQTIVINGVSKTYSMTGWRVGYAVGDPEIIGAMSKIVSQTTSNLTTAAQYAAIEALIGNQDTVEVMRQAFEERLNTIYPLLAKVPGFHVVKPEGAFYFFPNVKKAMEMKGYTDVTEFTTALLEETGVALVTGAGFGAPENVRLSYATDMVTLKEAINRIQAFMEK

SEQ ID NO: 14501 - protein, 502 aa, Oryza sativa Japonica Group
MASLALVFLALLLPTISWLWDYIIVPHIWRPYIAAKRLREQGIRGPPYKFLKGCNEDVKKMKDAADDLVLDVHDHNYLPRITNVDGEPFVYWFGAKPRICIFNYEWARQILSSKSGHFLKNDTTPTVLALLGKGLVLVEGIDWERHRRVINPAFTMDKIKELEDQASSNKNGETQVELDKQFQELTADIISHTAFGSSYKLGIEAFHAQKELQEIAVKSLLNVQIPGFSYLPTKGNWRKLTLEKKLRGTLMQIIQSRLSSKGSGYGSDLLGLMLEACIATDQGREQHQLSLSIDEIIHECKTFFFAGHETTSLLLTWTVFLLSVYPEWQARLRLEALRECGKENPNGDNLSKLKEARKLMSMVFLETLRLYGPALFLQRKPLTDITVGETKIPKDHAIIIPSAIMHRDKEIWGDDTDEFNPLRFQNGVTRAAKVPHALLAFSIGPRSCIGQNFAMLEAKSVMAMILKKFSFTLSPNYVHAPVDLLTLQPKFGLPVVLRLLDA

SEQ ID NO: 14502 - protein, 455 aa, Oryza sativa Japonica Group
  misc_feature (106)..(106): Xaa can be any naturally occurring amino acid
MAAARAHVKDPAHRTKVVLRRLPPAIAQQAVVEQVDARFGGRYDWSCFRPGNASQKNHRYSRLYLNFKGPEDVVEFAEVFNGHVFVNEKGAQFKALVEYAPSQQVXKSNTKKDARQGTIMKDPEYLEFLESISKPAEHLPSAEIQLERKEAERAAAGKEPPVVTPLMVYVRQQRAAKSMAQQYVLRENAKEKPTYILVPKRDEHAQREKDATSGGISGSAHVAENKKEKIVLLKGRARVDSNTSDVTSQQQSGTPMKNAAQSSSRQDPRLEGSGRIIKTILSNKEGRHVVTSQHDQEGHIITAEKRPPRIPNPRSVVKDQVVENAEKNHLDDKHSHLHGSGLISEKTERHARNRDRPDRGVWAPRRYDKSASGGTHSSSSEFSPMQQHSGENFCQQADGHRHANRRGPPRGLKEMEISASTSDGKPSKRASANYGAHEILIKTNIASCGVLDFAA

SEQ ID NO: 14503 - protein, 308 aa, Prochlorococcus marinus str. NATL2A
MVRLNEIKMQDGKIFLITGANSGLGYETSKFLLERGATVIMCCRDLLKGEKAKKELLKFKFSGKIELVELDLSDLINVKKFAESIKNTFDHLDVLINNAGIMAPPKTLSKQGFEIQFAVNHLAHMFLTLELLPMLEEKNNSRVVTVTSGVQYFGKIQWEDLQGNLKYDRWASYAQSKLANVMFGLELDSKLKETNSKTSSLLAHPGFARTNLQPKSVEANQSWQEELAYKLMDPMFQSAKMGALPQITAATLTSASGGEQYGPRFNFRGFPKICRNAPKALNQTSRKKLWDISEKLIKDFDTLSKQSK

SEQ ID NO: 14504 - protein, 285 aa, Salmonella typhimurium LT2
MKSVKNVTFCGQVTLPAIGQGTWYMGERADQRQREVSALRAGLDLGLRLIDTAEMYADGGAEKVVGEALAGRRDEAFLVSKVYPWNAGGQKIVAACEESLRRLKTDYLDLYLLHWAGSFSFEETVEGMERLIAQGKIRRWGVSNLDYDDMQALWRIPGGQQCATNQVLYHLASRGIEYDLLPWCQQQRMPVMAYSPLAQAGRLRSGLLNHPVVNEIAQAHNATAAQILLTWVIAHPGVMAIPKAGSTEHVKQNAAALEIALSANELALLDNAWPAPKGKTALDMV

SEQ ID NO: 14505 - protein, 441 aa, Candida albicans
ASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPD

SEQ ID NO: 14506 - protein, 278 aa, Hyphomonas neptunium ATCC 15444
MTSKIAYQGEPGANSHIACGEAFPGFEPMACRTFEDCFIAVERGEAELAMIPVENTIAGRVGDIHYLLPTTQLHITGEYYLPIRFQLMALPGTRLEDVKKARSHIMGLGQCRNFLRKHAIDPITAADTAGAAREVSELNDPSVAAIAPRLAAEVYGLEILAENIEDAAHNTTRFVIMSREPAEIDAGDGPAKTAFIFEVRNIPAALYKGLGGFATNGVNMTKLESYLVGGSFEATQFYAEIEGHPDERPVQLALEELGFFSQSLKILGVFPKAINARL

SEQ ID NO: 14507 - protein, 470 aa, Pediococcus damnosus
MSTGKVVQVIGPVIDVEFPLDGNLPDINNALNIKKLDGSILVAEVALELGDGVVRTIAMDGTDGLQRGAEVEDTGSSITVPVGDKTLGRVFNVLGDTIDNGEEFGPEAKRNPIHRDPPKYDELNPSMEILETGIKVIDLLAPYIRGGKVGLFGGAGVGKTVLIQELIHNIAQEHNGISVFTGVGERTREGNDLYFEMKASGVLEKTAMVYGQMNEPPGARMRVALTGLTIAEYFRDVEGQDVLLFIDNIFRFTQAGSEVSALLGRIPSAVGYQPTLATEMGQLQERITSTKKGSITSIQAVYVPADDYTDPAPATTFAHLDATTNLERSLTQQGIYPAVDPLASTSSALDPAVVGEEHYKVATDVQHVLQRYRELQDIISILGMDELSDEEKTIVGRARRIQFFLSQNFSVAEQFTGKPGSYVPVEETVKGFEGILEGKYDDLPEDAFNGVGNIDEVVEKAKQLTSATSK

SEQ ID NO: 14508 - protein, 222 aa, Oryza sativa Indica Group
MATVSSLFLASPVATAPTARARSTPSASPARPSLRLRRPSTLAAAAVQAEHQPAVAAAPKPPALPFRVGHGFDLHRLEPGLPLIIGGIDIPHDRGCDAHSDGDVLLHCVVDAILGALGLPDIGQIFPDSDPRWKGADSSVFMREAVKLMHEAGYELGNLDATLILQKPKISPFKETIRSNLCDLLGADPSVVNLKAKTHEKVDSLGENRSIAAHTVVLLMRK

SEQ ID NO: 14509 - protein, 441 aa, Candida albicans
ASYGQQPYEFFESCRQKYGDVFSFMLLGKIMTVYLGPKGHEFVFNAKLSDVSAEDAYKHLTTPVFGKGVIYDCPNSRLMEQRKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRDRGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFIYNLRWTIDGYKVPD

SEQ ID NO: 14510 - protein, 470 aa, Pediococcus parvulus
MSTGKVVQVIGPVVDVEFPLDGNLPDINNALNVKKPDGSILVAEVALELGDGVVRTIAMDGTDGLQRGLEVEDTGSSITVPVGDKTLGRVFNVLGETIDNGEKFGPEVKRNPIHRDPPKYDDLNPSMEILETGIKVIDLLAPYIRGGKVGLFGGAGVGKTVLIQELIHNIAQEHNGISVFTGVGERTREGNDLYFEMKASGVLEKTAMVYGQMNEPPGARMRVALTGLTLAEYFRDVEGQDVLLFIDNIFRFTQAGSEVSALLGRIPSAVGYQPTLATEMGQLQERITSTKKGSITSIQAVYVPADDYTDPAPATTFAHLDATTNLERSLTQQGIYPAVDPLASTSSALDPSVVGEEHYKVATDVQHVLQRYRELQDIISILGMDELSDEEKTIVARARRIQFFLSQNFSVAEQFTGQPGSYVPVEETVKGFKEILEGKYDDLPEDAFRQVGNIDEVVEKAKKLTSAASK

SEQ ID NO: 14511 - protein, 285 aa, Gossypium anomalum
DSAVADGVDVISLSVGGAVVPYYLDAIAIGAYGAAEKGIFVSASAGNGGPGGLTVTNVAPWVATVGAGTIDRDFPADVKLGNGKVVTGAGVYNGRGLSPGRMYPLVYAGSGGGDGYSSSLCLEGSLDPDFVKGKIVLCDRGINSRAAKGEVVKKAGGVGMILANGVFDGEGLVVDCHVLPATAVGASNADEIRQYIDSASKSKSSATATILFKGTRLGVRPAPVVASFSARGPNPETPEILKPDVIAPGLNILAAWPDKVGPAGIPSDNRRTEFNILSGTSMACP

SEQ ID NO: 14512 - protein, 285 aa, Gossypium somalense
DSAVADGVDVISLSVGGAVVPYYLDAIAIGAYGAAEKGIFVSASAGNGGPGGLTVTNVAPWVATVGAGTIDRDFPADVKLGNGKIVTGAGVYNGRGLSPGRMYPLVYAGSGGGDGYSSSLCLEGSLDPDFVKGKIVLCDRGVNSRAAKGEVVKKAGGVGMILANGVFDGEGLVVDCHVLPATAVGASNADEIRQYIDSASKSKSSATATILFKGTRLGVRPAPVVASFSARGPNPETPEILKPDVIAPGLNILAAWPDKVGPAGIPSDNRRTEFNILSGTSMACP

SEQ ID NO: 14513 - protein, 394 aa, Kluyveromyces lactis NRRL Y-1140
MNRNERQPTYRLLEEIGRGSFGSVRKVVREADNKVMVRKEVRYGHMNAKERQQLISECAILSQLKHDNIVEFFHWDHDAKSNTLFLYMEYCSKGDLSQMIRYYKHQRKYVPEEYVWRIMVQILMALFKCHYGRDLSKLQTIYDAMEEPLKSKGYVVIHRDLKPGNIFLTGYDDEFNQNASDVDYSKVIIKLGDFGLAKSLQASIEFATTYVGTPYYMSPEVLRDQPYSPLSDIWSLGCILYELCSLHVPFQAKTYTELQGKVKAGYFEPLPHFYSKNLQDIITRCIQVDFTKRPSTWSLLNDIQCRICRKALDLEKFERHLLNYEHELTQVGEMLEQHATEMKRDFASAVDQRVREILNGTSKPAATPLITGTGPVTMPGRTPFRNANVNRNYR

SEQ ID NO: 14514 - protein, 285 aa, Gossypium longicalyx
  misc_feature (175)..(175): Xaa can be any naturally occurring amino acid
DSAVADGVDVISLSVGGAVVPYYLDAIAIGAYGAAEKGIFVSASAGNGGPGGLTVTNVAPWVATVGAGTIDRDFPADVKLGNGKVVTGAGVYNGRGLSPGRMYPLVYAGSGGGDGYSSSLCLEGSLDPDFVKGKIVLCDRGINSRAAKGEVVKKAGGVGMILANGVFDGEGLVVXCHVLPATAVGASNADEIRQYIDSASKSKSSATATILFKGTRLGVRPAPVVASFSARGPNPETPEILKPDVIAPGLNILAAWPDKVGPAGIPSDNRRTEFNILSGTSMACP

SEQ ID NO: 14515 - protein, 285 aa, Gossypium bickii
DSAVADGVDVISLSVGGAVVPYYLDAIAIGAYGAAEKGIFVSASAGNGGPGGLTVTNVAPWVATVGAGTIDRDFPADVKLGNGKVVTGAGVYNGRGLSPGRMYPLVYAGSGGGDGYSSSLCLEGSLGPDFVKGKIVLCDRGINSRAAKGEVVKKAGGVGMILANGVFDGEGLVVDCHVLPATAVGASNADEIRQYIDSASKSKSSATATILFKGTRLGVRPAPVVASFSARGPNPETPEILKPDVIAPGLNILAAWPDKVGPAGIPSDNRRTEFNILSGTSMACP

SEQ ID NO: 14516 - protein, 80 aa, Buchnera aphidicola str. APS (Acyrthosiphon pisum)
MKNIEERIKKIIFEKLDIKQEKIFNDASFIDDLGADSLDTVELIMALEEEFDIEISDEEAEKINTVQKSIDFIQKKNLKK

SEQ ID NO: 14517 - protein, 485 aa, Arabidopsis thaliana
MVGRRKALLFSLCFFFLSLPSFSSLPSFQTLFPNSHSLPCASPVSFQPDSDSESLLESEFESGSDSESSSSITLNLDHIDALSSNKTPQELFSSRLQRDSRRVRSIATLAAQIPGRNVTHAPRPGGFSSSVVSGLSQGSGEYFTRLGVGTPARYVYMVLDTGSDIVWLQCAPCRRCYSQSDPIFDPRKSKTYATIPCSSPHCRRLDSAGCNTRRKTCLYQVSYGDGSFTVGDFSTETLTFRRNRVKGVALGCGHDNEGLFVGAAGLLGLGKGKLSFPGQTGHRFNQKFSYCLVDRSASSKPSSVVFGNAAVSRIARFTPLLSNPKLDTFYYVGLLGISVGGTRVPGVTASLFKLDQIGNGGVIIDSGTSVTRLIRPAYIAMRDAFRVGAKTLKRAPNFSLFDTCFDLSNMNEVKVPTVVLHFRRADVSLPATNYLIPVDTNGKFCFAFAGTMGGLSIIGNIQQQGFRVVYDLASSRVGFAPGGCA

SEQ ID NO: 14518 - protein, 295 aa, Agrobacterium tumefaciens str. C58
MVELSQAGNGLLRKGFAGDTFNAAWYARACLPQDWSVDYFTALGDDPLSEDMLAFIAEAGIGTEKIRRIKGGTPGLYLINLKDGERTFSYWRNAAAARQLAADADHLRKTVESADVVYFSGITLAILASAHDVDTFLAELRRARAAGKLVVFDPNIRPRLWADRDVMLETISNGARAATLVMPSFDDEASHFGDVSVEATIARYRSLGVENIVVKDGAKGATLDFGGSRSHAPAEKAVDVVDTTSAGDSFNGAFLARYVTGSSPEEAATFAARAAATVIGHHGALISPELLPLVG

SEQ ID NO: 14519 - protein, 128 aa, Triticum aestivum
QYSDKVTENCVAYWKATGVYTDAEAAAVDKFKEAFGPHSFAPGASILFTHSPAGVLTVAFSKDSSVPESGGVAIDNARLCEAVLESIIGEHGVSPAAKLSLATRVAELLKGASHAGGEPAAEPVSVSV

SEQ ID NO: 14520 - protein, 452 aa, Mycoplasma mycoides subsp. mycoides SC str. PG1
MQKFDVVVLGAGPGGYSLANILSLNNKKVALIEKEDLGGTCINKGCVPTKTLIKSAKVFELVKNSQKFGINADNISFDFKKMQQRRLDNKKFFNNSIKNQIDLNQISFFKGVGEVLDQNSIKVNDQIISFDKLVLATGTRAKIINFDGLEQSRKNGYLLDSDQALFLENVPSSLTIIGDGPISLEFAYLYNTLGSKVTILTNTDFLLRFDIDIQKSVRQYFDEKQIKVIENANIIKIDNNKVFYDQTSIESEKILLAVGRVPNNESFTKLDIKKDKNGFVIVDEFMKTNFDNIYAIGDITGLTLLSSVAYKTGDIVARNILKTDSEKFDKNLVTWAIYLNPEIAGIGLTEQQLKEQNIEFESIMINSKALPRAHADGIVNEYSFIKFLVSKQTEEILGCFMMIENANILINQIGLFMQQKLSFSTLQKTVYTHPTIGEALYYTSRVKGIKTN

SEQ ID NO: 14521 - protein, 254 aa, Streptococcus mutans UA159
MTKVAIVTGAGQGIGLAIAKRLHADGFKIGMLDYNTQAVQEAAASISKEDALAVTVDVSKREAVFDAFDQIVKKFGDLSVVVNNAGLGPTTPVETITEEQFKQVYGVNVGGVIWGTQAAYKHFKALGHGGKIINASSQAGVVGNPELTLYSGTKFAVRGITQVTARDLAKDGITVNAFAPGIVKTPMMYDIAHKVGQNAGKDDEWGMQQFAKDITLQRLSKPEDVANVVSFLASPDSDYVTGQTILVDGGMQFH

SEQ ID NO: 14522 - protein, 221 aa, Zea mays
MDGLAAPSPSHSGATSGGGASHRKRKLPPPSLSDATADEDDDTTAPSSPATSLSSPSRPSSPSSSHSDEDDDDSLTTFTAARLDAAPASSSGRPPKPDSSSASAVTAAAPKPDAASAAAGDGKEDSKGLFTDNIQTSGAYSAREEGLKREEDTGKLKFLCYSNDGVDEHMIWLVGLKNIFARQLPNMPKEYIVRLVMDRTHKSMMVIRNNNGVGGITYRPY

SEQ ID NO: 14523 - protein, 242 aa, Zea mays
MEYVNPLTGFRVDGRRPNEMRQLKGEVGVVARADGSALFEMGNTRVIAAVYGPREVQSKGQQVNSKEALVRCEYRMAEFSTGDRRRKPKGDRRSTEISLVIRQTMEASILTHLMPHSQIDIYVQVLQADGGTRSACINAATLALADAGIPTRDIATSCSAGYLCSTPLLDLNYLEDSAGGSDVTVGILAKMDKVTLLQMDAKLPIDTFENVMGLAIEGCKAIATYIREVLLENTKKLECQRG

SEQ ID NO: 14524 - protein, 635 aa, Coprinopsis cinerea okayama7#130
MSSINLQSHRAQLIATAVAASVTTAGLFYSYSTLTKRRRRKELDLEIRKALSQHDREHPRPGPEPPSPGDIYIKALEEEAAKSIRLQQDEYDEELIREQLARNYAFFGDEGMKKVRGGSVVVVGCGGVGSWAAVMLVRSGVSKIRLVDFDYVTLSSLNRHATANLADVGTPKVKCVERTLKEIAKWVEVDACIDIWRKEEGGELLDGYDWVVDAIDNIQTKVDLLKYCHDNKLKVFSSMGAGAKCDPTRIQISDISYTVYDPLARSVRRRLRLQGVTSGIPVVYSTEVPGDVKLLPLPEEEFQKGPVKELGVFDDFRVRILPVLGPLPAIFGLNIASYIVCELSGKPISNPLPIKNRKKLYERIYRDLLHREGQLAGQQLNRLPIDEDDVGFIFEDLHRGSMAAASQPVGRQPYAPTGIEDWARSDAYHNSFLIGEDPVLDAVVKNNKAQGLPDIAVSTAQGKLLNLLAKSIGAKRILEVGTLGGYSTIWLARGIPRDGRVVTLELSEKHAQVARENITNAGFASQVEVVVGPAAETLKSLQPDPPFDLAFIDADKPGNLTYFTEAKRLVRSGGVIIVDNVVRNGRVADPSLSDDNIEGARKLLNGIKGDSEVDATTIGTVGEKGYDGFLYAVRK

SEQ ID NO: 14525 - protein, 119 aa, Triticum aestivum
TRPAMEEDGSAPPGFVADAVTLFIRDADRILTDLAGLMKQRVVDVDKADALVRQLKGSCISIGAKKLGVSCTYFRRFYKEKPKGCLFVLTLLRNEFYDVRNKFQTMMHLEQQIEAYSPK

SEQ ID NO: 14526 - protein, 441 aa, Candida albicans
ASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRDRGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLLSPGYAHTSERYFDNPEDFDPTRWDTAAAKANSVSFNSSDEVDYGFGKVSKGVSSPYLPFGGGRHRCIGEQFAYVQLGTILTTFIYNLRWTIDGYKVPD

SEQ ID NO: 14527 - protein, 482 aa, Pseudomonas syringae pv. syringae B728a
MLDVPLLIGGQSCPARDGRTFERCNPVTGKVVSRVAAATLEDADAAVAAAQAAFPGWAAMLPGERRARLLEAAAQLQARSGEFIAAAGETGAMANWYGFNVQLAADMLREAASMTTQITGDVIPSNVPGNFAMALRQPCGVVLGIAPWNAPVILATRAIAMPLACGNTVVLKASELSPAVHRLIGQVLQDAGLGDGVVNVISNAPADAPAIVERLIANPAVRRVNFTGSTHVGRIVGELSARYLKPALLELGGKAPFLVLDDADLDAAVEAAAFGAYFNQGQICLSTERLIVDHKVADTFVARLTAKIKTLRAGNPDDSESVLGSLVDVGAGTRIKGLIDDAVARGATLVIGGQLQGSILQPTLLDGVTDAMRLYREESFGPVAVVLRGDGDEALLRLANDSDFGLSAAIFSRDTSRALALAQRVESGICHINGPTVHDEAQMPFGGVKSSGYGSFGGKASIEQFTQLRWVTLQNGPRHYPI

SEQ ID NO: 14528 - protein, 441 aa, Candida albicans
ASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRDRGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPD

SEQ ID NO: 14529 - protein, 511 aa, Cryptococcus gattii
MFARQPLSQHLLRPLSRPSSSFSRSSTLPKLAFLQSARGFASASEPYDVVIIGGGPGGYVAAIKAAQLGFKTACIEKRGALGGTCLNVGCIPSKAMLNNSHIFHQTQHDLKNRGIDVSGVQLNLPKMLAAKEASVKALTGGIETYLFKKNGIDYIKGEASFETANKLSVKLLEGGETQVEAKNVIIATGSEVTPFPGLEIDEERIVSSTGALELKEVPKKMVVIGGGVIGLELGSVWSRLGAEVTVVEYLGSIGAGMDGEVGKQFQRILTKQGFKFKLNTKVVSGHREGDIVKLKVDSAKGGKEETIEADVVLVAIGRRPVTKGLNLEAIGVETDKKGRIVIDNEFNTSAKGVKCIGDVTFGPMLAHKAEEEGIAAVEILKTGHGHVNYDAIPSVVYTHPEVAWVGKNEEELKAAGIQYKIGKFPFAANSRAKTNQDSEGFVKFIVEKETDQVLGCHIIGPAAGELIAPAVLAMEYKASAEDIARTCHAHPTLSEAFKEAALSSYDKPINF

SEQ ID NO: 14530 - protein, 285 aa, Arabidopsis thaliana
MAKDVEGPDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 14531 - protein, 84 aa, Oryza sativa Indica Group
MDSFSSSSGSPPNTEALMDQIKAQLAQAYAQEFLETVGNKCFAKCVTKPGSSLSGSESSCISRCVDRYIEATGIVSRALFSSTH

SEQ ID NO: 14532 - protein, 1141 aa, Staphylococcus aureus subsp. aureus N315
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 14533 - protein, 242 aa, Schizosaccharomyces pombe 972h-
MSHFEILSLEGLRNDGRRWDEMRNFQCRIGIEPSENGSAFIELGNTKVLCIVDGPSEPVIKSKARADRTFVNVEINIASFSTIDVKKRFKSDRRIQLQCLALQNTFEEIIQTELYPRSQISVYLHVLQDDGAVMASCINATTLALIDAGIPVKDFVCCSTAGIVESDMLLDLNSLEESALSWLTVAVLGNIKKVVYMQLETSMHLDYLESVMNMAIAGSEHIYNTMQSAVRQSAKPALASLS

SEQ ID NO: 14534 - protein, 629 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 14535 - protein, 420 aa, Hyphomonas neptunium ATCC 15444
MTPKLFTTLKTYTPKLFAADAFAGVTVAMVALPLSLAIAIASGADPGIGLITAIIGGLLISLLGGSRVQIGGPTGAFIVVVYGVIAAHGFDGLVLATLMAGLILLAAGFLRLGNLIQFIPEAVVNGFTIGIAIIIATSQIKDLLGLQVDHLPAEFLEKLPALWQARESFSPAALGIGLSTILLIILFRRLAPRWPGLIVAVGITSATVAFAHLPVETIASRFGDLPSSLPMPTFPDVTLARLQELLPSALIIAFLAGVESLLSAMVADRMTGGHHRPNAELIAQGAANLGSGLFGGLPATGAIARTATNVKAGGRTPVSGIVHALTLFVIMVSLSDLAGQLALPALAGLLLLTAWNMSEPDKWRDYARLPLEDRLLLILTLVLTVVADLAIAIGVGVGLGLALRLRRRNIPPSDWTPPSR

SEQ ID NO: 14536 - protein, 570 aa, Schizosaccharomyces pombe 972h-
MSSEKVLVGEYLFTRLLQLGIKSILGVPGDFNLALLDLIEKVGDETFRWVGNENELNGAYAADAYARVKGISAIVTTFGVGELSALNGFAGAYSERIPVVHIVGVPNTKAQATRPLLHHTLGNGDFKVFQRMSSELSADVAFLDSGDSAGRLIDNLLETCVRTSRPVYLAVPSDAGYFYTDASPLKTPLVFPVPENNKEIEHEVVSEILELIEKSKNPSILVDACVSRFHIQQETQDFIDATHFPTYVTPMGKTAINESSPYFDGVYIGSLTEPSIKERAESTDLLLIIGGLRSDFNSGTFTYATPASQTIEFHSDYTKIRSGVYEGISMKHLLPKLTAAIDKKSVQAKARPVHFEPPKAVAAEGYAEGTITHKWFWPTFASFLRESDVVTTETGTSNFGILDCIFPKGCQNLSQVLWGSIGWSVGAMFGATLGIKDSDAPHRRSILIVGDGSLHLTVQEISATIRNGLTPIIFVINNKGYTIERLIHGLHAVYNDINTEWDYQNLLKGYGAKNSRSYNIHSEKELLDLFKDEEFGKADVIQLVEVHMPVLDAPRVLIEQAKLTASLNKQ

SEQ ID NO: 14537 - protein, 488 aa, Euphronia guianensis
PGVFTLEKKNLGRIAQIIGPVLDVSFPPGKMPNIYNALVVKGRDTGGQQINVTCEVQQLLGNNRVRAVAMSATEGLMRGMEVIDTGAPLSVPVGGATLGRIFNVLGEPVDELGPVDTRTTSPIHRPAPAFIQLDTKLSIFETGIKVVDLLAPYRRGGKIGLFGGAGVGKTVLIMELINNIAKAHGGVSVFGGVGERTREGNDLYKEMKESRVINEQNLAESKVALVYGQMNEPPGARMRVGLTALTMAEYFRDVNKQNVLLFIDNIFRFVQAGSEVSALLGRLPSAVGYQPTLSTEMGSLQERITSTKEGSITSIQAVYVPADDLTDPAPATTFAHLDATTVLSRGLAAKGIYPAVDPLDSTSTMLQPDIVGKKHYKTAQRVKQILQRYKELQDVISILGMDELSQEDRLTVARARKVERFLSQPFFVAEVFTGSPGKYVGIAETIRGFNLILSGELDSLPEQAFYLVGSIDEATAKATTLKMENNLK

SEQ ID NO: 14538 - protein, 415 aa, Thermotoga maritima
PEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRRELERLSRRFFREIQVIIGPYNDIPAPDVNTNADVIAWYMDEYEMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 14539 - protein, 198 aa, Brassica napus
LPLGIGLSLLLCCLLYMMVSVVIVGLVPYYAMDPDTPISSAFATHGIQWAAYLIALGAIMALSSTLMGSILPQPRILMAMARDGLLPSFFSDVNQRTQVPVKGTISTGFCAALLAFFMDVSQLAGMVSVGTLVAFTMVAVSVLILRYVPPDEVPLPSSLQERICSAPFLRCEENSSSHVGTSISTKQPLLCEPDDSTV

SEQ ID NO: 14540 - protein, 513 aa, Staphylococcus aureus subsp. aureus COL
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCDCRGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 14541 - protein, 864 aa, Oryza sativa Indica Group
MRKRRTWAALFLAVYASLLCSSWRLVESVRAWYYSAAGGAGAVAAWPAAFYASVMYGAVFGLLSMGAALAVAAPAMLITWITVLVLLAFAGKPRRSLGRPLPVPTLPLRLATLSAASALDAVFAPRAATFAYRARHAAVRYLRSIPNASWFFRVAIPRQPFGPRHVRRLLSAISGKVDDPGFVEFLRELFASDAVAFELGGCELGRGLPQESELTATLLNIFFDPVDREVIAIREEVHKKNPRVKDDSVLHTPVRVYAVRYLDEMLVVTSGSKMLTIEVRDRILAVLERDLEVKVDKLGSSVHSAESEKMEFLGMEFQAVPPSVLHPPMSEKAKRARKMYLKRKAAKAQELKNARETRRKKLGLKILSHLFKKVRRGHEFEFDFQIESEVQQLFKEWAEEVVTEYFKSPEHCRYWHRLLTSGDFLSLARVRDQLPPELVDSYDKFQKTLDRFLMPMRDRGTSDEEERLAEEEERQYEKRTVQDLTELKMRVNAPIELVRKAVKLAGFTNSMGRPRPIKLLICLDDTDIINWYAGVGRRWLDFFCCCRNFKMVKTVVSYHLRFSCFLTLAEKHECTKRQAISHYSKDLKVTNDDGVAEVHFPTEREIRMMGDKNLSDPKPVDGALTMIFVRLAVDDTTYPCVAHFCAETDTVIYRIRLLQNRLNVDPLNEKKWVQGLSAIHESLNKKCLPLCPMHARMLLLTSVSVNCMRNNFISMLLRHIQILAVDYSSIMLKLLVQLVDSVIDLARNLVIPTELIVMVRMYHHDEVLSSMVKVVSCFYLTWPCRDISMLNRKLFMIVVMAGIGFHEMDDKATGPCRRWNIFGGVRSTAAVDTSYAQDLDQCLKGRQIATARSGLHYAIVYHSE

SEQ ID NO: 14542 - protein, 186 aa, Zea mays
MARRPDDLALAAITFAIVALCARYASAVGTTPQSTFSYKEGDPTGPTKWATLQKDWDVCDSGTEQSPIDVAKVEVSEDLDPLQQTYEPGDAVMHNRLHDFMLNWTGGNGGLTIEGKKYKLKQVHWHVPSEHTVNGTRFDAEMHMVHEDSTDAKSKAVVAVLFSAKAGKSSKLLRDVPQALLREARW

SEQ ID NO: 14543 - protein, 79 aa, Oryza sativa
MSEEAGRPLPKFGEWDVNDPASADGFTVIFNKARDEKKGGNGQDTDSPCKETRTERVESYAPKTNSKWFCCVTSRPTPS

SEQ ID NO: 14544 - protein, 205 aa, Mycoplasma mycoides subsp. mycoides SC str. PG1
MSKKVSIILIAGGSASGKTTIASKIANEILKDKSVEHISMDNYYKDFTNLSLEQRNHINFDHPNSIDIDLLIKDLKQLLKRHDIFVPTYDYKKHIRTNKEKLIKASDVIIVDGIFSLHFEKLRELGDIKIFVKTPDDLRFIRRLVRDIKERNRTIESVIDQYLTDVKPMHDLFIEQTIDYADIVFKKGNDVAIDIVASKIKDLLN

SEQ ID NO: 14545 - protein, 553 aa, Oryza sativa Japonica Group
MLISPKEQLMFTGRGSVFAQSYLEEIYVMLLQGKCLHKPLSMDDMVVSALGRVHLRDGILMRPIAESRRAAIINSTWFEAMKLLKQMLAYANPHNFDLPPDFLHLCNTMENRYEPKGMNIPYHASLLPLHSRQQALLDAFNLLTNRMNFRYASWISCELPHRTEWPQVLHGNNFLRQWFRDKQWLNDDGTIKVPTGIEFLWAHRVLCCHSDDYARKGVCMYTWEQLHLLIHGKNPLVLPDLHLKLMRADSVSLSSSSLSVSPPRRHRSPASRLRRRRLLPRPLPVVASVPLRLLVRIPDARCSLFWAAADRFPSMAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASYNNFPTAAGLASSVAGLVCFVFTLGNLMNVKEDYGELSSIARQGSGSACRSIYGGFVKWCMGKNNDGSDSIAVQLADEAHWNDLVIIIAVVSSKQKETSSTSGMRDSVETSPLLQYRAQQ

SEQ ID NO: 14546 - protein, 447 aa, Salmonella typhimurium LT2
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSSCVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 14547 - protein, 430 aa, Chlamydomonas reinhardtii
MTHHRTAAASLQLGAPLRSQFPILDQTVNGHPLVYLDNAATSQKPHAVLRALSDCYQEYNANVHRGVHALSARATQEYEDARAKVAALIGARNSREVVITRNATEAINLVANTWGLQNIKPGDEIILSVAEHHANLVPWQLLAARTGAVLRHVRLTPDRTQLDMNHFRTLLSPRTRLISLVHVSNVLGCVLDAAYVAEQARAVGARLLLDCCQSVPHSSLDVTTLGADWIVASSHKFCGPSGVGFLWGSYELLEEMGPWMGGGEMIQDVFLDHSTYAPPPARFEAGTPAIAETIGMGAAAEWLRELGMGRVHDYEQEIGTYLWERLTSLSPRITAYGPAPGDPRSGGRGRASLVAFNVEGLHATDVSTLLDHAGVAVRSGHHCAQPLHRELGVPASARASAYIYNTAAEVDAFVAALKDTIQFFDDVHGA

SEQ ID NO: 14548 - protein, 336 aa, Xanthobacter autotrophicus Py2
MSVKVAINGFGRIGRNVLRAIIESGRTDIEVVAINDLGPVETNAHLFRFDSVHGRFSGEVKVAGDTIDVGRGPIKVTAVRDPAQLPHKDLGVDIALECTGIFTARDKAAAHLAAGARRVLVSAPAEGADLTVVYGVNHDKLTSEHLVVSNASCTTNCLAPVAKVLNDAVGIEKGFMTTIHSYTGDQPTLDTMHKDLYRARAAAMSMIPTSTGAAKAVGLVLPELNGKLDGTSIRVPTPNVSVVDFKFIAKRATTKDEINAAVLAAAASGPLKGILGTTDQPNVSIDFNHDPHSSTLHLDQTKVLEGTLVRVLSWYDNEWGFSNRMADTAVAMGKLG

SEQ ID NO: 14549 - protein, 396 aa, Xanthobacter autotrophicus Py2
MTAFRTLDDADLADKRVLVRVDLNVPMESGRVTDETRLKAILPTIRTITDKGGKAVLLAHFGRPKGRDESQSLAPVAKALEGQLGRKVAFASDCVGEEASSAISRLAAGEVIVLENTRFHAGEEKNAPDFVEALASLGDIYVNDAFSAAHRAHASTEGLARKLPAYAGRSMESELAALTKALEAPVRPVLAVVGGSKVSSKLELLGNLVKKVDILVIAGGMANTFLAALGKKVGKSLCEHDLADTAREILEKAKAAGCEIVLPVDAVVAKEFKANAANRVVSVDEVGDDEMILDAGPETVAVVAQKLDGAKTVVWNGPFGAFEMTPFDAATVAVARDVGKRTRAGTLLSVAGGGDTVAALNHAGVAGDFSYVSTAGGAFLEWLEGKALPGVEALRR

SEQ ID NO: 14550 - protein, 493 aa, Pseudomonas syringae pv. syringae B728a
MSASDGTPLLQRAIEAECVFNGDWIPSSSPSLPVIEPATGELLMNTAMADAADIAVACREAALAQPAWAALGPREKADIFLLAADHAVCAFDELALYVARETGGSLHKGQHEVNETIVLLRQAAGMLSQAHGHGLILPSQAGRLSYARRVAHGVVGVISPFNFPLVLSLRSVAPALAAGNAVVLKPDPQTPISGGFLIARLFEEAGLPKGLLHVLPGSADAGEALCRDTNVQMITFTGSTGAGRKVAEAAGRNLKKVSLELGGKNPLVILEDADLDLAASNAAFGAWLHQGQICMATGLILVHESIVADLTRKLADKARALTVGNAARGEAALGPLINKRQLQHVHQVVSDSLQAGARLETGGEYEGLFYRPTVLSGVKPGMRAFDEEIFGPVAVVVSFSTDEEAIELANRSEYGLAAAVISPDVGRATAIGDRLKCGMLHINDQTVADECVNSFGGRGASGNGSSAGSPSDWDEYSQWQWVTVKNQAPAYPF

SEQ ID NO: 14551 - protein, 944 aa, Chlamydomonas reinhardtii
MTPTTMQTPPPPAGGPAGQQPFATYQVASTNPVFNMQDTGISPLALSKREVYTPAMSDSMAAASRASAGPAPAQPPPRGPGGARPSLPVPNPRDLFSPKAVEEAMQQRPNELQYLCELPRWTYARPGLTGLDLIMDLMAMEQRLVNDLLHAFLGLGSQLVRPRLVAPANARGANARGPCLTFAVREDLVHATLRERVAPLLPIWMVTHALAAALRGYLEDWQVMVAMMENQMLRGALDLTRLTFYCQQPAAALAVLADVAAQAADLYRSSAGASAGNGPGRSLLQHLLTAAAAPYCSGLEQWLRQGVLDDPYHEFMVQEDAMLRRNSPASTSGLPGAASRASSYWRGRYTLRCKVDEAAGAAALASPGGGGGGGGAPTTLDIPNFVFDMRELILRTGKYQNVLRECGQPVAQPLLPQSAAAAASGAPPAPLPPLVYDPTQPGNLQQHVRAAHAAASSALLSFLLRGSSSGGGGLLAVLRSVKHFFLLDQGDVLASIMEVADEELSKPAKAINRTRLQSLLEMAVKMSSAASDPHADSLGFEMDPRPLDVLARAVAATVAASSASGPSGSSHGPSFSAALDTPYGTPGPASRTAASASAVSFTPGGSRLLGPRDQDLPGWELFLPTLKLDWPATLVVGSEELLQYQLLFKHMWGLKRVERQLEATWLLLQGTKRLPRPRGAVPAAEVRRNKQLAVAHALCQQLYFTVQELLRYSTLDVLEPLWEGLEAGIAHRAADADQVIALHRDFLRAARAGLMLEQPRALGCMLGLQAGAAGFARRMAALWDKLQAGLETSSKAVQAGKRVDGDAWEERDGAGLHAEAASCLVTPADIAAEQQRAADIAQSLDDLQRLMGDNTQQLQELVAVLRDYYEARLTGSAAAGGGGGAAGGGAGLAGADASSGGLLEAGSGGWDLEALQNLADRLDFARPQAGTLGSVLAALVAAER

SEQ ID NO: 14552 - protein, 341 aa, Xanthobacter autotrophicus Py2
MTAELDAIAQKMVADGKGILAADESSGTIKKRFDAIGVESTEENRRDYRELMFRSEAMTKYISGVILYEETIRQKAKDGTPLVSLIEQAGSIPGIKVDAGAKPQPAFPGETITEGLDGLAGRLKEFYDLGARFAKWRAVIDIDTAKGIPSYGSIRANAHALARYAALCQEAKIVPIVEPEVLMDGSHDIDTCYQVTEWVLKTTFEELYYQRVRLEGMVLKPNMIVPGKKAAKQASVAEVAEKTVRVLKSCVPSVVPGIAFLSGGQSDEDATAHLDAMVKLGGLPWKLTYSYGRALQAAPQKAWAGKAENVAKAQAAFTHRAHMNSLAALGQWSSEEERKAA

SEQ ID NO: 14553 - protein, 363 aa, Prochlorococcus marinus str. NATL2A
MLKAGIVGLPNVGKSTLFNALVANAQAQAANFPFCTIEPNVGSVSVPDQRLNLLGELSNSKQIIPTRMEFVDIAGLVKGASKGEGLGNKFLANIREVDAIVHVIRCFSDDDVIHVSGSVDPSRDIEIINLELALSDLNQIEKRRTRLKKQISTSKDAKLEDDVLEKLSEALENENAVRSVSLTNEEKKLIKPLGLLTEKPIIYATNLGEDELAKGNSFSEEVNTLATKEGSECVKISAQVEAELIELGEEERDDYLNGLGVEEGGLISLIKATYRLLGLSTYFTTGEKETKAWTISDGMTAPQAAGVIHTDFEKGFIRAQTISYKKLLEAGSLVEAKNKGWLRSEGKEYIVNEGDVMEFLFNV

SEQ ID NO: 14554 - protein, 338 aa, Vibrio campbellii AND4
MKAAVVSEFKGPLIIKDIPLPNIKPRDVLVKVHACGVCHTDLHACHGDWPVKPKMPLVPGHEGVGEIVEVGSEIHHLKAGDRVGIPWLYSACGHCDYCLEGQETLCLDQHNAGYSVDGGYAEFCLAHGEYVVKIPDGISYVDAAPLFCAGVTTYKALKVTDVKPGQWVAIVGAGGLGHLAIQYAAAMGMNVIAVDTGDEKLALAKSLGAQHTIDFMKEKPSERIKDITNGGVHGVVCTAVSKPAFQEAYHSVRRGGACVLVGLPPEEMPIPIFDTVLNGIKVIGSIVGTRKDLQECLQFAAEGKVKAIIEVKRLEDINDIFADMERGEINGRIVMAFT

SEQ ID NO: 14555 - protein, 333 aa, Candidatus Protochlamydia amoebophila UWE25
MNPTPPFILPTIVDGEDKSSLLTNRIRKNYRHIRKWAKRTQTNCFRIYDKEIHQYPLAIDFYDGRFCVHYFSKAANDNDYDPPKELKEATIHALKTIFNVEEELIFWRTRSKRKETRQYERQGNAKEFFSIVEFGVQFKVNLIDYLDTGLFLDHRETRKMVTQASINKKLLNLFAYTCSFSVHAAASGAIFTKSVDMSNTYTEWGKDNFRLNSLSLQNNEVIRADCLKFLDDEIKKNLQYDVIVIDPPTISRSKKMDQLFDIQVDYVSMLSKALKLLQKDGVIFFSTNFRKFVFNQTLFPFCLIQDVSHKTIPIDFHDSKIHRCWKIIKKADF

SEQ ID NO: 14556 - protein, 771 aa, Ustilago maydis 521
MSKQELLLQVTTDVICPWCFVGSRRLKAFLNSEDYKTQIAPHVRLVLKLEPYILDPRLPATSYDTPDKYYDAIETTPYDKNVPPTKKFYYGSKFGGGLDAFDAKISAAASELGMPKFDWTSEGKVGATWNAHRLVLKAGQLDEQNNSRADRDDLETALQSLQMRFMDRFYQDFHSNSKDMSDNTYLAGVAEELGLFDAQEAALTWLESDDLEYELGNKLQQAEMNGVQSIPFYIVNDGADHMSETGSHGSFLKMMQMAVAPYLSELSAERDEPDKPTRLGFAVVSNDDFSTLTFCVTRTATCGRLSGVPIAARVSLCLLAYIAPQETFTNVRYKEFAIRRGNKYLIEPLLRVGLFLVTVISSWAHCHCDYAHRLAEMTRATSVPSVYDTHCDGPGLLPVTKPWSQYYCQLRKYTSDVYATLKFPDFKHADYDCTGKTVLISGSNSGIGKQAALYFARAGATVVMACRFTATHEQNPEEARKEIVATAGVDDSKVELWEIDCSSLANIEKFGIKWRESGRTLDILVNNAGLSAGKRRITDEGFELTHVINLLSHCLLTFYLLPSLNKSAAPRIINTCSCFHAGGKLDFANMDNEKLTSLGPDCVQAYCDTKLWFLMWSVELQDRLSRSDDYRHVIVHGIHPGFVGSNIWHNPDTRIPYPLRIIFQSAISKLSINSEQGSYAIIHAALEPSLGLPKKLTSARNKLAVGESAKFGGKFINRNFVDIRRPEVDDVLARSRLWQRVLEDVAAAKRGVAADLPDHYESVKLLGQSTK

SEQ ID NO: 14557 - protein, 1856 aa, Cryptococcus gattii
MLPSNQQTAAAGPLPATPNKLSLRRRHSSSKQDTPPNLDGPLRFNPSASESARRGKPTFFSSMHFSQALPQPIPSMAPDERRPEHQRSQRKSKVEALTKIDRSGTPIQLDAGPTATSFAPHTIQKSTPPPPAPHYLRNPLHRPKVVNPLFSIDSVRTKAPRHPHPRTEPRLFGLEDCPTFYPTPEEFKDPMAYIESISQQGKKYGMCKVVPPEGWHMPFRLETETFRFKARLQRLNQLEAASRAKLNFLEQLSMYHMQQGDSKIHIPLIDRQPLDLWKLRREVNRSGGNLELDRTKGWSKITEVLGHKPSWTPHVRAAYMNIVLPFDNWAVRAKSASVSPLTKLNPGSSSSPSKPPPVFINDTFSASPIKQGQGISRANTASRRPTIKMRPNGMHFVSPPDKGRPPSKRASVSGGSVLADVIEVNQPGSLSTAPSATASTPTTLRINVPGFSDREGSDSELSDEDSVLSSPSIRKTPFEPEYQKGEVCEICKGEHDPGKILLCDGCDRGFHIYCLDPPLASVPTNEEWYCTSCLLSQGEDFGFEEGDEHSVASFQARDAAFSHAWWNRHNPHNSPRPSVNGAQPTNNDDGERMKPRQFGKVTVSEDDVEREFWRLTESSLDTVDVEYGADIHSTSHGSAGPTPETHPLDPYSRDPWNLNNMPILPDSLLRYIKSDISGMTVPWIYIGMMFSAFCWHNEDHYTYSINYMYWGETKTWYGIPGSDAEKFEAAIKSEAPDLFEQQPGLLFQLITMMNPGRLSDAGVKVVACDQRPNEFVITFPKAYHCGFNHGINMNEAVNFALPDWLPDGKDSVRRYREHNKAPVFSHNELLITITLFSETIRTALWLKDALIEMVEEESARREALRAKYPKLVENLIEEDCPEDQYQCAICKAFCYLAQVTCSCTSQVSCLSHADRLCTCGKPRKVLRMRYSEAQLEDIRDIVVHRAALPEQWRVRFFSLMESPRPQLKSMRTLVSEGERIAHPIPDLGPLKRFVDVATSLIQQIMAIMTRKSVGRRKKASRGDGNRKGKRTRAERDDEEDDGIDRSPGVLSDLLKQADRLAFDAPELPQLRQLMLAIEGFRTEASSLLTTPEDQVDRQRCKNALILGQSFGLNFPELSPLEKLVQRQEWFRQLEEEVDDANMEYDDVVAFLEESLECQIPQDHAMVKELSVRERKGKQWIESVEKLLASSQITLGGISSLIEARQHVPVSTDILRRLESLRKSAISWQTSARNALATHGSPVAASRLCKNVAAASKPLSNVVIPEIRQLQAELKHHALWKEEASKVLGVPVARLASTIDYIRSEFENSLAPDDDAHNDQRVCFCRSSPADNMVMCNVCRHSYHPRCVDVSLRHVPEEFKCAICQRLPNDDGPSLDAFIGLISPQRWNFLINPSEFEPAQYIASAAMRYAPQALRLADPFSLSHPCRDLELLRHTIRKIYTLPLVFDAYNSQTNERCVFVNWLFRRMQDAVRMKTKQISVLDRHSLTLAAGQFTSANSENGTPSGRAKPRRRARIILAESHPHEFYCLCGMSPAGENTAAQVECPKCGQGYHAVCVKVAEELAGKSVWRCPCCTVRDGRHYQKDIEVRVQLRSHRGTDQFLDYRTIINDFAERLVVVTKPTSANAITLECIDFVPAHIPDNVKTMEGGGSSLNRIKKRKSAVVDGAFRNEQAASNSVAHNLIAMTAKCSMDTPSTILGEIPTQITSSGTNGSSVAMSTLSDIQAKSDAASRSIYTSDESNANTSVLALAPTIQNRSIFDMHSNVSPRSCFSSTPVATRASTTSVIRESSVVPSATTMCGGGKEAAVIRKSIYDDNINSHRGSEGINSCPDMGESIAVEEAVTFGRHVVDEDVIMENQ

SEQ ID NO: 14558 - protein, 284 aa, Candidatus Protochlamydia amoebophila UWE25
MKKYHSLTPEENSVINFKGTEYPNTGKYNHFSEPGVYVCKKCDAPLYLSSDKFLSHCGWPSFDDEIKGSVDKKVDSDGRRIEILCHRCGGHLGHVFKGEGLTTKNLRHCVNSVSLSFLPALTKESYERALFAGGCFWGVEYLFQKLTGVIKTKVGYSGGVTIDPTYEDICSGRTKHAETLEVVYDKNKITYEALAKFFFEIHDPSQFQRQGPDIGNQYRSAIFYLTKQQEEIAQCLIQLLSTKGIPIVTEVIPASVFYPAENYHQNYYGKTGKTPYCHIYTKRF

SEQ ID NO: 14559 - protein, 338 aa, Buchnera aphidicola str. APS (Acyrthosiphon pisum)
MNNLYQRDCLRLLDFTSLELQNIITLAQKLKQYKKNNKEIQLLKKKNIALIFEKESTRTRCSFEVAAFDQGAHVTYLGPGSTHLGTKESIEDTAKILGRLYDGIQYRGHHHSTIEILAKNSKVPVWNGLTEKFHPTQLLADLLTIKEIFPERKFYEIKCAYVGDAHNNMGNSLLEAASLVGLDLRLVAPKECWPEKNIFKFCKEQMKNKKGNIICTENINEGVKNVDFIYTDVWVSMGESQEVWKKRIELLSSYQVNSLMLKITNNPQVKVLHCLPALHDQKTCTVKSILKKYGFKNGMEITDEVFQKNQKIIFEQAENRLHTIKAILVSSLLKTIKF

SEQ ID NO: 14560 - protein, 169 aa, Triticum aestivum
  misc_feature (77)..(77): Xaa can be any naturally occurring amino acid
MAAAGDAGEKKMVTLKSSDGEEFEVEEAVAMESQTIRHMIEDDCADNGIPLPNVTSKILSKVIEYCNKHVQAKPADXAAAAPDAAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 14561 - protein, 288 aa, Vibrio parahaemolyticus RIMD 2210633
MWQAISQQLSDTLLFEYQITEKVRLSGGDISESYMINDGEQRYFVKINDREFLHKFEVEAESLHLLRETSTIFVPEVVLVGKTKNNAFIILNYLPTKPLDDPENSFKFGQQLAQLHQWGEQKEFGFDTDNYLGSTLQPNQWHKKWCMFFAEQRIGWQLQLLKEKGVTLVDIDDFIDVVKQLLANHTPEPSLLHGDLWNGNVALTAFGPICFDPACYWGDRECDIAMTELFGGFQPEFYQGYESVMPLLPGYHERKDIYNLYHILNHCNLFGGHYLEQAQLTINKIISY

SEQ ID NO: 14562 - protein, 495 aa, Pseudomonas aeruginosa PAO1
MLQTLKQNWFSNLRGDLLAGLVVALALIPEAIAFSIIAGVDPKIGLYASFSMAVVIAFAGGRPGMISAATGAMALLMVNLVKDHGLQYLLAATLLCGVLQILAGYLRLGSLMRFVSRSVVTGFVNALAILIFMAQLPELTDVGWPVYAMTAAGLAIVYGFPHLPRIGRLLPSPLVCILVLTGISIYLGLDIRTVGDMGQLPDSLPLFLWPDVPLNLDTLLIVLPYSAALAVVGLLESLMTATIVDEMTDTGSDKNRECKGQGLANIATGLLGGMAGCAMIGQSVINVKSGGRSRLSTLVAGVALLLMVVFLSDWVGRIPMAALVAVMIMVSIGTFRWESIRNLKRYPLSTNLVMLVTVGVVLATHNLAFGVVAGVLLASLFFANKIGHYLDIDSERSADGTRRHYQVSGQVFFASSGRFVAAFDLKETLEHVLIDLRHAHLWDVTAVAALDKVVLGFRQRGVQVDVLGLNAASATLVDRFGAYDKPGAVDILSDH

SEQ ID NO: 14563 - protein, 181 aa, Xanthomonas campestris pv. vesicatoria str. 85-10
MTPIRSFLHHTPQLGARVYVDSACTIIGEVSLGDDVSVWPGTVIRGDVNHVQIGARTNVQDGTIIHVSHHSPFNKAGYPTVIGEDVTVGHGTILHACTIEDLCLIGMGACVLDGATVKRYGFVGAGAVVGPGKVVGEAELWLGNPARLARTLSDKEIESLHYSAQHYVRLKDQYLGASPAG

SEQ ID NO: 14564 - protein, 647 aa, Hordeum vulgare subsp. vulgare
MRVHHKNIVRFVGYCHEIRHKCVEHNGKYVLATVEDRALCFEYLEGGSLDKHLSDESCGFGWHTRYKIIKGICEGLNYLHNGSKESIFHLDLKPANILLDRNMMPKIGDFGLSRLFDSTETYSTKGIIGTPGYMPPEYINRSQITPKFDVFSLGVTIIKIMAGQEGYSKFADMSSLEFIQLVHENWEKALQTTELSQTSDGVKKCIEIASRCVEADRVKRPTIAEVVDELNKIDTTIIDELNKIDAARSSPTEQVTNLRSNQAFNPCVHSGMLGGGKDGSIKCQILPSASVKMFSYDNLRSATRKFHVDCVIGEGGFGTVYKGWIDENTLSSCKSRTGIPVAVKRLNHEGLQGHREWLAEVNYLGHLSHPNLVKLFGYCLEDKHRLLVYEFLPRGSLEEHLFGRGSCRPLAWNLRMKVALGAAKAIAYLHITETNIIVRDVKSSNILLDSDYTAKLTDFGFATNGPVGERSHVSTMVVGTYGYAAPEYIVTGHLTQKCDNYGFGVVLLEMLSGRRVIDRNRPTEERNLVDWARPYLKHKHKIRCVIDASLGGLYSFTAAQKVAALAFECLCGDPKKRPTMDSVVSVLEGVQEDEEPEAEEHQESQGAGKKVITASASRKNKSPGISSEGGGRDPKPYTRQTRTRFYP

SEQ ID NO: 14565 - protein, 513 aa, Oryza sativa Japonica Group
MVLSHGVSGSDESVHSTFASRYVRTSLPRHARSPLSRAPLAPIDSVIDWEFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 14566 - protein, 632 aa, Hordeum vulgare subsp. vulgare
MRVHHKNIVRFVGYCHEIRHKCVEHNGKYVLATVEDRALCFEYLEGGSLDKHLSDESCGFGWHTRYKIIKGICEGLNYLHNGSKESIFHLDLKPANILLDRNMMPKIGDFGLSRLFDSTETYSTKGIIGTPGYMPPEYINRSQITPKFDVFSLGVTIIKIMAGQEGYSKFADMSSQEFVQLVLENWEKALQTTVLSQTSHGVKKCIEIASRCVEADRVKRPTIAEVVDELNKIDTTIIDELNKIDAARSSPTEQVTNLRSNQAFNPCVHSGMLGGRKDGSIKCQILPLASVKVFSYDNLRSATRKFHVGCVIGEGGFGTVYKGWIDENTLSSGKSCTSIPVAVKRLNHEGVQGHREWLAEVNYLGHLSHPNLVKLFGYCLEDKHRLLVYEFLPRGSLEEHLFGRGSCQPLAWNLRTKVALGAAKAIAYLHSTEAKIIVRDVKSSNILLDSDYTAKLSDFGFATDGPVGEKSHVSTMVVGTYGYAAPEYITTGHLTQKCDTYGFGVVLLEMLSGRRVIDRNRPREEQKLVEWARPYLKHKHKIRCVIDASLGGLYSFTAVQKIAALAFECLCLDPKKRPTMDSVVSVLEGVQEDEEPEAEERQEFQVAGKKVITASASRKNKSRWNIFGGWRS

SEQ ID NO: 14567 - protein, 474 aa, Zea mays
MDSEPQESPPPEAVSRCGGLERPTPTITPRPSAFFSLTSGPLTPGLVIFSTPPVCSPPNPTPQSAMAAGSCPAPPAEAQPPPPIHHLPPDALHNVLLRLQLRDAVVCRPVSRLFHETLSPQLLALLPTLRLLLLRHPRPDGGGCLHAFDPARRTWLRLPFAHFLPYQSFSPVASSTSLLYLWVETSSSTSPLALPPSTSSASSASPVHPPKSLAVCNPFAGTYRLLPQLGSAWARHGTVLAGPAGTVLVLTELAALSYTPSGSAKWMKHPLSLPSKPRSPILASDAVFALCDVGTPWRSQWKLFSCPLAMLTGGWAPVERAAWGDVFEVLKRPRLLAGAGGRRVLMIGGLRSSFAMDAPCSTVLILRLDLATMEWEEAGRMPPNMYRCFTGLCEAASQGGAIPAAAAGGNNKVKVFGGDGKVWFAGKRVRGKLAMWEEDETGSSGKWDWVDGLPGYDDGVYRGFVFDSGFTAIP

SEQ ID NO: 14568 - protein, 393 aa, Rubrobacter xylanophilus DSM 9941
MRLAGRMRRLGTESAFAVLARARELEAQGRDIIHLEIGEPDFDTPPHIVEAGCRALREGHTHYTPAAGIPELREAIAEEVSRSRGVPVHPSQVVVTPGGKPVMFFAILVLVEPGDEVLLPNPAFPIYESMVNFVGGRPVFVPLRQENGFRFDPEEFGERLGPKTRLVILNSPANPTGGVLTPEDTRALAEILRERPDVYVLSDEIYSRLVYPEASFASIASEPGLGPDGRTIILDGFSKTYAMTGWRLGYGVMPRRLAGEFAKLQVNSSSCANAAAQRAGLAALEGPQEPVEEMVREFGARRDMIVAGLNELPGVECRTPHGAFYAFPRVTGTGRSAGELARLLLEEAGVACLSGDGFGRYGEGHLRFSYANSRENISRALERVAKTLAGAAR

SEQ ID NO: 14569 - protein, 647 aa, Hordeum vulgare subsp. vulgare
MRVHHKNIVRFVGYCHEIRHKCVEHNGKYVLATVEDRALCFEYLEGGSLDKHLSDESCGFGWHTRYKIIKGICEGLNYLHNGSKESIFHLDLKPANILLDRNMMPKIGDFGLSRLFDSTETYSTKGIIGTPGYMPPEYINRSQITPKFDVFSLGVTIIKIMAGQEGYSKFADMSSLEFIQLVHENWEKALQTTELSQTSDGVKKCIEIASRCVEADRVKRPTIAEVVDELNKIDTTIIDELNKIDAARSSPTEQVTNLRSNQAFNPCVHSGMLGGGKDGSIKCQILPSASVKMFSYDNLRSATRKFHVDCVIGEGGFGTVYKGWIDENTLSSCKSRTGIPVAVKRLNHEGLQGHREWLAEVNYLGHLSHPNLVKLFGYCLEDKHRLLVYEFLPRGSLEEHLFGRGSCRPLAWNLRMKVALGAAKAIAYLHITETNIIVRDVKSSNILLDSDYTAKLTDFGFATNGPVGERSHVSTMVVGTYGYAAPEYIVTGHLTQKCDNYGFGVVLLEMLSGRRVIDRNRPTEEQNLVDWARPYLKHKHKIRCVIDASLGGLYSFTAAQKVAALAFECLCGDPKKRPTMDSVVSVLEGVQEDEEPEAEEHQESQGAGKKVITASASRKNKSPGISSEGGGRDPKPYTRQTRTRFYP

SEQ ID NO: 14570 - protein, 402 aa, Xanthomonas axonopodis pv. citri str. 306
MAPKSNKPTAATGGNKKPTKTATSASAGKPANTPAEKAAIKTAAPVLADVRAKIDEIDRNIQALIAERANFAHQVGKAKGKLAAAVDYYRPEREAQVLRMVVDRNEGPLSDEVLVHVYREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLIGHVEDDAMKQALAELKAHSAQIKVLGSYPVAIP

SEQ ID NO: 14571 - protein, 432 aa, Rubrobacter xylanophilus DSM 9941
MADVTFDYRNLLEVEGGLTGRELEEISPRLRAAVGTLLEDPPGFMRLPRTREHLEASLEVAERVRSDGATDFVHVGIGGSALGPMVLHRALSHPFYNLLPDRGGPRLHFAENADPATLSGILDVIEPEGTWVNVVTKSGSTAETMANFLVIRGALAEALGDFGYQARTVVTTDPEKGFLKRIADREDLVTLQVPPEVGGRFSVLSPVGLLPAAVAGLDVEALLAGAARCVEELEEQGAEHPAVVGAAMHHLMDASRGRNIRVMMVYADALERLAAWFVQLWAESLGKDGKGSTPHGAVGTTDQHSQLQLYMEGPQDKVIEIVEVREHPRDVGIPGAYEDLEGVGYLSGHTVGELLNVECDATRRALTGAGRPNATIRLGSLSAENLGYLMQALEVQTAVAGALYGVNPYDQPGVEAGKRITYARMGRPGYRA

SEQ ID NO: 14572 - protein, 463 aa, Glycine max
MGEDGYSWIRRTKFSHTVCHRLDPARLGSIPISVQSEQKSRPAASKAQRHPITNKQRSLSPLPETYLSEAFREARHEQKRFSTPNPRREKRIMGKLLNKDSRETKESSSKSPSHSPNRQVKSKNRKDSAWTKLLDNGGGKITAVETAEEWNVDMSQLFFGLKFAHGAHSRLYHGVYKEEAVAVKIIMVPEDDENGALASRLEKQFIREVTLLSRLHHQNVIKFSAACRKPPVYCIITEYLAEGSLRAYLHKLEHQTVSLQKLIAFALDIARGMEYIHSQGVIHRDLKPENVLINEDNHLKIADFGIACEEASCDLLADDPGTYRWMAPEMIKRKSYGKKVDVYSFGLMIWEMLTGTIPYEDMNPIQAAFAVVNKNSRPVIPSNCPPAMRALIEQCWSLQPDKRPEFWQVVKILEQFESSLASDGTLSLVPNPCWDHKKGLLHWIQKLGPLHQNSGPVPKPKFT

SEQ ID NO: 14573 - protein, 955 aa, Pseudomonas syringae pv. tomato str. DC3000
MLELTLGQISMAQSAVDKTAALKLLADHLVADGLVAEGYLTGLMNREQQGSTFLGQGIAIPHGTPETRDLVFTTGVRLMQFPEGVDWGDGQMVYLAIGIAAKSDEHLRLLQLLTRALGEEDLGQALREAKSPEDLLKLLQGAPQELALDAQMISLGVSADDFEELVWRGARLLRKADCVSNGFAAVLQQVEALSLGDGLWWLHSEQTVKRPGLAFVTPDKPIRYLGQPLTGLFCLASLGEAHQALLERLCLLLIEGRGHELGHATNSRVVLEALGGEVPAEWPTQQIQLANAHGLHARPAKILAQLAKEFEGEVRVRVLETGESAVSAKSLSKLLSLGVRRGQTLEFIAEPSIAADALPALIAAVEQGLGEEVEPLPAASEPEAAPTPVAVAKPINAPAAGSVLSAVPASPGIAIGPAHVQVLQTFDYPQKGESVAAERERLQTAIGEVRRDIENLIQRSKSKAIREIFITHQEMLDDPELIREVEQRLNDNESAAAAWATVIEAAAVQQEQLKDALLAERAADLRDVGRRVLAQICGVETVAAPDEPYILVMDEVGPSDVARLDPAQVAGILTARGGATAHSAIVARALGIPALVGAGDEVLLLKPGTVLLLDSQRGRLTVAPDQATLQRAVEDRDAREQRLKAAAAARMEPAVTRDGHAVEVFANIGDSTGTPAAVEQGAEGVGLLRTELLFMAHSQAPDEATQEAEYRRVLTDLGGRPLVVRTLDVGGDKPLPYWPIAKEENPFLGVRGIRLTLQRPDVMESQLRALLRAADSGPLRIMFPMIGTLEEWREARAMTERLRAEIPVSDLQLGIMIEVPSAALIAPVLAREVDFFSIGTNDLTQYTMAIDRGHPTLSAQADGLHPSVLQLIDMTVRAAHANGKWVGVCGELAADPLAVPVLVGLGVDELSVSARSIGEVKACVRELTLSSAQQLAQKALTAGSAAEVRALVEAV

SEQ ID NO: 14574 - protein, 320 aa, Clostridium thermocellum ATCC 27405
MNLHGKDIKIFAGNSNRELAEEIAQKIGLPLGLATVGKFSDGETAINIDEVVRGSDVFIIQSTCPPVNDNLVELLIMIDAVKRASAGRITAVIPYFGYARQDRKAKARDPISAKLVANLITTAGADRVLTMDLHAPQLQGFFDIPLDHLLGGNILANYFLEKFGDMSDVVVVSPDVGSVSRSRKFAQRLDVPLAIIDKRRPKANVSEIMNIIGDVDNKRVILVDDLIDTGGTIVNAANALMEIGAKEVYACCTHGLLSGPAIDRIKESPIKQLVTLNTIPLDERKRIDKIVSLSVASVFAEAIERIYGDMSISSLFTQQD

SEQ ID NO: 14575 - protein, 685 aa, Pseudomonas syringae pv. syringae B728a
MYNSLCEIVHDQAFLKVTGLGADFFLKMESLNPAGSIKLKTAVGLINDLQARGLLGPDTILIESSSGNLGVALAMICAERGIPFTCVVDPNSSSHNIRMMRSYGAEVIQVEIPDANGGFLGTRIELIRQKVASDPRYVWLNQYENAANPRAHARTTARSISQHFGHVDYVFVGAGTTGTLMGCIQHFQRHHPTTRIIAVDSVGSVTFDTPASRRFIPGLGTSQRPPIFNADGIHALEMVPESHTVAMCRILARSKGLLVGGSTATVIAAVHAWRERIEPGSVVVALSPDWGERYLDTLYDDHWVEQRFGREVLSMTLADLSSPVAETSPESMEAPALSRHSSWTVWLAAERMKRAAFHVLDGEVVARLLAADPLACIDDVQAAYLDHEAGRTINPDSYFLRFAQAPANRIIALPASLSGEQPVSGIKWISSFPGNIDTGLQRASAVLILNDPLTGYAFACLEASRISAMRTAASAVLAARWMSRQQRHVGRMSFIGAGFIARTILDMFVSDGWTMDAVSVFDQHQDSALALVGHASRHGLHSEPSDLATCLQADVVVFATTAPSPYVLEPVFQPGQRVLNISLRDLGPEVIAQANNILDDVEHCLKAQTSPDLAVQQYQHRSFITGTLAQLMTGQVELSPDKASIFSPFGLGVLDLAVGQRVYRQAVAEGSALPVPQFFFESARW

SEQ ID NO: 14576 - protein, 1225 aa, Cryptococcus gattii
MSGFTPALGLHHTHSSSVLPTISNDAEPNPPTSSQPHQLAAYSHLYTTSPNYASKITNESSYSSSTTHHGFKYVRPSTSPLLKPPKGNSFSAYLGDWGSQELFTFLDIHKCGQCLAIFQKNDINGKLLLDLDVAALKSMGIDKISERVRLISGIKDLRRRVTDESVRAPFTLCSCPPERTLLPILPSHSNVLLDRWDCSSSTSCLGKREITFRPPPLDLRGHMPPRLSNHSSQSIASIDTHDVHTTNPQIGAVQQYPLDQPQSVPTNRSDSLTLRAPPSRNIGRRSPSPRHFEGCESQTDRFTTLNVASDQQVLSSTVNSLTLREDCHLQREEGLPSFLQVPHFRNTFTSSHKTLLSRRSDLARDDTTSHQPFGPAIAEQDNHIRCRIPDTITNIRETSQGDPNHPFAVKSSKSQSGMLDGVCDMVHGPMADGTKPKGKASVPLTGMSSPNIFPVNANSAALSLADLRRQLVKFINTEDDTIRTVNVMHVTSGIEILERALKKFGKWGTGMHSGPDVYSDDDVNGTLEIDGWGVYTESNPDESSKPLSESSLLQKCTFHREGTAIPDKGLFLHKKKRSQKRKNIHDFFGETPPPLMSPTLPTLFTGPHLGLVQGKSQPASESAPFSSTRLSTSANKGPNRASMISVMSGLGVPITCTLPSPQGNGLRLTGQVNSHKKKSMYNFFGHRPPSELISNHLADYFPSAKKSDVEKARHSLLRLSGGNSAYQGSWIDQGDNAPDHRSKPGSSQPPSLPPFEPSRDTLSDSLQAYASTAIHLSRPKHSTALRRRRDSDSSSRSHMSELMQTRLNRDHSDTASLLTVDEITAEVENRRTSAVLKGNCIEEAEDPPSIERDMLPKYEESKGLLHAVCSDGNSNVDDGMSYRGNSDLDPEEEEEEEEEEEEEEEGEEEEDEENEQGKAFTSTGSKRIIKWIKGALIGAGSFGSVYLGMDAQSGLLMAVKQVELSAGSAKTEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADVWSVGCLVVEMLTGTHPWADLTQMQAIFRIGSLARPAPPSDISVQADEFLRKTFEIEHTKRPTAAQLLKHPFIGSPRVRATSSNFINGAIVSEKMQVQIVKEM

SEQ ID NO: 14577 - protein, 554 aa, Pseudomonas syringae pv. tomato str. DC3000
MAYYRNPSDVTAMPAWQALTKHRQAMQDFSMREAFTDDPKRFSQFTLSSAGLFLDYSKNLITAETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFDQNMPVLLALLGVWYGNFWNAQSHAILPYDHYLRNITKHLQQLDMESNGKSVRQDGTPALTDTGPVIWGGVGANGQHAYHQLLHQGTQMIPADFIVPIVSFNPVADHHQWLYANCLSQSQALMMGKTRAEAEAELRDKGMSEEEVQKLAPHKVIPGNRPSNTLVVERISPRRLGALVAMYEHKVFVQSVIWGTNAFDQWGVELGKEMGKAVYQRLTGGTEEPADDASTQGLINYFRGRHRG

SEQ ID NO: 14578 - protein, 347 aa, Zea mays
MATAKLSSPATSLLAGGRARRSAPARRATVIRAAAGSYSDELVSTAKSVASPGRGILAIDESNATCGKRLSSIGLDNTEPNRQAYRQLLLTTAGLGEYISGAILFEETLYQSTTDGRKFVDCLKDQNIMPGIKVDKGLVPLPGSNNESWCQGLDGLASRRTVVSIPCGPSALAAKEAAWGLARYAAIAQDNGLVPIVEPEILLDGDHGIERTLEVAEKVWSEVFFYLAQNNVLFEGILLKPSMVTPGADHKEKASPEAIAKYTLTMLRRRVPPAVPGIMEPDDDVTDGEAQSSLGIFLTPRSLYDKLRLSKMMINDHYMPIYRRNIEQLIAELEKDSLDQIGCVRCS

SEQ ID NO: 14579 - protein, 645 aa, Cryptococcus gattii
MAFSPSLTPSRPAPVPPRRAAGTAPHTIGVTDTAAAPQSNFSSTSYSPSFSYTNPSIQSTKIADTTRSRTIRSGAASIKEEGLRAFMWSKRWLVLGSAELRIYKNESSSSPVYTVSLEDIQDVQRVDLKPYCVEIETSDKLLYFAFRSDNEVYGWMDDINSRTPRLGVSQPTNFVHQVHVGCDPKSGGFTGLPPQWSKLLTSSAITEEEAARNPEAVLDVLQFYTQQQASDVLEGYQKFPLPSVSNQFLTTGAAATRFEGVGLGGQQQQQQQQRLRSAPFTATGSLATTVASGQRSFNTETKTLAQKEKEIVLNPQRQLLDSVTRPPIGKNDKEMIMRSPGPTVEKRISTMNEVQIMEKLRSVVSAKDPSQLYSKIRKVGQGASGMVFVAKTLSNGKKVAIKQMDLSQQPRKELIVNEIIVMRESQHPNVVNFLDAFLVRGSELWVVMEYMEGGALTDVIENNKLEENQIAAICLETCRGLQHLHSRSIIHRDIKSDNLLMNTQGEVKITDFGFCAKLTDQKSKRATMVGTPYWMAPEVVKQKEYGAKVDIWSLGIMAIEMIENEPPYLDEEPLKALYLITTNGTPTLKSPEKLSQDLKHFLSVCLCVDVAFRATSTELLKHEFLQLACSVQDLAPLLRFKQDTL

SEQ ID NO: 14580 - protein, 705 aa, Candida glabrata CBS 138
MSSTLVINGKAPVVAYAELIAARLVNDSKSDASVTVEFVDDKKSAAATFDGKSDNALEAIVAKFPEILGANEESKPWIKLAAEELVIKNFQKLAQSLEKLDAQLNFRTYINGGLKFDSADIACWGALRSNGMVGSIIKNKVYVNVSRWYLLLESNPSFGQSHEFLTKSLQELKKAANAGKKKESHKANFEIDLPDAKIGEVVTRFPPEPSGYLHIGHAKAALLNQYFAQAYKGKLIIRFDDTNPSKEKTEFQDSILEDLELLGIKGDRITYSSDYFQEMYELCVKLIKEGKAYCDDTPTEKMREERMDGIASARRERSVEENLKIFTEDMKNGTEEGLKNCVRAKIDYAALNKTLRDPVIYRCNLTPHHRTGSEWKMYPTYDFCVPIVDSIEGVTHALRTIEYRDRNAQYDWFLDNLNLRKVHIWDFARVNFVRTLLSKRKLQWMVDKNLVSNWDDPRFPTVRGVRRRGMTVEGLRNFVLSQGPSRNVINLEWNLIWAFNKKVIDPVAPRHTAIVNPVKIHIEGAPESPKTEMKPKHKKNPAVGEKKVIYYQNVVIDKEDADSIEDNEEVTLMDWGNIIITKKNADGSMEAKLHLEGDFKKTKHKLTWLADTDDSVKVDLVDFDHLISKDKLEEDESFEDFLTPQTEFHTEAIADLNVKDMIVGDIIQFERKGYYRLDAEAKDGKPYVFFTIPDGKSVNKYGAKK

SEQ ID NO: 14581 - protein, 576 aa, Thanatephorus cucumeris
MARTTFLVSVSLFVSAVLARTVEYGLKISDGEIAPDGVKRNATLVNGGYPGPLIFANKGDTLKVKVQNKLTNPEMYRTTSIHWHGLLQHRNADDDGPSFVTQCPIVPRESYTYTIPLDDQTGTYWYHSHLSSQYVDGLRGPLVIYDPKDPHRRLYDVDDEKTVLIIGDWYHESSKAILASGNITRQRPVSATINGKGRFDPDNTPANPDTLYTLKVKRGKRYRLRVINSSEIASFRFSVEGHKVTVIAADGVSTKPYQVDAFDILAGQRIDCVVEANQEPDTYWINAPLTNVPNKTAQALLVYEEDRRPYHPPKGPYRKWSVSEAIIKYWNHKHKHGRGLLSGHGGLKARMIEGSHHLHSRSVVKRQNETTTVVMDESKLVPLEYPGAACGSKPADLVLDLTFGLNFATGHWMINGIPYESPKIPTLLKILTDEDGVTESDFTKEEHTVILPKNKCIEFNIKGNSGIPITHPVHLHGHTWDVVQFGNNPPNYVNPPRRDVVGSTDAGVRIQFKTDNPGPWFLHCHIDWHLEEGFAMVFAEAPEAVKGGPKSVAVDSQWEGLCGKYDNWLKSNPGQL

SEQ ID NO: 14582 - protein, 493 aa, Xanthomonas campestris pv. vesicatoria str. 85-10
MNALTSATAAATDSPAWHGCIFNGDWVPGRGGSVPIHEPATGALLHEVGKADLADVAAAIAQAKQAQRAWAATPPRERAAVFHRAAQAMQARSAEATLLIARETGGILPKAQREVDESVVFYQQAAAMPLQASGQMLPTASGQLSLARRLPLGVIGVISPFNFPLILSLRSVAPALAMGNAVILKPDPRTPYTGGVIIAQVLEEAGLPKGLLHVLHGDAQIGQALVESPDVPMIAFTGSTAAGRRIGEIAGRHLKKVSLELGGNNAVIVLDDADLDKAASAVAFGAYMHQGQICMATGRVLVHRSVAQALTQRLAEKARHLPVGDPVSGIVALGPIIDQRQLQRVVDIVNDSVAAGAVVEAGATHEGLFYAPTVLSNVRPGMRAFDEEVFGPVINITVFDTGDDAAELANQGEYGLAAGILSASVSRALALGEKLHTGLLHINDQTVADEVVNPFGGAGASGNGTSVGGPADWEQYTHWQWLTIKSEVPQYPF

SEQ ID NO: 14583 - protein, 325 aa, Vitis vinifera
MARSSIDETSESGAFTRTPSAFRSVISRDPNAPFPAESGRYHLYISYACPWACRCLSYLKIKGLDNVIAFTAVKSKWERTKDGDEHMGWAFPASETEEPGAEPDPLYGARSIRQLYELASANYTGKYSVPVLWDKKLKTIVNNESSEIIRMLNSEFNDMAENAALDLYPPHLQPQIDEINEWIYDRINNGVYKCGFAKKQGPYNEAVGKLYEALDRCEDILSKQRYICGNLLSEADIRLFVTLIRFDEVYAVHFKCNKKLIREYPNLLNYSKDIFQIPGMSSTVNMDHIKRNYYGSHPSIDPLGIIPIGSHLNYSSPHDRAKFSI

SEQ ID NO: 14584 - protein, 367 aa, Coxiella burnetii
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFGTV

SEQ ID NO: 14585 - protein, 372 aa, Hordeum vulgare subsp. vulgare
MGNCAGVQGNAEINPTFSAPNTSGNNSKSSSSNATDTSTFGKSSSSSVPPTPRSEKEILQSSNLRKFTFSELKSCTRNFRTDSLLGEGGFGSVFKGWIDERTFTPVKPGTGMIVAVKKLKLDSFQGHKEWLAEVNYLGQLSHPNLVKVIGYCLEDEQRLLVYEFMPRGSLEHHLFRRAPHFQPLSWNLRMKVALEAARGLAFLHSDEAKVIYRDFKTSNVLLDSEYNAKLSDFGLAKDGPSGDKSHVSTRVMGTQGYAAPEYLATGHLTTKSDVYTYGVVLLELLTGQRALDKNRPPGQHNLVEWARPYINSKRRVIHVLDPRLGSQYSLPAAQKAAALAMQCLSMDARCRPDMDQVVTVLQKLPEVKKTSK

SEQ ID NO: 14586 - protein, 594 aa, Novosphingobium aromaticivorans DSM 12444
MDKNLLLDRRRLLVGSGALALAPLFPAWAQSGNLAGHGGHSRGSGPMAGRNSGGTLSGDTIALNIGEARYSVGRRSASAVAVNGTIPAPLIRLREGQTVRIAVTNHLKEQSSIHWHGLLVPFQMDGVPGLSFPGIDPGETFTYQFPILHSGTFWYHSHSGMQEAVGLYGPIVIDPALPDAAAPFDREYVLMLADWSPVDPHAQLRKLKTMGGYYNWQRQTVGGLIAGKDQSLKDRLEWAKMRMDATDISDVTGATYSFLVNGHDTEANWTALFRPGERVKLRIINASAMTNFNFRIPGLPMTVVAADGCNVAPVETDEIQIAIAETYDVIVQPGEAAPFGIIAEAIDRSGLVRATLAPQAGMVGPVPKLRQRPILTMRDMGMDMSGMDMGAGGEIDLSKPANESMDGHSMSMRDFSAAPGVKKGPGVATISPMPADRLADRGTGLENEDHRVLTYADLRSRDPNPDPRKPTRQIDVNLTANMERYMWSIDGETISDGAAPIPFRKGERVRVNLINHTMMPHPIHLHGHFFELVTGEAGNRPRKHTVNVLPGGKASFDLTADAEGDWAFHCHMLLHMHSGMMRVVTVRADKGDAA

SEQ ID NO: 14587 - protein, 239 aa, Vitis vinifera
MGWVFPASDTEEPGAGPDPLNGTRSIRELYELASTNYSGKYTVPVLWDKKLKTIVNNESSEIIRMFNTEFNDIAENPSLDLYPPHLQAQIDKINDWIYSGINNGVYKCGFAKKQEPYDEAVKNLYEALDKCEEILSKQRFLCGNTLTESDIRLFVTLIRFDEVYAVHFKCNKKLLREYPNLFNYTKEIFQIPGMSSTVHVEHIKKHYYGSHPSINPFGIIPQGPDVDYSAPHDRERFSS

SEQ ID NO: 14588 - protein, 466 aa, Novosphingobium aromaticivorans DSM 12444
MNALSPTLTNRSLVDIDRDHLIHSVTSFRGHEQHGAIVLESGDGMWLTDAEGNRILDAFAGLWCVNVGYGQESIVEAAAAQMRKLPYATGYFHFASEPAIRLAGELTAAAPSGLDHVFFTQGGSDAVDSAIRYIVHYWNAAGKPSKKHFIALEWGYHGSSSLGAGLTALGNFHRNFDLPRPWQHHIASPYPYRHPQGDDDAAVIASTVAALEAKVAELGADNVAAFCCEPIQGSGGVIVPPRGWLKALREACTRLGILMLVDEVITGFGRTGPLFACEEEGVSPDFMTTAKGLTAGYIPMGAMFMADHVYQTIADAAPAALPIGHGQTYSGHPVAAAVGLEVLRLYREGGLLENGRKTGERFAWHMERIRAHPLVGDVRYRGLLGAIELTPDKATKAIFDASLDIGGRLSKLTYANGVIVRCFGNAVLGFAPALCCTLEEMDMIFERVERSLDQLLDQPDIRALVV

SEQ ID NO: 14589 - protein, 359 aa, Novosphingobium aromaticivorans DSM 12444
MSSNTRSYSIAVIPGDGIGKEVMPEGMRVLEKAASIFGFEIEQKWHDFACCDYYARHGKMMPDNWKEEIGRPDAIFFGAVGWPDTVPDHVSLWGSLLQFRREYDQYVNLRPVRLMPGVPCPLAGREPGDIDFWVVRENTEGEYSSVGGIMFPNTDREVVIQETVMTRIGVDRVLRYAFDLAQKRERKHLTSATKSNGIAITMPYWDQRVEAIGAEYPDVSHDKYHIDILTAQFVLNPDRFDVVVGSNLFGDILSDLGPACTGTIGVAPSGNINPEGIHPSLFEPVHGSAPDIAGQGIANPVGQIWSAAMMLEHLGEAEAAAAIMRAVEQVLATPSARTRDLKGAASTDACGKAIAEALG

SEQ ID NO: 14590 - protein, 533 aa, Pleurotus sp. 'Florida'
MAVAFVALVSLALALVRVEASIGPRGTLNIANKVIQPDGFYRSTVLAGGSYPGPLIKGKTGDRFQINVVNKLADTSMPVDTSIHWHGLFVKGHNWADGPAMVTQCPIVPGHSFLYDFEVPDQAGTFWYHSHLGTQYCDGLRGPLVVYSKNDPHKRLYDVDDESTVLTVGDWYHAPSLSLTGVPHPDSTLFNGLGRSLNGPASPLYVMNVVKGKRYRIRLINTSCDSNYQFSIDGHTFTVIEADGENTQPLQVDQVQIFAGQRYSLVLNANQAVGNYWIRANPNSGDPGFENQMNSAILRYKGARSIDPTTPEQNATNPLHEYNLRPLIKKPAPGKPFPGGADHNINLNFAFDPATALFTANNHTFVPPTVPVLLQILSGTRDAHDLAPAGSIYDIKLGDVVEITMPALVFAGPHPIHLHGHTFAVVRSAGSSTYNYENPVRRDVVSIGDDPTDNVTIRFVADNAGPWFLHCHIDWHLDLGFAVVFAEGVNQTAAANPVPEAWNNLCPIYNSSNPSKLLMGTNAIGRLPAPLKA

SEQ ID NO: 14591 - protein, 791 aa, Oryza sativa Japonica Group
MLAAIATRVRGFCEKTYTKEGIDKSQPLDLASRFGLTLVFLGVSAPPSPISRPPASAAAGDCSRSPSLLPFRLLVRIPDARCSLFWAAADRSPSMAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASFNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQTVVPERVLKMEEAIKSRNFESFARLTCADSNQFHAVCLDTSPPIFYMNDTSHRIISLVEKWNQSEGTPQVAYTFDAGPNAVLIAPNRKNATILLQKLLYYFPPQDNDLSRIYLTNKMMQLYGWRQVDSKRCWTEIDRRCGGPPSSCRDEDAEPKIQGRCHRRRRRSNSLIPRTSNASPSRAWRCSSCRSRTGRSAWPWRGATRYRSLSSKDDSAARRPLSSSLSKDDGAARWTCRAAVDLARVVESAAPEEMPPPLTVDEEVRLECFAKSSGAVLFRLYHGCLFELSLATMEVRFIGYYSLPAGEEARRAPPCREVAPSRRCCARRPWMRARRRAATSTAAGSHCRVRRTGQLLTHHAVSGHGGLARPRIEHDDKLLPLHAFVGFASMFLRRRRRRFHVVSVHGFEMDSIHLATMVWVGLVSNILRVGLIWMLEMRKWSGLVWWSGCRGGGLGWMRPGF

SEQ ID NO: 14592 - protein, 485 aa, Novosphingobium aromaticivorans DSM 12444
MALQLNDPSLLRQAALIDGAWISGDLPKVEVLDPASGEVVGVVPDCGVAETEAAIAAAEASWAGWRRRTANERAALLEAWHALVLANLDDLARIMTAEQGKPLAESQGEIRYAATFIKWFAEEGRRVGGRNIPSPERDRRIIVMTEPVGVSAAITPWNFPAAMITRKCAPALAAGCPVVIKPSEMTPFTALALVELALRAGFPKGTINLVTGMPQAIGAAITASPVVRKLSFTGSTRVGALLMRQSADTIKRLSLELGGNAPLIVFDDADLDLAVKAAMASKFRNAGQTCVCANRILVHAPVYEEFASRLGAAVSALNSAPGMEAASTVGPLINAAAVEKVSAHVEDALAKGGKVLFSGKGREGGNFLRPLVIGNASSDMRLASEETFGPVAPLFRFETEDEAIALANDTPYGLASYFYTSGLDRAFRVAEALEAGMIALNTGSIAMEMAPFGGIKQSGLGREGGLAGIEEYLETKAFHIGGLKI

SEQ ID NO: 14593 - protein, 336 aa, Vibrio angustum S14
MEVLVTGGMGYIGSHTCVQMLQAGITPVIIDNLSNAKIGVLTRIEALTGEMPVFHQGSVQDEAFLDSVFAKHDIKAVIHFAGLKAVGESVEKPLEYYYNNVNGSLVLARAMRKAGVKSIVFSSSATVYGDPKMVPITEDSPTGATTNPYGRSKYMVEECFKDLFHAENDWSITLLRYFNPVGAHPSGTMGEDPQGIPNNLMPFIAQVAIGRRDRLSIFGNDYPTPDGTGVRDYIHVMDLADGHIAALNVLREKAGLHIYNLGTGKGSSVLEMVDAFAKACGNQVPYVICPRRAGDIAECWASTDKAERDLNWKATRSVKEMTVDTWNWQSNNPNGY

SEQ ID NO: 14594 - protein, 256 aa, Bordetella parapertussis 12822
MGAMGDMAAQRRGAYERYRMTEVDSMPHRLAAIQARIKAACERSARPPESVALLPVSKTFPVEAIRHAAALGLRRFGENKTQEIRHKAPELADLDLQWVMIGHLQTNKAKDVARDVAEVQSLDRLELADALQRRLEMEARSLDVLVQVKTSPELSKYGLAPELLPGFLRTLVSDFPALRVQGLMTMAVNDEDPQAVRACFRLLRELRDRARDSVPGVALDRLSMGMSGDFEIAIEEGSTEIRIGSALFGARPASAP

SEQ ID NO: 14595 - protein, 550 aa, Ustilago maydis 521
MASTQGSDPVPLVHSLDSIYSHAGVLKNGRRWNDLALKFAQAFSGAKADFIARAPGRVNLIGEHIDYVGFSVFPAAIEKDILMATKVTLSSVSAPASETVEVVLKNTTARFAETCFSFRYDSVDKVELLNSGDERWANYFKVALKGLHSHLPSWVLGASNSNRPVKIQVLVDGTIPPESSLSSSAAMTTCSSIVVLEAFAARLLIDRKEMAEVAIQSERLVGVNSGGMDQSASIFSIPNHALYISFYPELRVRPTKLPQSTPDHTFVIVNTLVVSDKKVTGPVNYNLRVVETRMAARALAKSLGLESAKGAGCRDLRGVLESFFSENGRDSQLQIEMENSTAVQETLEKSGEEAARIRVLEEKVEALYTSSALRAGLGREKVEELTGYTGEEFDKEFLSSFPIRAERFELYKRSKHVFTEALRVLQFQALCKQNPASSEDDGKIVYKQLGALMDGSQTSLRELYNCSCDELNQVIDIAKRNGSLGSRLTGAGWGGCTVHLVPKPKVEVFISAMRTQYYKKRFPGLSEQELQDACFDTQPAGGACVYKVQA

SEQ ID NO: 14596 - protein, 389 aa, Photobacterium profundum SS9
MLSECCHNYRDSKLSLLYTSAVDYFCSTDMTLKVAINGFGRIGRSVLRALYESGKHHHINVVAVNELAEPEAMAHLLQYDSSHGRFFKPVSHDQEHLFIAHENGERDDIRILHQSDITLLPWHDLDVDIVLDCTGVYGSREDGLAHIKAGAKKVLFSHPAANDIDNTIIYGVNHKTLTSEHRIVSNGSCTTNCIVPVIKIIDDAFGIESGTITTIHSAMNDQQVIDGYHSDLRRTRAASQSIIPVDTKLHLGIGRIFPKFVDKFEAISVRVPTINVTAMDLSVTVKTNVKVNDVNQALSEVSRCTLEGIVDYTEAPLVSIDFNHDPHSAIVDGTQTRVSNKHLIKLLVWCDNEWGFANRMLDTALAMHASDAAQHSNKELRSKIAIKNS

SEQ ID NO: 14597 - protein, 240 aa, Nocardioides sp. JS614
MRHQNTAEQKSSATDLVSEADRTAEALIRDVLRRARPADSIVGEELAPRDGSSSVTWVVDPLDGTSNYLRGYPGWSVSVAAEHEGKTAVGVVYDPTHGLLYSAALRGATVNGRPIRVSATTNLASSLIGIGFSYDAADRARQGAALARALADIGDVRRGGSAALELCHVAAGALDGFVEDDLQPWDWAAGAHLVEQAGGLTAPLRRVSTHGVIAANSALWEPLHHAFGLGLSTGRTPSRS

SEQ ID NO: 14598 - protein, 1047 aa, Bacillus pumilus SAFR-032
MQQTSIIPKPKTYGPFKNIPHIKKGELSQTFWRLADELGPIFQFEFSKATSIFVSSHELAKEVFDESRFDKFIGSSLNKVRTFSGDGLFTSWTEEPNWRKAHHILMPAFSQQAMKGYHEMMLDIATQLVQKWQRTGRDEEIEVAEDMTKLTLDTIGLCGFDFRFNSFYKENQHPFIESMLNGLNEAMEQASRLPVADKLMIKRRKKFEENVDFMKTLVDDIIQERRKQDKTGNDLLSLMLHAKDPETGERLSDENIRYQIITFLIAGHETTSGLLSFAIYFLLKNPEKLKKAVQEADDVLQGELPTFKQVQKLTYTRMVLNEALRLWPTAPTFSLYAKEDTIIGGKYSIKKNQSVSVLLPKLHRDQAVWGGDAEEFKPERFLHPEKIPQHAYKPFGNGQRACIGMQFALHEATMVLAMVLHNMELIDHTSYELNLKESLTIKPNDFKIKVRPRKQQLFMAPPKEETKKSTTIEESKVKSHGTPLLVLYGSNLGTAQQIANELAEDGKAKGFDMTTAPLDDYARQLPDKGAVLIVTASYNGHPPDHAKTFVDWVTQDKEKDLTNVTFAVFGCGDRNWASTYQRIPRLIDEALESKGAKRVADLGEGDAGGDMDEDKETFQKIVFEQLAKEFQLTFQEKGKETPKLSVAYTNELVERPVAKTYGAFSAVVLKNEELQSQKSERKTRHIELRLPEGKKYKEGDHIGIVPKNRDVLVQRVIDRFNLDPKQHIKLSSEKEANHLPLGQPIQIRELLASHVELQEPATRTQLRELASYTVCPPHRVELEQMAGEAYQEAILKKRVTMLDLLDQYEACEMPFAHFLALLPGLKPRYYSISSSPKIDEKRVSITVAVVKGKAWSGRGEYAGVASNYLCDLQKGEEVACFLHEAQAGFQLPPSSETPMIMIGPGTGIAPFRGFVQAREVWQKEGKRLGEAHLYFGCRHPHEDDLYFEEMQLAAQKGVVHIRRAYSRHKDQKVYVQHLLKEDGGMLIKLLDEGAYLYVCGDGKVMAPDVESTLIDLYQHEKQCSKEDAENWLTTLANNNRYVKDVWS

SEQ ID NO: 14599 - protein, 334 aa, Synechococcus sp. WH 7805
MAIRIGINGFGRIGRLAFRQAMTCPDVEVVGINDLIEVDYLAYLLRYDSTHRQFQGDIRVEDGALVVNDQPIRITAERDPSQLRWGEIGADYVLESTGFFLTAPLAQAHLDAGARRVVMSAPSKDDTPMFVMGVNHTSYAGQAIVSNASCTTNCLAPLAKVVHDNFGIVSGLMTTVHATTATQKPVDSPSLKDWRGGRGAGQSIIPSSTGAAKAVGRVIPELNGKLTGMAFRVPTPDVSVVDLTVNLDRPTSYENLKQTIKQASQNGLSGILGYTEDPIVSNDLLGESCTSVFDAGAGMALNDRFMKLVAWYDNEWAYSCKCIDLMRHMATHQS

SEQ ID NO: 14600 - protein, 415 aa, Ustilago maydis 521
MQFHSSQAKRRIRVYIDQSRRITHNCPCPVVSCAVRRVEAAVAVHKTAFNGKFARLFCFPSHSTPLPAEDCRTKMITRGASSLLRATAPASASRSPLLARSLVSSVVTRQPNSTEKRQNPSKPVESDSTSALDYKLAHKLRKLPPLPSLEPPSLDAPSAVSNILYNTPPPSKAPFKRHTLNCLVQNEPGVLSRVAGTLAARGFNIDSLVVCGTEIRDLSRMCIVLRGQDGVIEQARRQLEDLVPVWAVLDYTNTKVIERELMLVKVSILGPEYFEESQQASASSPASTPEVVAERETDSASKSSSTSASQPMTPLTPTEALRVKSDNMRSVIALAEQFRGRVVDVSATSVIVELSGKSSRCDAFLKLVRPFGILECARSGTMVLPRSPIPSSYAGADDLTEDQVDVVDAGALPPG

SEQ ID NO: 14601 - protein, 191 aa, Pyrococcus horikoshii OT3
MVDTSNVKLRIENIVASVDLFAQLDLEKVLDICPNSKYNPEEFPGIICRFDDPKVALLIFSSGKLVVTGAKSIQDIERAVAKLIQKLKGIGVKFKRAPLIDVQNMVFSGDIGREFNLDNVALTLPNCEYEPEQFPGVIYRVKEPRAVILLFSSGKIVCSGAKSEADAWEAVRKLLRELEKYGLIEEEEEEL

SEQ ID NO: 14602 - protein, 581 aa, Candida albicans SC5314
MKTCYYELLEVSSTATDTELKKAYRKKALLLHPDKNPDNVEEANHKFSLVRAAYEVLSDPQERAWYDNHKQSILNDEDEIIEGESYLPSISTEEIYRFFNPSMYTEINDSISGFYQVVTRIFARLAHEEIQHGKYSKIPGYEKYHDDDDKNINAIDPSLLKYPRFGNSQSSYIDQIRPFYNVWGSFQTCKTFNWKDEYRYSVAPDRRTRRMMERENKKLRDEARKEYNETIKKFVNFIKKRDPRVKSGQEELNKLNKRKQLQEYENQIRQQQQLNKLKNNNNGGDAKFTEQDWQKLTPEELQELEQMLQEEYEEEEADSTDSEFGHDDNENLEVHEFECIVCDKIFKNEQQFQIHEDSKKHKKNVRQLQWEMKQEGIELGIDKHDGDDLSEFETASSEFHDDDDDDDDTDVSEELEEEVLEDQDNELKTDEDNLVEKSTDNIDLDNLEVDDEIDEDIVVNTTTTPKKESKPTLNKVEEDLAHLLGQTSLSTKGIDESDDDWSDNKRKPKKGKKTKKKSQTNSKESTPNTENKPIINNIEKCSVCGTTFESRNQLFNHVKSEGHAAPPPKSKSKSKKKNKRK

SEQ ID NO: 14603 - protein, 356 aa, Brassica napus
MELDLSPRLPKKVYGGDGGSYFAWCPEELPMLRDGNIGAAKLALEKYGLALPRYSDSSKVAYVLQGSGTAGIVLPEKEEKVIEIKKGDSIALPFGVVTWWFNSADTELVILFLGETHKGHKAGQFTDFYLTGSNGIFTGFSTEFVGRAWDLDETTVKKLVGSQTGNGIVKVDASLKMPSPRKGDREGFVLNCLEAPLDVDIKDGGRVVVLNTKNLPLVGEVGFGADLVRIDGHSMCSPGFSCDSALQVTYIVGGSGRVQVVGADGKRVLETHVKAGALFIVPRFFVVSKIADSDGLSWFSIVTTPDPIFTLLAGKTSAWKALSPEVLQAAFKVAPEVEKAFRSKRTSDAIFFPPPN

SEQ ID NO: 14604 - protein, 504 aa, Xanthomonas campestris pv. vesicatoria str. 85-10
MGEMYDLLVIGGGINGVGIARDAAGRGLSVCLCEQDDLAAHTSSASTKLIHGGLRYLEQYEFALVGKALAEREVLLRLAPHIIWPLRFLLPHQPHLRPAWMIRAGLFLYDHLGGSKRSLPRSRRLSLRTHPVGAPLQESLRTGFVYSDAWVQDARLVVLNAMDAARRGAKIHTRTRCVGAWHDAGFWYAELEDREGRRRTVQARALANAAGPWAVAFLDTVASVPHEHALRLVKGSHIVVPKLFDHDHAYIFQQPDRRIVFAIPYEHDFTLIGTTDVDYEADPAAPKIDAAEVQYLCDAVNLYFQQQISPADVVWNYSGVRPLLDDAEDNAAEVTRDYQLEVVTEGAPLLNVFGGKLTTYRKLAEEAVDRLTHALGARKPAWTARGEALPGGEQRDIASLLERVGRGRPWLPAATAQRLVRNYGTCAEQLLGDAQSLADLGTHFGADLYQAEVDYLRQHEWAVAADDILWRRSKLGLRIDAAGRQRLEDYLQTQSIRQRDAVSA

SEQ ID NO: 14605 - protein, 340 aa, Glycine max
STSSRGGSRPDPVTLIPGDGIGPMVTGAVEQVMEAMHAPVYFEKFEVHGNMKAVPPEVLDSIRKNKVCLKGGLVTPMGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIKYNEIIVDNCCMQLVSKPEQFDVMVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 14606 - protein, 385 aa, Buchnera aphidicola str. APS (Acyrthosiphon pisum)
MPANNSLLIFRDEINNIDKKIVKLLAERKNLVFKIAQSKIENNQAIRDIEREKKMLQKLIFLGKKYNLKSEYITQLFQLIIEESVATQKKLLKKFCNHNKLIPANFSFLGPKGSYSHIAAYKYADLNFQKCITNECSTFEEVVLSVENNQSDYAVLPIENTCSGSINEVFDILKKTNLFIIGEINIFINHNLLTLKKIELNKIKTIYSHPQPFQQCSDFIKKFPEWKIKYTKSTADAMKKIKKYNDVTNAALGSEIGSKIYGLEILMKNLANKENNITRFILLNRNPKKISKNIPTTTTLIFTTGQEAGSLSKVLSILQEKKLIMKKLTSQKIYKNPWEEMFYIDIQVNLSSTLMQDALEKIKKITRFIKILGCYPSEKITPIAP

SEQ ID NO: 14607 - protein, 484 aa, Desulfovibrio desulfuricans G20
MTAAHDFPAYRGQMEYFCLGCGSRYNVDELHYTCPDCGGVFLLDNTDFDALSARSGKEWQDIFDARAATRTTPLRGIFRFYELMAPLLEPEDIIYLGEGNTPVIEASPAMSDMAGIPFAFKNDGQNPSASFKDRGMACAFSFLKSLVRKHGWDEVLTVCASTGDTSAAAALYASYVGAPLKSVVLLPHGKVTPQQLSQPLGSGATVLEVPGVFDDCMKVVEHLAENYRVALLNSKNSWRILGQESYAFEVAQWYGWDMQNKCIFVPIGNAGNITAVMSGFLKLHRLGIISCLPRVFGVQSHHADPVYRYYSVQDPASRVFTPVTVQPSVAQAAMIGNPVSFPRVRHFAGQFEAIGGQGAFQVVQVTEQAIMDAMIIANRHGHIACTQGGECLAGLMRARELGIIAPHETAVLDATAHALKFSGFQDMYFSGTLPAEYGVTPDAGLSNAPELLMDEAARNALAPEEFTLAAARAVAGRLGLAPKS

SEQ ID NO: 14608 - protein, 342 aa, Neptuniibacter caesariensis
MTVLKKVAVLGGGSFGTVIANLIAENGYDVQLWMRDQQRADQLNYEHENKRYLPGYSLSEKVVATSDLQSVVQDAELVFVSIPSQSFRDVIKQAKPFINEGQMFVSTTKGIEAKTFSLMSEILSEELPGAQVGVLSGPNLAKEVVAKQLTATVVASESQLLRSSVQTILHSSYFRVYASSDTYGVELGGTLKNIYAIAAGLSAALGMGENTRAMLMTRSLAEMSRFAVCMGANPMTFIGLAGVGDLIVTCMSPLSRNYRVGHALGEGKTLEEAVEALGQVAEGVNTIKQVKEKASEMQVYMPLVTGLYEVVFNHAPVAEVVKMLMMNEQSTDVEFVLPRGDI

SEQ ID NO: 14609 - protein, 298 aa, Erwinia carotovora subsp. atroseptica SCRI1043
MPIVRRFKQVDVFTQQPFKGNPLAVIMEANGLTDEQMQDIARWTNLSETTFVLPATDPLADYHVRIFTPESEMPFAGHPTLGTAHALLEEGLRPKSSGQLIQQCGIGLVPINIGDDESLAFHAPQATIVPFGDEHMPLLEKTLGITNLGANRIDKRYPPAAVHMGIRWLVVRVDSADTCLNITPDAEALAAVENLSQTNGIAIYGPHEGATPADYEVRTFYIERGHLKEDPVTGSANACLAALLRQHHSMNNIDAPLSYLVRQGTMLQRDGRITVTYLNDEPWIGGHSVTIVDGTLQR

SEQ ID NO: 14610 - protein, 469 aa, Oryza sativa Indica Group
MGGCFSLEEHRLQGKTEAGGPDGLRKCKSDSKATASVLAPPKDVEDLQIEGYGNVNIFTYNELRAATKNFRPDQILGEGGFGVVYKGVIDENVRAGFPSTQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVAGLAYRCLSQNPKGRPTMSQVVETFEAVQNMPECQDILLQNCMTGAVTLYEVAKDPTESVEPEKIKQEQPAAKTVTVAPALVNGKPVPQSRRTRPGNGRSKSEPSLECKLYIPSPDSDGQQPGLEALSSPSRDGSIKDPPDEDLYKI

SEQ ID NO: 14611 - protein, 429 aa, Salmonella enterica subsp. arizonae serovar 62:z4,z23:--
MKALNREVIDYFKEHVNPGFLEYRKSVTAGGDYGAVEWQAGSLNTLVNTQGQEFIDCLGGFGIFNVGHRNPVVVSAVQNQLAKQPLHSQELLDPLRAILAKTLAALTPGKLKYSFFCNSGTESVEAALKLAKAYQSPRGKFTFIATSGAFHGKSLGALSATAKSTFRKPFMPLLPGFRHVTFGNINAMRMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPDLVHDARGKGMLMAIEFVDNETGYRFASEMFRQRVLVAGTLNNAKTIRIEPPLTLTIELCEQVLKSARNALAAMQVSVEEV

SEQ ID NO: 14612 - protein, 516 aa, Bradyrhizobium sp. ORS278
MADYDLAIIGGGLNGVSLARDAAGRGLRVLLVEQGDLGGAASSATSRLVHGDLAALERRSLLRVRRSLAERDVWLTIAPHVVRPVRFAIPAHSNERPHWQLRTGLWLYDRLAARRRLPAASTLDVTHHPIGDALKRPIGTAFEYSDCVVDDSRLVALTALDAAERGAAIRTGARCIRADRDRLWRLAIIDRGHRRIVTAGALANAAGAWSVSTAETVLRQPPLRATARQINQIVVPRLFDVDAVYVFQNSDGRLIFAQPYAGAFTLIGTVAHGFTGDPAVVTVPAADVSYLCKAANRYFRSDIQPADVLRTVSGANMMLLRGEKAGQPEAVVSFDASRSKAPLLTMCGGDVTTVRRRAEQAVSRLARFFPMTPRWTAGMALPGGNFDWQHFEDLVDEAGDRWRFLGEAEARRMVGAYGTRLSEILGEARSRSDLGQAFGAQLTEAEVRYLMTKEWARFPEDVLWRRTKLGLSLSAAERDALAAFMAQAGASGSAAPRRDGDGDSPARAVELQSIGG

SEQ ID NO: 14613 - protein, 277 aa, Nicotiana tabacum
MAFFNRVGSILKQSVSKHSNLELSASNASLFQAIRSMSSSKLFVGGLSYGTDESSLKEAFSQYGDVIEARVIMDRDTGRSRGFGFISFPSSEEAASALQAMDGQDLHGRRIRVNYATEKRRAGFGGGYGGGGGGFNYGGEGGNSAGAGGYPTNNYGGGFSGGNTSAGGYGSYGGGSNYGNDNSSPAEGGVGYGSANYGNTPNSNYSGPGNSFSGGYDGGNNGNGFGESPGASFNGGQEQVSVDQGTQSINEDIGQETSEGNYRDDDDEPKDFANSRG

SEQ ID NO: 14614 - protein, 502 aa, Glycine max
MGMLLVVVSYAVLFLVLFLGVKFVFQSRKLRNIPPGPPPLPIIGNLNLLEQPIHRFFQRMSKQYGNVVSLWFGSRLAVVISSPTAYQECFTKHDVALANRLPSLSGKYIFYNNTTVGSCSHGEHWRNLRRITALDVLSTQRVHSFSGIRSDETKRLMQRLVLAKNSNEEEFARVEISSMFNDLTYNNIMRMISGKRFYGEESEMKNVEEAREFRETVTEMLELMGLANKGDHLPFLRWFDFQNVEKRLKSISKRYDSILNKILHENRASNDRQNSMIDHLLKLQETQPQYYTDQIIKGLALAMLFGGTDSSTGTLEWSLSNLLNHPEVLKKARDELDTQVGQDRLLNESDLPKLPYLRKIILETLRLYPPAPILIPHVSSEDITIEGFNIPRDTIVIINGWGMQRDPQLWNDATCFKPERFDVEGEEKKLVAFGMGRRACPGEPMAMQSVSFTLGLLIQCFDWKRVSEEKLDMTENNWITLSRLIPLEAMCKARPLATKIGI

SEQ ID NO: 14615 - protein, 436 aa, Cicer arietinum
GLAENQLTADLVQNWIMSNPEASICTLEGVHNFKHMANFQDYHGLPEFRNAVAKFMSRTRGNRVTFDPDRIVMSGGATGAHEVTAFCLADPGDAFLVPTPYYPGFDRDLRWRTGVKLVPVICESSNNFKLTRQALEEAYEKAKEDNIRIKGLLITNPSNPLGTVMDRTTLRTVVNFINQKRIHLISDEIYAATVFSHPSFISVAEIIEQDTDIECDRDLIHIIYSLSKDMGFPGFRVGIIYSYNDSVVNCARKMSSFGLVSTQTQYLMTKVLSDDEFVERFLGESAKRLAQRYRIFTGGLVKVGIKCLQSNGGLFVWMDLRDLLKKPTFESELELWRVIIHEVKINVSPGCSFHCSEAGWFRVCYANMDDRALQIALQRIRSFVLQKNKEVMVSDKNSKPCWHSNLKLSLKSRRFEDIMMSLILQFLQSPLVQATT

SEQ ID NO: 14616 - protein, 390 aa, Pseudomonas syringae pv. tomato str. DC3000
MTQPYSARSRAIEPFHVMALLARANELQAAGHDVIHLEIGEPDFITAEPIIKAGQAALADGKTRYTAARGLPQLREAIAGFYAQRYQLDIDPQRILVTPGGSGALLLASSLLVDPGKHWLLADPGYPCNRHFLRLIEGEAQLVPVGPQERYQLTPELVASHWNPNSVGALVASPANPTGTLLTRDELAALSSALKARNGHLVVDEIYHGLTYGVDASSVLEVDNEAFVLNSFSKYFGMTGWRLGWLVAPPEAVADLEKLAQNLYISAPSMAQYAALACFEPQTLAILEQRRAEFGRRRDFLLPALRELGFGIAVEPEGAFYLYADISAFGGDAFAFCKHFLETEHVAFTPGLDFGRFQAGHHVRFAYTQSLPRLEQAVERIARGLRSWSA

SEQ ID NO: 14617 - protein, 648 aa, Hortaea werneckii
MTTSSQPLGNVNAARRPPAGPGPRPTPAAARGGMNPELAERMKNFSLSRQSTPSGGPPRAGGPAGNNGGGAGGNGGNGGAGAAPLSPEGKSAAGGFPAGFKLPPQLNRPSFPNSASSPAIPGSKGPAMPGKGPSLAEKRGMKLPGGLPGSSPAPPSPNPAAPGAPAGKRRGPPGKLSDIGGSMGANGDAPAGQEPPKEQSQMEKYAEFIDTKNGAINFKGKATVTGHGIEFTSGKSFRISLDETDTLDELGKGNYGTVFKVRHSRPRFRKAGAGLAGNKPRPGEQKESEESKDGPLIGNVSASGKGTTGVVMAMKEMRLELDDAKFQSIIMELDILHRCVSPYIVDFYGAFFQEGAVYICMEFMDGGSMDKLYGDGVPENVLRKVTFATTMGLKSLKEEHNIIHRDVKPTNILVNTKGQVKICDFGVSGNLVASIAKTNIGCQSYMAPERISSGGVASAGADAGGTYSVQSDIWSLGLTVIECALGRYPYPPETYDNIFSQLSAIVDGEPPDLPAERYSEAARNFVAGCLNKIPKLRPTYPMLLQHAWLAPLVKPSTIAEEDEEAAEAGGELDQNLGILNPELEDEGGFVDREVGEWVIDMLDRKRRGVLGESQKPAGHAAPLDSSGGFGSMGGKKDGEGVKPVAVDA

SEQ ID NO: 14618 - protein, 425 aa, Blastocladiella emersonii
MTLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 14619 - protein, 696 aa, Hortaea werneckii
MASPDEQQSPLDSPSPPTSPEESSTSPLSDGAPTARPAVSPTGFRSATTQNMTTSSQPLGNVNAARRPPGGPGPRPTPAAARGGMNPELAERMKNFSLSRQSTPSGAPPRAGGLAGNNGGGAGGSSGNGGQGATPLSPEGKSAAGGFPAGFKLPPQLNRPSFPNSASSPAIPGSKGPSLAEKRGMKLPGGLSGSSPAPPSPNPAASGAPAGRRRGPPGKLSDIGGGAGANGDAPAAQEPPKEQSQMEKYAEFIDTKNGAINFKGKATVTGQGIEFTSGKSFQISLDETDTLDELGKGNYGTVFKVRHSRPRFRKAGAGLAGNKPRPGEQKESEESKDGPLIGNVSASGKGTTGVVMAMKEMRLELDDAKFQSIIMELDILHRCVSPYIVDFYGAFFQEGAVYICMEFMDGGSMDKLYGDGVPENVLRKVTFATTMGLKSLKEEHNIIHRDVKPTNILVNTKGQVKICDFGVSGNLVASIAKTNIGCQSYMAPERISSGGMASAGADAGGTYSVQSDIWSLGLTIIECALGRYPYPPETYDNIFSQLSAIVDGEPPDLPSERYSEAARNFVAGCLNKIPKLRPTYPMLLQHAWLAPLVKPSTITEEDEEAAEAGGELDQNLGILNPELEDEGGFVDREVGEWVIEMLDRKRRGVLGESQKPAGHAAPLDSSEGFGSSMGGGGKKEDGEGVKPVAVDA

SEQ ID NO: 14620 - protein, 141 aa, Glycine max
  misc_feature (14)..(14): Xaa can be any naturally occurring amino acid
  misc_feature (76)..(76): Xaa can be any naturally occurring amino acid
APPQDGVHDSHVSXERLERHVRHKDRPDRGVWTSRSNGADDSFSSSASSQVDPLEGSHADLKHDTPNARSGEVKSXGSVRTIHSSENGFNKHFGRRGPSHGVKDVDGYSVSSEGKHPRRSSTSAYGSNEKQVWVQKASSGT

SEQ ID NO: 14621 - protein, 672 aa, Legionella pneumophila str. Paris
MNNYKHWDLQRDKDAILWLGLNRRDAAVNSINEEVLDELNSLLHEISHDKKAMGLIIYSLKEKGFIAGADVNAFSQFESSSQAVDFLQKGQTVFARLQTLSIPSVAMIDGFCMGGGYELALACTYRIATDDKDTRIGLPEVMLGIHPGWGGTVRLPQLIGGFKALSQVILTGSAIPAVKAKSLGMIDEVVPVRQLRRAAVYFIKNKPPRHRASFIESLTNSSLLRKALAYLLRYNVAKRVRKEHYPAPYAVIDLWEKEGGVGERAYLKEVDSIEKLVSQNDTAKNLIRAFLLRERLKGFAKDSNFKATHVHVIGAGVMGGDIAAWCALRGLQVTLQDKSYEQIAPAIGRAHKLYSKKLRKPRLIQAAMDRLIADPEGHGVKRADVIIEAVFENLAVKQEIMKIVEKNAKKDAIIATNTSSIPLDEISSVMSKPERLVGIHFFNPVAKMDLVEIVSSSSTAKKIQQSSCAFVNQIGKLPLPVKSSPGFLINRVLMPYLMECVQLLDEGYSAETIDEAALQFGMFMGPVELADTVGMDVCLAVAENLTSHFGGTIPQRLRDLVKEGKLGRKTGEGFYKYKNGKVIKKKAPSHVDKTIADRLILRMVNESAACIREKVVEDSDLLDAGMIFATGFAPFRGGPMNYANDFGKDKLETLFKTFESKYGERFKVDTSL

SEQ ID NO: 14622 - protein, 582 aa, Arabidopsis thaliana
  misc_feature (552)..(552): Xaa can be any naturally occurring amino acid
MSKQTYKVCFCFRRRFRYTASEAPREIKTIFEKYSENGVMTVDHLHRFLIDVQKQDKATREDAQSIINSASSLLHRNGLHLDAFFKYLFGDNNPPLALHKVHHDMDAPISHYFIFTGHNSYLTGNQLSSDCSEVPIIDALKKGVRVIELDIWPNSNKDDIDVLHGMTLTTPVGLIKCLKAIRAHAFDVSDYPVVVTLEDHLTPDLQSKVAEMVTEIFGEILFTPPVGESLKEFPSPNSLKRRIIISTKPPKEYKEGKDVEVVQKGKDLGDEEVWGREVPSFIQRNKSEAKDDLDGNDDDDDDDDEDKSKINAPPQYKHLIAIHAGKPKGGITECLKVDPDKVRRLSLSEEQLEKAAEKYAKQIVRFTQHNLLRIYPKGTRVTSSNYNPLVGWSHGAQMVAFNMQGYGRSLWLMQGMFRANGGCGYIKKPDLLLKSGSDSDIFDPKATLPVKTTLRVTVYMGEGWYFDFRHTHFDQYSPPDFYTRVGIAGVPGDTVMKKTKTLEDNWIPAWDEVFEFPLTVPELALLRLEVHEYDMSEKDDFGGQTCLPVWEXLSEGIRAFPLHSRKGEKYKSVKLLVKVEFV

SEQ ID NO: 14623 - protein, 770 aa, Oryza sativa Japonica Group
MAAAAILPELAAQVVIPVAAAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASGHARTLGPKGSDPHKAAVIGDTIGDPLKDTSGPSLNILIKLMAVESLVFAPFFATHGGILFKLF

SEQ ID NO: 14624 - protein, 253 aa, Aggregatibacter actinomycetemcomitans
MCSANFNRRKIMSNMEGKKVPQVTFRTRQGDQWIDVTTSELFDNKTVIVFSLPGAFTPTCSSSHLPRYNELAPVFKKYGVDDILVISVNDTFVMNAWKEDEKSDNITFIPDGNGEFTEGMGMLVGKEDLGFGKRSWRYSMLVKNGVVEKMFIEPNEPGDPFKVSDADTMLKYLAPQHQVQESITIFTKPGCPFCAKAKQMLHEKGLSFEEIVLGHDATIVSVRAVSGRATVPQVFIGGKHIGGSDDLEAYFAK

SEQ ID NO: 14625 - protein, 309 aa, Prunus persica
MAVTLSSGFEMPVIGLGLWRLEKEELRSAILNAIKLGYRHFDAAAHYKTEIDVGNAIAEAIQSGLVKREELFITSKVWNSDHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEVLNFKLEKEDIELINTIDKKFRTTLPSLSWGFDLYA

SEQ ID NO: 14626 - protein, 186 aa, Pseudomonas aeruginosa PAO1
MNIPNLLTLLRVLLIPIFILLFYLPTSWSYLTASAVFALAAATDWLDGYLARRLGQSTPFGAFLDPVADKLMVAVALVLLVEEHANLWLTLPAVIIIGREIVVSALREWMAELGARAQVAVSNLGKWKTAAQMLALVILLANPPLMTFWVILGYVLLIISAALTLWSMVHYLLAAWPHLSTTPKEK

SEQ ID NO: 14627 - protein, 356 aa, Bacillus thuringiensis serovar konkukian str. 97-27
MVIKVTIDRVCTIGPASNNKETLAQLINNGMKIVRLNLSHGTHESHKDIIRLVKSLDDSIKILGDVQGPKIRLGEIKGEQITLQAGDSFLLHTQPVTGSSTEASVDYEGIANDVKVGSRILMNDGEVELIVEKVSTDKIETKVKTGGNISSHKGVNLPGAIVSLPAITEKDKKDIQFLLEEGVDFIACSFVRKPSHIKEIRDFIQQYRETSPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPVESVSTLRLVSEFAEHVKQDGPFVMKDVLELLHKSLGE

SEQ ID NO: 14628 - protein, 434 aa, Brassica napus
MGKENVVSRPLTRAFASALRASTTENQQRANTKRPASEDVNVTAPPNKKKKRAVLGDISNASFSAAKLEARDIKQVKKSQGLASASCVTSEVTDLQSGTEAKAEVVSVTAGNTNDTADNCIEKHKLPPRPLGRSSASIVEKSGVIRSSTALDLPKFTDIDSDDKDPLLCCLYAPEIYYNLRVSELKRRPVPNFMERIQKDVTQSMRGILVDWLVEVSEEYTLVPDTLYQTVYLIDWFLHGNYLERQRLQLLGITCMLIASKYEEINAPRIEEFCFITDNTYTRDQVLEMENQVLAHFSFQIYTPTPKTFLRRFLRAAQASYLIPRRELECLASYLTEVTLIDYHFLKFLPSVIAASAVFLAKWTLDQSNHPWNPTLEHYTTYKASDLKASVHALQDLQLNTKGCPLSAIRMKYKQEKFKSVAVLMSPKLLDTLF

SEQ ID NO: 14629 - protein, 200 aa, Hyphomonas neptunium ATCC 15444
MAEERGEKRGRRRDRENPRDRDDESSELVDKLVGINRVAKTVKGGKNFGFAALVVVGDQKGRAGFGKGKAREVPEAIRKATEEAKRNLVRIPLREGRTLHHDGNGRHGAGKVVLRAAPPGTGVIAGGPMRAVMEVLGVQDVVGKSLGSSNPYNMVRATFDALKGQANPRTVASKRGLKVQDIVGRRTDGASEAGMADSVN

SEQ ID NO: 14630 - protein, 222 aa, Medicago truncatula
MGSNFLSPPAKRSITGLPDPNPFPNGSSKRAKPSKPPQQPLPIPAGHVAFRLLCNSSRIGGVIGKSGTVIKNLQLTTGAKIRIEDSPNESPDRVIMVIGASNIDGKVMVRSHSGDGEAIEVSKAQEALLRVFDRILEVAAEMEGIELGDRTVSCRLVADSAQAGSVIGKGGKVVEKIKKDTGCKIWVCKDNLPACISSPDEVIECSASRSMFGSAVTRIVFE

SEQ ID NO: 14631 - protein, 564 aa, Medicago truncatula
MMIEGSVSSVKKALVAVSRNLQDRHHADRTKMTGQNSHEVIHHEALVGVPRETLMSVPRETFIGAPRETLTAVPCETLTDLHVDHLLQRRSALSILPSSSNSYATGVHSLSAEVNRVSSLEPKAHQQEITFKIICSNDRIGGVIGKGGNIIRALQSETGATVSVGPSVAECEDRLITITASESPESRYSPAQKATVLVFSRSVEAGIEKGIDSGLNTGSSVTAQLVVSSNQVGCLLGKGGVIVSEMRKATGASIRIVGTDKVSKCASDNDQVVQISGEFSNVQDALYNATGRLRDNLFGGTLKSAGTRSLSSVQSDTSPYGRLRDVPLGSQSSLRADTNAFVRLRDVPLVGQSSLQADTSPYVRLRDVSLGGQSSLQSDTSPYGRLRDIPLGGQSSLQSDTSPYGKLRDIPLGGQSAVGISHSLSRHTFSQGIDHFSLGRNYDRPSSPGLWTPPRVTGMNSGSINEASWGSTSRKGGLELVSGSKSAIVTNTTIEIVVPEDTLYLVYGENGSNLARLRQISGAKVVIHEPRPGTSDRTIVLSGSPDETQAAQSLLQAFILNGSS

SEQ ID NO: 14632 - protein, 322 aa, Xanthomonas campestris pv. vesicatoria str. 85-10
MSFDPDVVRLFAQLQEAAQPPMETLPIEGARAMMRAVGAQFGFPRIEMAEVRDLQAEAATGAVPLRLYRPTGLAAGPAPTCLFVHGGGGLVGDLESHDDVCRQLAARAGCQVLAIHYRLAPEHPAPAGVEDVIATLHWLVAHPDTVGADVQRLAVCGDSIGGAMAAVAALAARDAGIALRCQLLVYPLTDARQDSGVYPSRSLNAGLPPLTAAAVEFFNRHLLPDMAVANDWRVSPMLAPDVAGVAPALVVVCDRDMLYDEGRAYAERLRAAGMEVTLHSFPGMIHGFINMGSVLRAAGETLDLAALTLRQRLLPAIERRAA

SEQ ID NO: 14633 - protein, 368 aa, Oryza sativa Indica Group
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENDLPIWVSNDGPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADRTIKTRGHFRTCDCDEACCNIQTSG

SEQ ID NO: 14634 - protein, 167 aa, Zea mays
  misc_feature (8)..(8): Xaa can be any naturally occurring amino acid
ITAALAQXGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 14635 - protein, 277 aa, Forsythia x intermedia
MAATSQVLTAIARRLEGKVALITGGASGIGETTAKLFSQHGAKVAIADVQDELGHSVVEAIGTSNSTYIHCDVTNEDGVKNAVDNTVSTYGKLDIMFSNAGISDPNRPRIIDNEKADFERVFSVNVTGVFLCMKHAARVMIPARSGNIISTASLSSTMGGGSSHAYCGSKHAVLGLTRNLAVELGQFGIRVNCLSPFGLPTALGKKFSGIKNEEEFENVINFAGNLKGPKFNVEDVANAALYLASDEAKYVSGHNLFIDGGFSVCNSVIKVFQYPDS

SEQ ID NO: 14636 - protein, 645 aa, Hortaea werneckii
MTTSSQPLGNVNAARRPPGGPGPRPTPAAARGGMNPELAERMKNFSLSRQSTPSGAPPRAGGLAGNNGGGAGGSSGNGGQGATPLSPEGKSAAGGFPAGFKLPPQLNRPSFPNSASSPAIPGSKGPSLAEKRGMKLPGGLSGSSPAPPSPNPAASGAPAGRRRGPPGKLSDIGGGAGANGDAPAAQEPPKEQSQMEKYAEFIDTKNGAINFKGKATVTGQGIEFTSGKSFQISLDETDTLDELGKGNYGTVFKVRHSRPRFRKAGAGLAGNKPRPGEQKESEESKDGPLIGNVSASGKGTTGVVMAMKEMRLELDDAKFQSIIMELDILHRCVSPYIVDFYGAFFQEGAVYICMEFMDGGSMDKLYGDGVPENVLRKVTFATTMGLKSLKEEHNIIHRDVKPTNILVNTKGQVKICDFGVSGNLVASIAKTNIGCQSYMAPERISSGGMASAGADAGGTYSVQSDIWSLGLTIIECALGRYPYPPETYDNIFSQLSAIVDGEPPDLPSERYSEAARNFVAGCLNKIPKLRPTYPMLLQHAWLAPLVKPSTITEEDEEAAEAGGELDQNLGILNPELEDEGGFVDREVGEWVIEMLDRKRRGVLGESQKPAGHAAPLDSSEGFGSSMGGGGKKEDGEGVKPVAVDA

SEQ ID NO: 14637 - protein, 263 aa, uncultured marine bacterium 582
MQTSANLNVMVKAARKAGRSLMKDFQEVENLQVSVKGAGDFVTKADIAAEKIIKDELLQARPTYGWVGEESGEIEGADPTRRWIVDPLDGTTNFLHGLPHWSVSIALEHKGQVVAGVVHDPIKNELFFAEKGSGAWMNETRLRVSGRNRMIEAVFATGLPFAGRADLPASLRDLGRLLPVCAGVRQSGSAALDLSYVAAGRFDGFWERRLNVWDLAAGLIILREAGGLASPIDESLDILGDGQIICSNEPLYETFLAVVRNAA

SEQ ID NO: 14638 - protein, 263 aa, Streptomyces coelicolor
MSTTGTTPATTGYAAEFAGRTALVTGAASGIGLATARRLGAGGARVVVADFNAEGAEKAAAELRAGGVEAAAVELDVTRPESVEAAVGFAVDTFGSLDLAVNNAGIGGPSAPTGEYDVAAYQRVVRTNLDGVFYSMRYELPAIEAAGKGGSIVNVASILGSVGFAGSPAYVAAKHGVVGLTKAAAAEYAARGIRINAVGPGFIDTPLLKTMDEAAYKGWSPCTRPAASGAPRRSRTLIAFLLSDRASFVAGSYHLVDGAYTAV

SEQ ID NO: 14639 - protein, 178 aa, Agrobacterium tumefaciens str. C58
MLGKKVPAVTFRTRVRDEAVGGPNPFRWQDMTSDDYFKGKKVVLFSLPGAFTPTCSTYQLPDFEKLAGEFRALGVDEIYCLSVNDAFVMNAWAKGQNLENVKVIPDGSGEFTRKMGMLVAKDNLGFGMRSWRYAAVINDGLVEQWFEEEGYSDNCESDPYGVSSPQNILENLKSRAAA

SEQ ID NO: 14640 - protein, 479 aa, Lactobacillus acidophilus NCFM
MSEGEIVQVIGPVVDVKFPIDKNLPDINNALRVIKSEDESIVLEVTLELGDGVLRTIAMESTDGLRRGMKVEDTGAPISVPVGEDTLGRVFNVLGQPIDGGPAFPKDHPREGIHKEAPKYEDLTTSREILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTLATEMGQLQERITSTKKGSITSIQAVYVPADDYTDPAPSTTFAYLDATTNLERSLVEQGIYPAVDPLESSSSALDPEVVGQEHYEVATRVQHVLQRYHELQDIISVLGMDELSDEEKLIVARARKVQFFLSQNFFVAEQFTGVPGSYVPIKETIKGFKLILDGHLDDLPEDAFRGVGPIEDVLKKAQEMGVTPSDPEAKALLEK

SEQ ID NO: 14641 - protein, 380 aa, Oryza sativa
MAASSARLLAAAARGRAATTFRHAPTVSSSLSFPPNPHHRPSLRGRAGISFSSTSISLPSGSPHGASAPFNLFPPDSDPFIQWDPPPPDAASPLGAGAAGREAPGDLTLVVLLGWLGARQKHLRRYADLYRDRGVGSVRFVVPVRELLGLDLGRRVERRVADLAAGIAAWCDADHRRTLLFHTFSNTRWLAYGAILENLQSRADIIERIRGCIVDSAPVLEIRPEVWAAGFSAAMLKKSSSMTGPSVESPDGYTSNGTLNNLSSDVTRPTWGENILLSTLQKFFEIVLHLPDVNKRLEKVHSVLSEKQPTCPQFYLYSSADRVIPAECVERFIDMQKSLGQSVFAHNFVSSPHVDHYRSFPHVYAAKIDEFLKICSIARV

SEQ ID NO: 14642 - protein, 462 aa, Streptococcus thermophilus CNRZ1066
MAFEIIMPKLGVDMQEGEIIEWKKQEGDVVNEGDILLEIMSDKTNMELEAEDSGVLLKITRQAGEIVPVTEVIGYIGAEGEVVADNAAIAPAAEAAPQVEKVADVETPAAKPQPQVAIVHEGGKIRATPKARKVAREMGIDLAQVLGTGAKGRIHADDVENFKGAQPKATPLARKIAADLGIDLATVSGTGFGGKITKEDILAISAPAQVKVAAAAPAVEAKPEKVLPEGVEVIPMSAMRKAISKGMTHSYLTAPTFTLNYDVDMTNLIALRKQVLDPIMNKTGMKVTFTDLIGLAVVRTLMKEEHRYLNASLINDAQNIELHKFVNLGIAVGLDDGLVVPVIHGADKMSLSDFVGASKDVIKKAQAGKLKAAEMSGSTFSITNLGMFGTKSFNPIINQPNSAILGVSATIQTPVVVDGEVVVRPIMGLCLTIDHRIVDGMNGAKFMVDLKHLLENPMELLI

SEQ ID NO: 14643 - protein, 499 aa, Hordeum vulgare
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 14644 - protein, 344 aa, Streptococcus mutans UA159
MKKIVTLAGDGIGPEIMAAGLEVFDAVAQKINFDYEIEAKAFGGAGIDASGHPLPDDTLAAAKTADAILLAAIGSPQYDKAPVRPEQGLLAIRKELNLFANIRPVRIFDALRHLSPLKAERIAGVDFVVVRELTGGIYFGQHTLTENSACDINEYSASEIRRIMRKAFAIARGRSKKVTSIDKQNVLATSKLWRQIAEEVAKEYSDVTLEHQLVDSAAMVMITNPACFDVVVTENLFGDILSDESSVLPGTLGVMPSASHSESGPSLYEPIHGSAPDIAGKGIANPISMILSVAMMLRDSFGETAGAEMIEHAVNKTLTQGILTRDLGGLANTKQMTAAIIANL

SEQ ID NO: 14645 - protein, 416 aa, Pyrococcus horikoshii OT3
MNKMKAVILAGGFGTRLRPISSTRPKPMVPVLGKPNLQYILEALEKVKEIDEIILSVHYMRGEIREFIQEKMRDYPKDIRFVNDPMPLETGGALKNVEEYVSDDFLVIYGDVFTNFDYSELIEAHKKNDGLITVALTKVYDPERFGVVITDEEGKIVEFEEKPRKPKTNLVDAGIYMVNKDVLKEIPKNKEIYFEREILPKFVNQGLVYGYKMPKQYYWVDLGTPEDFFYAHQIALDELSKENGYMILGENVEIPDDVEVQGPVYIDDNAKIGHGVKIKAYTYIGPNTIIEDKAYFKRSILLGNDIIKERAELKDAILGEGVVVGKDVIIKENAVIGDYAKIYDNLVIYGAKVLPWKKVEEYEAYIKIKLDPTKVRPGQYPDHCPLGLPECIYKKFKAIAGEKPPCDECIENQWLF

SEQ ID NO: 14646 - protein, 480 aa, Salmonella typhimurium LT2
MTLSFTARWRDELPATYTALLPTPLKNARLIWYNDELAQQLAIPASLFDATNGAGVWGGETLLPGMSPVAQVYSGHQFGVWAGQLGDGRGILLGEQLLADGSTLDWHLKGAGLTPYSRMGDGRAVLRSTIRESLASEAMHYLGIPTTRALSIVTSDTPVQRETQETGAMLMRLAQSHMRFGHFEHFYYRREPEKVQQLADFAIRHYWPQWQDVPEKYALWFEEVAARTGRLIAEWQTVGFAHGVMNTDNMSILGLTIDYGPFGFLDDYDPGFIGNHSDHQGRYRFDNQPSVALWNLQRLAQTLTPFIEIDALNRALDRYQDALLTHYGQRMRQKLGFFTEQKDDNVLLNELFSLMAREGSDYTRTFRMLSHTEQQSASSPLRDTFIDRAAFDAWFDRYRARLRTEAVDDALRQQQMQRVNPAIVLRNWLAQRAIDAAEQGDMAELHRLHEVLRQPFTDRDDDYARRPPEWGKRLEVSCSS

SEQ ID NO: 14647 - protein, 320 aa, Arabidopsis thaliana
  misc_feature (236)..(236): Xaa can be any naturally occurring amino acid
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSWIIGILWVALLIGLGSVGTSAVIVVQLFRLSALDPLYLVLXTTAIAKLKVKAKLVNSLMGQWQGWRYVRAHSFCGFAYNVKLCHFIFNILPQKFKTYFYLHFKFVCFIVFFCIYFLLCDDNYLCT

SEQ ID NO: 14648 - protein, 500 aa, Citrus sinensis
LLLIPLLLILKKLKAQNKQQLPPSPPKLPVIGNFHQLGELPHQSLWQLSKKYGPVMLLKLGRVPLVVISSAEAARDVLKVHDLDCCSRPPLIGSGKFTYNYSDIAFSPYSDYWRELRKISVLEVFSLRRVQSFGFIREEEVALLMNSISESSSSASPVDLSEKMFALTGSIVFRMAFGRRFRGSNFDNHSFQELVHAVESLLGGFAAAECFPYVGWIIDRLNGYHAKLERVFQELDTLFQQIIDDHLKPAETTKQEHVQQDIIDVMLKIERDQAESHESEAWLTKNHIKAVLLNIFLGGVDTSAITVIWAMAELCKNPRLMKKAQAEIRNHIGNKGRVTEADIDQLQYLKMVIKETLRLHPPAPLLIARDTLYRFKVNGYDIYPKTLIQVNAWAIGRDSKYWESPEEFIPERFIDKPVDVKGQDFEYLPFGSGRRICPGINLGLIMSELALANLLYCFDWKLPNGREEDCVNMNMEEATGVSLTLSKKTPLILVPVNYLQ

SEQ ID NO: 14649 - protein, 280 aa, Nocardioides sp. JS614
MRTLDDKVCVVTGAGSGIGRALALNLAGRGARLALSDVDDIGLAATVDQVRAAGGREVRSDHLDVADRDAFASYAADVAGHFGRVNVAINNAGVALAGNFEDLEYPDMDWIIGVNFWGVVHGTKEFLPHLIASGDGHLVNISSLFGLVSMPGQSMYNASKYAVRGMSEAVREEMLIAGHPVGVTVVHPGGIKTAIARNARVSSREDKEKTARLFDEKLAKMTPERAAEIIVRGILHNRARVLVGLDAHAVHHLAKLTGSRYQDILAKAAGRVLPDQTTAV

SEQ ID NO: 14650 - protein, 292 aa, Hordeum vulgare
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 14651 - protein, 292 aa, Hordeum vulgare
MEGKEEDVRLGANRYSERQPIGTAAQGGGADEKDYKEPPPAPLFEAEELSSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 14652 - protein, 290 aa, Hordeum vulgare
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 14653 - protein, 216 aa, Arabidopsis thaliana
MSEEAYEETQESSQSPRPVPKLNERILSTLSRRSVAAHPWHDLEIGPEAPLVFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHFTDIKQLAPHRLQEIRRFFENYKKNENKKVAVNDFLPSESAHEAIQYSMDLYAEYILHTLRR

SEQ ID NO: 14654 - protein, 610 aa, Candida glabrata CBS 138
MPPVSASKAKRDAKKAEREAKKKSEGKTIRKLGKKKEAGTEEDAAEAAAREIEQLKLQTDKDGLSDRVTTGVLDSLETSRDIKMSSVSLLFHGKVLIQDSNLELNYGRRYGLLGENGCGKSTFLKALATREYPIPDHIDVYLLDEPAAPTEYSALEYVVREAQNELKRVEDLVEKIILEDGPESELLDPLYERMDGMDPSTFESRAAVILIGLGFNSQTILKKTKDMSGGWKMRVALAKALFVKPTLLLLDDPTAHLDLEACVWLEEYLKRFDRTLVLVSHSQDFLNGVCTNMIDMRMQKLMQYGGNYDSYIKTRTELETNQMKQYNKQQEEIAHIKKFIASAGTYANLVKQAKSRQKILDKMEADGLIQPVVPDRVFSFRFPPVERLPPPVLAFDDISFAYDGNPENNLYEHLNFGVDMDSRTALVGPNGVGKSTLLKIMTGELMPQSGRVSRHTHVKLGVYSQHSQDQLDLTKSALEFVRDKYSNISQDFQYWRGQLGRYGLTGDAQKVQMGTLSEGQRSRVVFALLALENPNVLLLDEPTNGLDIPTIDSLADAINEFNGGVVVVSHDFRLLDKIAKDIFVVEDKTATRWDGSILDYKKKLAKNVVL

SEQ ID NO: 14655 - protein, 1230 aa, Cryptococcus neoformans var. neoformans
MSSFTPAFRLHHTHSSSVSPTASNDVAPSSPTPNQPHQLAARSPLYANSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIGGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 14656 - protein, 225 aa, Glycine max
MTRLRKRVATRLKDSQNTFAMLTTFNEVDMTNLMKLRSDYKDAFVEKHGVKLGLMSGFVKAAVNALQHQPIVNAVIDGDDIIYRDYIDISIAVGTPKGLVVPVIRNADTMNFADIEKQINTFAKKANDGSLSIDEMAGGTLTISNGGVYGSLLSTPIINPPQSAILGMHSIVSRPTVVGGNIVPRPMMYVALTYDHRIIDGREAVFFLRRIKDIVEDPRRLLLDI

SEQ ID NO: 14657 - protein, 491 aa, Nicotiana tabacum
MVLSKTSSESDVSVHSTFASRYVRTSLPRFEMAENSIPKEAAFQIINDELMLDGNPRLNLASFVTTWMEPECDKLMMDSINKNYVDMDEYPVTTELQNRCVNMIARLFNAPLEEKETAVGVGTVGSSEAIMLAGLAFKRNWQNKRKAEGKPYNKPNIVTGANVQVCWEKFANYFEVELKEVKLREGYYVMDPVQAVEMVDENTICVAAILGSTLNGEFEDVKLLNDLLIEKNKQTGWNTPIHVDAASGGFIAPFLYPELEWDFRLPLVKSINVSGHKYGLVYAGIGWVIWRTKQDLPEELIFHINYLGADQPTFTLNFSKGSSQVIAQYYQLIRLGYEGYRNVMENCRENAIVLREGLEKTGRFNIVSKDEGVPLVAFSLKDNSRHNEFEVSETLRRFGWIVPAYTMPADAQHVTVLRVVIREDFSRTLAERLVLDIVKVLHELDTLPARLSAKLEEVKLVKNGKKFELEVQREVTNYWKKFVLARKAPVC

SEQ ID NO: 14658 - protein, 217 aa, Salmonella enterica subsp. arizonae serovar 62:z4,z23:--
MNQTLLSSFGTPFERVELALDALREGRGVMVLDDEDRENEGDMIFPAETMTVEQMALTIRHGSGIVCLCITEDRRKQLDLPMMVQNNTSAYGTGFTVTIEAAEGVTTGVSAADRVTTVRAAIADGAKPSDLNRPGHVFPLRAQAGGVLTRGGHTEATIDLMTLAGFKPAGVLCELTNDNGTMARAPECIAFAGQHNMAVVTIEDLVAYRLAHERKVS

SEQ ID NO: 14659 - protein, 359 aa, Neptuniibacter caesariensis
MSKNVLILPGDGIGPEIVTEARRVLELVNEQDNLGLELTEALLGGAAIDAEGVPLPDATLEAAKASDAILLGAVGGPKWDTNPDFQIRPEKGLLGIRSQLELFGNLRPAILYPQLAHASTLKPEVVSGLDILIVRELTGGIYFGQPRGVREKEGGIREGYNTYVYDENEIRRIGRVAFEAAMARDKRLCSVDKANVLEVTVLWREIMEDLAKEYPEVELSHMYVDNAAMQLVRAPKQFDVMVTGNMFGDILSDAAAMLTGSIGMLPSASLDESGKGMYEPCHGSAPDIAGQGLANPLATILSAAMMLRYSLGAGETADRIEAAVSKVLDQNLRTADIMSEGMQQVSTSEMGDAVVAALQ

SEQ ID NO: 14660 - protein, 209 aa, Streptococcus mutans UA159
MRKKPIIIGVTGGSGSGKTSVSRAILANFPNAKIAMIEHDSYYKDQSHLTFEERVTTNYDHPLAFETDLLINHLKELIADRPVDIPIYDYTQHTRSEKSYRQEPQDVFIVEGILVLEDQRLRDLMDIKLFVDTDDDIRIIRRIKRDMQERGRSLDSIIEQYTRVVKPMYHQFIEPTKRYADIVVPEGVSNLVAIDLINTKVASILNETH

SEQ ID NO: 14661 - protein, 397 aa, Zea mays
MEAKKPYLIAVVIQLIYAGMFVVSKAAFDHGVNTFVFIFYRMAAASLLLLPVAITLQRKNVRSMSMGLLLKLFFYALIGSYSYYISGHTHAHASSDFQSIHRCIITDYSRLQMNTFSLNLYNVSMKWTSATVASASSNSMPVIAFCLALLLRMEAVSLRSRSGVAKVAGVALCAAGVLVLAFYAGPALSPVTRRRAAFFAAAHHATDKHHPASGGTAWVEGAFFMVLANVTWALWIVLQSALLKEYPNKMLVTVTQCVFSMTQSFVVAVVAERGDFSEWKLRFDISLLAILYTGFVVTGVSYYLQAWCMEMKGPVFLAMSNPLCFVFTIFCSSFFLGEIVHLGSFLFGLLYGVGSTVGGALLVAGLYSVLWGKSREAMESEAEGMEDHAPSSMDEQA

SEQ ID NO: 14662 - protein, 261 aa, Vibrio campbellii AND4
EAAGLKVKFYHYFSPETKQVDTERMLEDLSKAGPSDVVLLHGCCHNPTGADIDFSAWQVITEMSQKNGFTPFVDIAYQGFGDGLEEDAKGLRFMADNVEEMLITTSCSKNFGLYRERTGAAIVIGKNTQDVANAKGKLLTLARSTYTMPPDHGAALVKTILQDTYLTSVWKQELNEMQQRLVNLRQILCNELRNNHNTEQFDFIEGHKGMFTVLGFSEKQIAQLREDYGIYGVGDGRINIAGLSETHIPFVADAIQRVSQR

SEQ ID NO: 14663 - protein, 303 aa, Ipomoea batatas
RMDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 14664 - protein, 252 aa, Arabidopsis thaliana
LSENSNMSPRISFSRDFCQSDAIPIEKRPLRSSNSKPSSLNSSIDFDFCIPGGVNSGESFDQGSWSADELFSNGKILPTEIKKKPEPGKKEPEPKPVKSKPDSRKQRKQPNEEQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14665 - protein, 443 aa, Zea mays
MAAAHYGNGSSTSGGGGGRGRGKPITCKGAVACLRLLFCFCTAVAWGPGVPLSLEEVEVAPPSPMEVRVKVLFTSICHTDLSAWKGECEAQRKYPRILGHEAAGLVPLSMGGLSGLVGRIVCMSIGPSVRRVVESVGEGVEGLAPGDHVVPIFTGECEKCVYCKSDKTNLCGTYRVDPLKSSMVYDDGTRFSVVDQASGQRRPVYHFLNTSTFTEYTVLDAACAVKINPEAPLQRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYGRRITGCVFGDFKGKSQLPDLVDKCVNGEVNINFDGFITHKMPFSDINKAFRLLEEGKSLRCLLSL

SEQ ID NO: 14666 - protein, 144 aa, Arabidopsis thaliana
  misc_feature (57)..(57): Xaa can be any naturally occurring amino acid
  misc_feature (94)..(94): Xaa can be any naturally occurring amino acid
  misc_feature (116)..(116): Xaa can be any naturally occurring amino acid
MVFCTAHATVRDPFIGLKYSSAFPATRKALKDITSITSNGSRVNCMQVWPPIGKKKXETLCYLSDLTDSKLAKEVDYLIRARWIRCDELELKHXVVFREHGHSPGYYDGRYWTMCXLTLFGCSESPVLLKEVVECRKEYPTAFI

SEQ ID NO: 14667 - protein, 348 aa, Saccharomyces cerevisiae YJM789
MSIPETQKAIIFYESNGKLEHKDIPVPKPKPNELLINVKYSGVCHTDLHAWHGDWPLPTKLPLVGGHEGAGVVVAIGDNVRGWKIGDYAGIKWLNGSCMACEYCELGNESNCPHADLSGYTHDGSFQEYATADAVQAAHIPQGTDLAEVAPVLCAGITVYKALKSANLRAGHWVAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 14668 - protein, 367 aa, Torenia hybrid cultivar
MARAGPLTLTSLALEKSLHEKFIRDEDERPNLAYDQFSSQIPLISLSGIDDECNKRKELCKRIAQACEDWGIFQVIDHGIDLKLVNDMTRLAREFFDLPDEEKLRFDMSGGRKGGFIVSSHLQGEVVQDWREIVTYFTYPIKGRDYSLWPDKPEAWRAVTETYSSQLMCLGCKLLGILSEAMGLEREALTKACLNMDQKVVVNFYPKCPQPNLTLGLKRHSDPGLITLLFQDNVGGLQATRDGGKSWITVQPVEGAFVVNLGDFAHYLSNGRFKNADHRAVVNSNTNRMSIATFQNPSPEAIVYPLKIGDDGKPIIEKPITYGEMYKRKMAKDIELAKLKKLAKEQKLQEEVVNNVEDHHLNNGKTK

SEQ ID NO: 14669 - protein, 469 aa, Rhizobium leguminosarum bv. viciae
MATASEILKQIKENDVKFVDLRFTDRRASLQHVTMDVVCVDEDMFADGVMFDGFSIGGWKAINESDMVLMPDTETVHMDPFFAQSTMVIVCDILDPVSGEAYNRDRRGTAKKAEAYLKASGIGDTVFVGREAEFFVFDDVKYKADPYNTGFKLDSTELPSNDDTDYETGNLGHRPRVKGGYFPVPPVDSAQDMRSEMLTVLSEMGVVVEKHHHEVAAAQHDTLVRNADELGIKFKMQIYKYVVHQVANAYGKTATFMPKPIFGDNGSGMHVHQSIWKGGKPTFAGDEYAGLSESCLFYIGGIIKHAKAINAFTNPSTNSYKRFVPGYEAPVLLAYSARNRSASCRIPFGSNPKAKRVEVRFPDPTANPYLAFAAMLMAGLDGIKNKIHPGKAMDKDLYDLPPKELKKIPTVCGSLRQALESLDKDRKFLTAGGVFDDDQIDAFIELKMAEVMRFEMTPHPVEYDMYYSA

SEQ ID NO: 14670 - protein, 399 aa, Bacillus thuringiensis serovar konkukian str. 97-27
MRSEVTVKIKSKFIKEIKSGYPLILKDAIQNLNDVREEGTIIKVVDEKNNFVGKGYYGKQNKGYGWILTRKESEQINQSFFESKIKSALHKRKQFYKSSDTTAFRALNGEGDGLGGLIIDYYDGYYVVSWYSEGIYTFRDEIIAALQKVANFKGIYEKKRFDTKGKYIEGDDFVAGERGEFPLIVKENGVNFAVYLNDGAMVGVFLDQRNVRKQIRDKYAKGRTVLNMFSYTGAFSVFAALGGASKTTSVDLANRSLSKTIEQFSVNEVDYEAQDIIVEDVFLYFKYAAKKKMKFDMVVLDPPSFARSKKYTFSAAKDYKNLLKETIAITENNGIIVASTNCSAFDMKKFKGFIDTAFKEMNGKYKILEEHSLPEDFRTIDQFKEGDYLKVVFIEKIKG

SEQ ID NO: 14671 - protein, 222 aa, Zea mays
  misc_feature (116)..(116): Xaa can be any naturally occurring amino acid
TARPSVRYGLPSPSSDTSPTTPGGGYYGPPSPSSDTSPTTPGGSGGGYYGPPSPSSETSPTTPGGGGGYTPTPQVPLPPISTSPPFSPLTPTPTTPTPYDPNTPPFTGPGSGFTAXPGVRWGLFGFWCPLVRLFGPSAAVPFGHDLTVPEALANTREDGVGALYREGTASLLNSMVNNRFPFTTQEVKDAFGAALNSGDDGAAAAQARLFKKANEGHVIRQN

SEQ ID NO: 14672 - protein, 481 aa, Campylobacter coli RM2228
MGNARGFLDFKRVDFKKVAPKERVLNFKEFTTLLDKKEQEIQGGRCMDCGVAFCHTGVMSEGKDVGCPLNNLIPEWNDLIYRSLWKEAYERLDLTNPFPEFTGRVCPAPCEDSCVCAINGKSVSIKNNELAIIENAFKENLVSPNKPKQYNGKKIAVIGSGPAGLACANTLNSLGYKVSVFERSDKVGGLLMYGIPDMKLDKSIVDRRVDLLKESGIEFKVNENIDSKDKVSKLLKEFDALVLCTGASKPIDLDIEGRKLKGVEFALDFLTQNTKTLLKTGKGADTAKGKNVLVIGSGDTSVDCIAVATRQGAKSIVRFERSPKRPLQRSQSNPWPLKADIFTTDYGLEEAIAVYGKDPREYQKMTKKFLGKDKVESVEACDLKREFKEGKAINVELPNSNQNYKADLVLLAMGFSGSEDAIASNFGVSLDEKNNVKTKNFQTTHEKIFACGDARKGQSLVVWAIKDGIECALNIHENLAK

SEQ ID NO: 14673 - protein, 486 aa, Hyphomonas neptunium ATCC 15444
MPLKLKDSSLLKSEAFIGGAWRAATSGETFEVTNPATGETLISVPKMGADETREAIDAAAKAFPEWAALLAEKRSAILRQWFDLLMENQADLAALMTAEQGKSLTESKGEIAYAASFIEWFSQEARRTYGDIIPSHTPTARILVTHEPVGVTAAITPWNFPAAMIARKAAAALSVGCTMVVKPASATPLTALAMAVLAERAGIPAGVLSVITGSAGDIGGELTSNPKVRKVSFTGSTETGKKLMQQSASTLKRLSLELGGNAPFLVFDDADLDAAVEGAIASKFRNSGQTCVCANRFLVQDSIYDAFAEKLQKAVSKLKVGNGMDEGVDQGPLINDDAVETVKAHIEDAVTKGARIALGGKPHALGGTFFEPTILLDVPKTARLAREETFGPVAALFRFTDEAEAIAMANDTEFGLAAYAYTKDLARAFRVSAALDYGIVGMNEGLISTAIAPFGGRKESGFGREGSKYGVSDYLDIKYTLMGGLG

SEQ ID NO: 14674 - protein, 314 aa, Arabidopsis thaliana
MAEEIRFFELNTGAKIPSVGLGTWQADPGLVGNAVDAAVKIGYRHIDCAQIYGNEKEIGLVLKKLFDGGVVKREEMFITSKLWCTYHDPQEVPEALNRTLQDLQLDYVDLYLIHWPVSLKKGSTGFKPENILPTDIPSTWKAMESLFDSGKARAIGVSNFSSKKLADLLVVARVPPAVNQVECHPSWQQNVLRDFCKSKGVHLSGYSPLGSPGTTWLTSDVLKNPILGGVAEKLGKTPAQVALRWGLQMGQSVLPKSTHEDRIKQNFDVFNWSIPEDMLSKFSEIGQGRLVRGMSFVHETSPYKSLEELWDGEI

SEQ ID NO: 14675 - protein, 415 aa, Nocardioides sp. JS614
MARISRKNVLVICLAGGEGKRLMPLTADRAKPAVPFAGIYRLIDFALSNVVNSGFLKVVVLTQYKSHSLDRHVTQTWRMSTMLGNYVTPVPAQQRVGKHWYLGSADAIYQSLNLMRDERPDYVVVVGADHVYRMDFYQMVKAHAESGAACTVAAIRQPIELADQFGVIDVHPDDPSRIREFLEKPTDPVGLPDSPGEVLASMGNYVFDADALVEAVTRDATEIGSKHDMGGDIVPAFVRRQQAAVYDYKDNDVAGSTDRDRGYWRDVGTLGSYYAAHMDVVSPLPVFNLYNFDWPIYTSYGPQPPAKLVQGASGDLPGVDEAVLSPGVVVTGGQVQRSVLSPSVRVDTGAEVTGAVLMNGVYVGAGAVVRNAILDKNVVVPPGAQIGVDPEADRARGFVVEDGLTILGKDQAFPT

SEQ ID NO: 14676 - protein, 572 aa, Magnaporthe grisea 70-15
MVLSRHVNPDDIVQHLHNSSLKEQDGDNDTRTQAAISHLTPYSSRYASNVSLPKYKLPKEGAEADTVYSMIRDELDLDGKPNLNLASFVGTYLEDNAQKLMVENIAKNLSDADEYPAMISMQQRCVSILAHLWNVQKGEKAIGSATTGSSEAIQLGGLAMKRRWQEARRAAGKDDSKPNIIMGANAQVALEKFARYFDVEARILPVSEKSRYRLDADMVRDNIDENTIGIFIILGSTYTGHYEPIEEISEILDKYQAETGHDIPIHVDGASGAFIAPFTHAQAGGPKWDFSLPRVKSINTSGHKYGLVTAGVGWIVWRDESFLPKHLIFELHYLGGTEESYTLNFSRPGAQVITQYFNLVHLGFSGYRAIMENCLANARLLSKSLEATGWYTCVSDIHRRVETAGSNGSNGKQKEPEVTPEHAKETSADYVAGLPVVAFCFSDEFRRQFPHVKQETVSVLLRARQWIIPNYALPPNEEKTEILRVVVRESMSLDLLDRLLSDICEVTQKLMDEDELDLNVLQGSRHKGPCTKADVSKEGRAQAKKERDDRHKKHQATGRTGRMETGVHRSTC

SEQ ID NO: 14677 - protein, 712 aa, Erwinia carotovora subsp. atroseptica SCRI1043
MSRIIMLIPTGTSVGLTSVSLGVIRSMEQKGVRLSVFKPIAQPRSGDNTPDQTTTIIRANSAINAAEPLAMSRVEALLSSNQQDVLMEEIIARYHENTKDAEVVLVEGLVPTRKHQFANALNYEIAKTLNAEIVFVLALGNDSPAQLKDRIELARSSFGGSKNKNITGVIINKLNAPVDDQGRTRPDLSEIFDDSTKASVANIDPKQLFANSPLPVLGCIPWSFDLIATRAIDMAKHLNARIVNEGDIQTRRVKSVTFCARSIPHMLEHFRPGSLLVTSADRPDVLVAACLAAMNGVEIGALLLTGGYEMDPSIAKLCERAFQTGLPVFMVDTNTWQTSLSLQSFNLEVPADDRQRVEKVQEYVARHIDTQWIDSLSAESERSRRLSPPAFRYQLTELARKAGKRIVLPEGDEPRTVKAASICAERGIAHCVLIGNPEEIQRVAAAQGVELGKGIEIVDPIVVRERYVARLVELRKSKGMTEVVAREQLEDNVVLGTLMLEQGEVDGLVSGAVHTTANTIRPPLQLIKTSPGSSLVSSVFFMLLPEQVLVYGDCAINPDPTAEQLAEIAIQSADSATAFGIDPRVAMISYSTGNSGAGSDVEKVREATRLAQEKRPDLVIDGPLQYDAAIMADVAQSKAPNSPVAGKATVFIFPDLNTGNTTYKAVQRSADLISIGPMLQGMRKPVNDLSRGALVDDIVYTVALTAIQATQL

SEQ ID NO: 14678 - protein, 513 aa, Streptococcus agalactiae NEM316
MSILEVKNLSHGFGDRAIFENVSFRLLKGEHIGLIGANGEGKSTFMSIVTGHLQPDEGKIEWSKYVTAGYLDQHTVLEKGQTVRDVLRTAFDELFKTEARINDIYISMADDGADVDSLMEEVGELQDRLESRDFYTLDAKIDEVARALGVMDFGMDSDVTELSGGQRTKVLLAKLLLEKPDILLLDEPTNYLDAEHIDWLKRYLQNYENAFVLISHDIPFLNDVINIVYHVENQDLVRYSGDYTNFESVYAMKKAQLEAAYERQQKEIADLQDFVNRNKARVATRNMAMSRQKKLDKMDIIELQAEKPKPSFEFKESRTPGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 14679 - protein, 417 aa, Novosphingobium aromaticivorans DSM 12444
MASSAMTLNTPRIPVGKSFWQSGHRPTLFAAFLYFDIAFMVWVILGPLAPIISKELGLDPAQKGMMVAVPTLAGAVIRLVNGLLVDRIGPKRTGIISQVVVIAGMFAAWWFGISSYEGTLALGVILGFAGASFAVSLPLASRWYPPEHQGKAMGIAGMGNSGTVFASLFAALLAKSFGWTNVFGLALIPLVAVFAFYLVAAKDSPEQPEPKPLSAYASVLKEQDAWWFMLFYFVTFGGFVGLSSSLPTFFADSFGVTPVIAGYCTAAAVFMGSMLRPLGGALADRFGGIRTLSVVYVVAGALLAVIAAVSTQGLALAIALFVAVMGTLGVGNGAVFQLVPQRFRKEIGVMTGLVGFGGGVGGFYLASSLGAIKKATGSASLGFLIFAALAVVALVGLTAVKRRWRTTWGAALGGARI

SEQ ID NO: 14680 - protein, 483 aa, Oryza sativa Japonica Group
MTTPHGLLQYSSGAFSDQVPADDSAEEHGVKDHAMLAPFTAAWQTAISPPLVIERSEGCYVYDVNGTKYLDALAGLLSTALGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGLPTLHQDFDLPGRFVLHTDCPHYWRFHLPGETEEEFATRLADNLENLILKQGPETIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 14681 - protein, 400 aa, uncultured marine bacterium 582
MALLSDTLARVKPSPTVAMSSKAIEMRAAGRDIISLSAGEPDFDTPENIKSAAIAAILAGKTKYTAPDGIIELKQAICDKFLRDNALRYRPEQVSVGTGGKQVLYNALMATLNPGDEVIIPAPYWVSYPDMVYLAGGEPVILETSVERGFKLSAEALEAAITPRTKWFIFNSPSNPTGAGYHWDELRALTEVLQRHPHVWILSDDIYEHLVYDNFKFCTPAEVAPDLMDRTLTVNGVSKGFAMTGWRIGYAAGPRALIAAMRTIQGQSTSNPCTVSQWAALEALNGPQDYIASNNILFRTRRDLVVAQLNAIDGITCPTPEGAFYVYASIDGLIGKTTAAGVLLANDEAFAMQLLEEANVAIVFGAAFGLSPCFRVSYAASEDTLKAACTRIAEFCAALT

SEQ ID NO: 14682 - protein, 397 aa, Solibacter usitatus Ellin6076
MQAAVNPIADRISSISVSSTMKVSAEAEKLRSEGVDVVDFGAGEPDFPTPDNIKQAAVRALEQNFTKYTAAGGTAELKKAVCEAHARDFGTDYKPAECLITVGGKHVIFNLIQALVNPGDEVVIPVPYWVTYKDVVNYAGGKCVFVDTDESQGFALTAAMLEPHLTARTRLVIINSPSNPSGAVVDRAEFEKIFQLTSSRGIYLMTDECYCKFLYDSQPFSIASLPGAKETVLVAGSLSKTYAMTGWRIGFGLVPQAIVGAMTKLQSHSTSNPCSISQKAAVEALRGPQESVAIMLAEYHKRRDYVVERLRAIPGVKCAMPQGAFYAYPNVGVVLGGKSGIANTLQLSERLLAESHVAVVPGEAFGTDQHIRLSYATSMHELGRGLDRIHEFIVKNS

SEQ ID NO: 14683 - protein, 590 aa, Oryza sativa Japonica Group
MTAAAASHAPLPGRRHPAARRLSAAATRLPLPPDLAEGRPPGRAPPPIPPLFPPRRLPSGRLRPPPAVAVVGGGEKGRRWEGEEGEEMAGRWRRENERGGGGEDEKGGGENRIRTTKGLPAVIHDLHSRLVTLLVTAHFFQASESEIRQSNIYKVTVPVFGRGVLYDVDLATRSRQISFCTDSIKPINLRGHVDSMVHEVEVSNMQTLYVILQLGYFAQWGEDGVVDIKYEMGNLILLIANRCLLGKQFGESKLEQVSTLLHELFDNGFHLISLFFPYLPTPQHRRRDKARAMLGEMIHEAVRSRRNSGVAEDDVLQKFLDSKYINGRCMTENEIAGLLICMMFAAQHTSSSTSTWTGACLLSHGHRSYLAAAIQEQKRIIQQHGDRINWGILLQMTTLTHCIKEALRLHPPANLLIRHASKSFSVQTRQGHRYQIPKGHTLATCTTVGNRLPYIYKDPNVYDPSRFGPGREEDKVGGKFSYTPFSAGRHVCLGEDFAYMQIKVIWSHLLRNFDLELISPFPEEEWEKFIPGPKGGGGDGRGKGWRKRRTGGRPAAGGRGCGAHAAAPRVGGRGGAGGESTREAMAQRQR

SEQ ID NO: 14684 - protein, 556 aa, Rhizobium leguminosarum bv. viciae
MYRYDEFDHAFVTERVEQFRDQVERRLSGELAEDAFKPLRLMNGVYLQLHAYMLRIAIPYGTLSSRQLRMLAHIARTYDRGYGHFTTRQNLQFNWPKLSDIPDALADLASVEMHALQTSGNCIRNVTADHFAGAAADEIADPRPYAEILRQWSSVHPEFSFLPRKFKIAVTGAERDRAAIQVHDIGLHVKKNDKGEIGFAVYVGGGQGRTPMIAKLIRDFLPEEDLLSYTTAIVRVYNLHGRRDNKYKARIKILVHETGTEELTRQVEAEFAALKDTELKLPEKDVQSIAAYFAPPDLPQRAEGWENLARWKKADSGFSRWVQQNVQPHKNPDYGMVTISLKPIGGIPGDASDAQMDAIADLAEEYAFDEIRVSHEQNLILPHVALADLEAVYRGLVAINLAEANAGLITDIIACPGLDYCALANARSIPLAQEISRRFGNAERQAEIGELKIKISGCINACGHHHVGHIGLLGVEKKGAELYQITLGGSGDEHTSIGEIIGRGFEPDRVTDAIETIVDTYLGLRLDHSENFLAAYRRVGPQPFKTALYGSAAEAA

SEQ ID NO: 14685 - protein, 253 aa, Arabidopsis thaliana
LSENSNMSPRISFSRDFCQSDAIPIEKRPLRSSNSKPSSLNSSIDFDFCIPGGVNSGESFDQGSWSADELFSNGKILPTEIKKKPEPGKKEPEPKPVKSKPDSRKQRKQQNEEQQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14686 - protein, 307 aa, Solibacter usitatus Ellin6076
MRMLLNQGHDVTVVDNLSKGYRHNVPAERLHEIDLADTQAIAALLREKKCEAVIHFAAFIAVGESMREPAKYFTNNVCGSLSLLDAMTQAGVKHLVFSSTAAVYGDVKKSPITEDFPIQAVNPYGESKVMVETLLGWFDQIHHLTSVCLRYFNASGCDPEGGLGEEHEPETHLIPLVLRAVQTGKPITVFGGDYPTPDGTCIRDYIHVNDLAQAHILAVEYLIKGGASDQFNVGTGTGHSVLEMIHAVEEVTGKKVPYVVGARREGDPPSLVASSKKLRERLGWAPRYEELKVIVEHAWRFANKRAG

SEQ ID NO: 14687 - protein, 399 aa, uncultured marine bacterium 582
MTLSQGRSYLAIPGPSVVPDQVLQAMHRAAPNIYEGALVELTHGLVPDLRRVARTQGEVAMYIANGHGAWEAALSNVVAAGERVLCVATGRFGVGWGEMAQALGIEVDMVDFGLHAPLDPERIGTALRRDHAQKLKAVLISHVDTSTSVVNDVAAVRAELDRLGHPALLMVDCIASLACDRFEMDAWGVDVMVAASQKGLMLPPGMGFVFFNDHAAQSRKAMTRVSRYWDWQPRSRPELYYEYFNGTALTHHLYGLRVSLDMLHDEGMEQVWARHETLAQAIWAACDAWSSGGDLRLNVGDPAHRSRAVTAAALTAPDATRLRQWLSERAGVTLGIGLGMAPPGDPACDGFFRFGHMGHINAHMVLGMLSSVQAGMAALDIAHGAGGMDAATAIVADCA

SEQ ID NO: 14688 - protein, 78 aa, Xanthobacter autotrophicus Py2
MSDIAERVKKIVAEHLGVEPEKVTESASFIDDLGADSLDTVELVMAFEEAFNCEIPDDAAETILTVGDAIKFLEKNAA

SEQ ID NO: 14689 - protein, 167 aa, Zymomonas mobilis
MTEKMISVCGSGFDVHCFEAGDHIMLGGIKIPHDHGLAGHSDADVALHALTDALLGAIADGDIGTHFPPSDPQWKGANSTQFLEYAVALAKKAGAIIDHADVTVICEAPKVGPYRPAMRKHIAQILGLPEQRVSIKATTTEKLGFTGRKEGIAAQAVTSIRLPDILC

SEQ ID NO: 14690 - protein, 367 aa, Bacillus pumilus SAFR-032
MNQLICHHCGKKYEMTPTLWKCDCDGVLNLVKDTPKIDVAAWNHYPNSLWRYVETMPFSKGSNTWETVTMGEGQTPLIVLDPHEPNTYVKVDYMMPTLSFKDRGAAVLMTHAKELGVSKVIADSSGNAGTAIAAYAARCGIACDIYLSDDTSPKKVAQIKAHGATIKEIHGTREDIAAAAQKAVDNEKVFYASHVYNPYFFEGTKTYAYEIYEQLNGAPDTLIIPVGNGTLLLGAYDGFKELFENGLILKIPKIIAIQAKNCAPLVKAYQNEEKSASPVTNKGTLAEGIAIAAPARSKQILEAVQDTNGTFIDIEEDEILNARSKLSEKGFYVEVTSAVNLAGYMKYQKKPEETIVIPLCGAGIKSK

SEQ ID NO: 14691 - protein, 174 aa, Glycine max
MDHDKTGCQAPPEGPILCINNCGFFGSAATMNMCSKCHKDILLKQEQAKLAASSIGNIMNGSSSSTEKEPVVAAAANIDIPVIPVEPKTVSVQPLFGSGPEGSVEAKPKDGPKRCSSCNKRVGLTGFNCRCGDLFCAVHRYSDKHNCPFDYRTAAQDAIAKANPVVKAEKLDKI

SEQ ID NO: 14692 - protein, 346 aa, Cytophaga hutchinsonii ATCC 33406
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 14693 - protein, 304 aa, Oryza sativa Japonica Group
MAVAARLRSAGARLVVGPAAMAVGRGGGGEGRWMGTATAEAAAGIARWEPMGAREYYDYRRAIYGDITHKAILVDAAGTLLAPTEPMAQVYRTIGEKYGVNYSEDEILMRYRRAYAQPWGRSRLRYVDDGRPFWQHIVSSSTGCSDLQYFEELYQYYTTAKAWQLCDPDAKYVFEALRKAGVKTAVVSNFDTRLRPLLQALNCDHWFDAVAVSAEVAAEKPNPTIFLKACEFLGVKPEEAVHIGDDRRNDLWGARDAGCDAWLWGSDVYSFKENQAHIIKSGLLCRSQKGSELRCKESFVRWVT

SEQ ID NO: 14694 - protein, 363 aa, Burkholderia thailandensis E264
MPVWYRQLADKPTRPNGRSSGTRAPRATVSQKNAASRVKLRLRMRRSRCSARIPLFANSSSVGETPACRHPRARRRFAGSITTRGGLASPASGFRLMHPMLNIAVKAARRAGQIINRASLDLDLIEIRKKQQNDFVTEVDKAAEDAIIETLKTAYPGHAILAEESGESGDESEFQWIIDPLDGTTNFIHGFPYYCVSIALAHKGVVTQAVVYDPNRNDLFTATRGRGAYLNDRRIRVGRRDRLADALIGTGFPFREKDGLDAYTRLFTEMTQACTGLRRPGAAALDLANVAAGRLDGFFEQGINVWDVAAGSLLITEAGGLVGNYTGDSDFLHRREIIAANPKVYAQMIPILSRYTHTRPADE

SEQ ID NO: 14695 - protein, 274 aa, Arabidopsis thaliana
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHVSVSLLTKFTIQSKVSIIG

SEQ ID NO: 14696 - protein, 301 aa, Arabidopsis thaliana
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHVMGLLGWTIHWCCTCCSLPRYSHQSHPIQVQKLKLIEFYLKSGFCS

SEQ ID NO: 14697 - protein, 404 aa, Streptococcus pyogenes
MLTSKHHNINKLVWRYGLTSAAAVLLAFGGGASSVKADDNDQAQQQKERSQKIQEIKSYIETKYPRTTDRRYWDNSNGIFGSSAFDNDLYQKDLDEFTQKALTGIVELVDKAGIKGDKGEPGEPGKPGAQGIPGPKGDKGETGERGEKGEAGIQGPQGEAGRDGAPGKDGAPGEKGEKGDRGETGAQGPVGPQGEAGKDGAPGKDGAPGEKGEKGDRGETGAQGPVGPQGEAGKDGAPGKDGAPGEKGEKGDRGETGAQGPVGPQGEKGETGAQGPAGPQGEAGKPGEQGPAGQPGEKAPEKSPEVTPTPEMPEQPGEKAPEKSPEVTPTPETPEQPGEKAPEKSPEVTPTPEMPEQPGEKAPEKSKEVTPAPEKPADKEANQTPERRNGNMAKTPVANNHRRL

SEQ ID NO: 14698 - protein, 480 aa, Zea mays
MAVSHNVGSKHGVAPLEVSVEAGNGGAAEWLDDDGRPRRTGTFWTASAHIVTAVIGSGVLSLAWAIAQLGWVAGPAAMLLFAFVTYYTATLLAECYRTGDPETGKRNYTYMDAVRSNLGGAKVAFCGVIQYANLVGVAIGYTIAASISMKAVRRAGCFHAHGHADPCNSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVSVAAAAGSIADVIDALKVYRPFSG

SEQ ID NO: 14699 - protein, 210 aa, Kineococcus radiotolerans SRS30216
MTASTLVLWRHGQTPFNAENRFQGQLDVPLDDVGRAQAAAAAAHLSALPLDAVVSSDLVRAVDTATALTSLTGLALTRDPALREVDAGEWQGLLGDEIARRWPEEHAAWRRGADVRTGGGETRSELGARVAGAVERHAAAVPGGGTLLVASHGAALKAGVLRLLGLPPTAGDAFAGLRNAHWAVLRRRSRAWALEEYNAGPAGARVGAEG

SEQ ID NO: 14700 - protein, 184 aa, Zea mays
  misc_feature (79)..(79): Xaa can be any naturally occurring amino acid
  misc_feature (92)..(92): Xaa can be any naturally occurring amino acid
MGQQSLIYAFVARGTVVLAEYTEFTGNFTTIAAQCLQKLPASNNKFTYNCDGHTFNYLVEDGFTYCVVAVESVGRQIPXAFLDRVKEDFTKXYGGGKAATAAANSLNREFGSKLKEHMQYCVDHPEEVSKLAKVKAQVSEVKGVMMENIEKVLDRGEKIELLVDKTENLRSQVKDSFRMYTLAI

SEQ ID NO: 14701 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILAYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 14702 - protein, 293 aa, Oryza sativa Japonica Group
MEQYEEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMER

SEQ ID NO: 14703 - protein, 530 aa, Oryza sativa Japonica Group
MGQCPSAPRYHHHRHPPRNPPPPSPPPADHAPPQPLPTPDDDAPAAEDHTADLPDDLLAVVFGLLGSADRKRCSLVCRRWLSVDAASRLRLALDARAPLHAALPGILARFPAVSKLALKCDRRAESVADPTLALLADRLGPALRRLKLRSIRLVTDDGVAALAAAATNLRKLSVGSCTFGAKGIEAVLRSCLHLEELSIKRLRGLAQSEPVAVSSLCLHSLCLKELYNGQCFSSLITNSPNLKTLKIIRCSGDWDPVLQDLPQDAMLAELHLEKLQVSDRGVSALSGLEVLYLAKAPEVTDVGLGKLATRSPRLRKLHVDGWKANRIGDRGLAAVAQKCAALQELVLIGVNLTSASLELIAANCPALERLALCGSDTFGDAEISCVATKCAALRKLCIKACPVSDAGMDKLAQGCPRLVKVKVKKCQGVTPECAERLRASRNGALAVNVDTPGGAGELQDARSVDESGVLENAGSDTLPDDLDDRIGGPDLSCGSSGRPSGWKARMGAFMSRSLSVSMFRRRPRVSCYES

SEQ ID NO: 14704 - protein, 445 aa, Shigella flexneri
AVMGRNLALNIESRGYTVSIFNRSREKTEEVIAENPGKKLAPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRSALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 14705 - protein, 526 aa, Chlamydophila pneumoniae TW-183
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 14706 - protein, 252 aa, Arabidopsis thaliana
LSENSNMSPRISFSRDFCQSDAIPIEKRPLRSSNSKPSSLSSSIDFDFCIPGGVNSGESFDQGSWSADELFSNGKILPTEIKKKPEPGKKEPEPKPVKSKPDSRKQRKQPNEEQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14707 - protein, 760 aa, Xanthobacter autotrophicus Py2
MASNISEDLRSGALVYHRLPKPGKLEIQATKPLGNQRDLALAYSPGVAAACEAIAADPLLAAELTIRANLVAVVSNGTAVLGLGDIGPLAGKPVMEGKAVLFKKFSGIDVFDIEIDAKTVERMVDVVSALEPTFGGINLEDIKAPECFEVEAQLRERMKIPVFHDDQHGTAIIVGAAVRNAMEVGKRKIEELKIVASGAGAAALASLNLLLTLGAKKENIWVCDIEGVVYDGRNTLMDPYKEKFAQKTDKRTLDEVIEGAHIFLGLSAGGVLKPEMVKKMADHPLILALANPVPEIMPEVAREARPDAMICTGRSDFPNQVNNVLCFPYIFRGALDVGATDINPEMKMAAVEAIAALARETPSDVVARAYGGETRAFGADSLIPSPFDPRLILRIAPAVAKAAMDTGIATRPIADMDAYIERLDHFVFRSGFIMRPLFAQAKRNIKRVVYAEGEDERVLRAVQAVVEEGIARPIIVARPNVLETRLKRFGLSVRPGHDFDLINPEDDPRYRDYVRDYVEIAGRRGVTPDAARTLVRTHPTVIAALAVKRGEADAMLCGIEGRFTRHLRQVRDIIGLAPGVKELAALSLLITSHGNFFICDTQIQTEPTAADLAEMTVLAAAHVRRFGLEPRVALLSHSNFGSHETLSAKRVRSALSIIREREPNLEVDGEMQADSALLEDIRKRVLPNSTLTGAANVLVMPDLDAADIAFNMLKVLGDALPVGPILMGTAKPAHILGPSVTARGIVNMTAVAVAEAQTEA

SEQ ID NO: 14708 - protein, 295 aa, Oryza sativa Japonica Group
MPMSDPTAAVIPKPGGIGVGGGGGDDEEPVEIREVWADNLEEEFALIRDVVDEFPFVAMDTEFPGIVCRPVGAFRSPADYNYATLKANVDMLHLIQLGLTFSSPRGELPALGPGRRRCVWQFNFREFDDARDIFASDSIELLRRSGIDFRRNSERGVDARRFAELLMSSGVVLNDSVYWVTFHAGYDFGYLLKILTCSSLPDTQAGFFKLMKIYFPTVYDIKHLMKFCNSLHGGLNKLAELLDVERVGESHQAGSDSLVTSCAFWKLKDSFFAGSTEKYAGVLYGLNAENVVSAH

SEQ ID NO: 14709 - protein, 252 aa, Arabidopsis thaliana
LSENSNMSPRISFSRDFCQSDAIPIEKRPLRSSNSKPSSLNSSIDFDFCIPGGVNSGESFDQGSWSADELFSNGKILPTEIKKNPEPGKKEPEPKPVKSKPDSRKQRKQPNEEQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14710 - protein, 360 aa, Virgibacillus marismortui
GVRWAAPSAGKIKSIYYATGDIVTVGTIIMEIDTGKDAVITTKAEQQVLVDEGAASALDSQNSFRNPYNRILAAPYTRKIARELGIDIEQIKGSGPAGCVLEEDVYRFSNQSNACNDNQGESHTGIREDAEGTTIPFKGIRKQIATKVSHSLLTIPHVTHFDEVDVTNLNELRKTLKLSGDSISLAAFLVKATVICLKEHQLFNARLDEENEVIRLLTDYHMGIATNTEAGLLVPVIYDVDQKSIRTINKQMKELTIKAREGKLTAGDMKHGTFTVNNVGPLGGTGATPIINHPQTGIMTFYKTKRMPIVLDDDEIAIRSIMNISVSFDHRVIDGAQSIAFTNRFIELVENPNKLLLELI

SEQ ID NO: 14711 - protein, 742 aa, Oryza sativa
  misc_feature (34)..(34): Xaa can be any naturally occurring amino acid
  misc_feature (73)..(73): Xaa can be any naturally occurring amino acid
MGVHAEGHHQAEEHPRGQARATVQLRGLHDALHXIYNMCTQKPPHDYSQQLYDKYRESFEESFTTSTGSHSRXYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 14712 - protein, 520 aa, Saccharomyces cerevisiae
MNTNVPIFSSPVRDLPRSFEQKHLAVVDAFFQTYHVKPDFIARSPGRVNLIGEHIDYCDFSVLPLAIDVDMLCAVKILDEKNPSITLTNADPKFAQRKFDLPLDGSYMAIDPSVSEWSNYFKCGLHVAHSYLKKIAPERFNNTPLVGAQIFCQSDIPTGGGLSSAFTCAAALATIRANMGKNFDISKKDLTRITAVAEHYVGVNNGGMDQATSVYGEEDHALYVEFRPKLKATPFKFPQLKNHEISFVIANTLVKSNKFETAPTNYNLRVIEVTVAANALATRYSVALPSHKDNSNSERGNLRDFMDAYYARYENQAQPWNGDIGTGIERLLKMLQLVEESFSRKKSGFTVHEASTALNCSREEFTRDYLTTFPVRFQVLKLYQRAKHVYSESLRVLKALKMMTSATFHTDEDFFTDFGRLMNESQASCDKLYECSCIETNQICSIALANGSFGSRLTGAGWGGCTIHLVPSGANGNVEQVRKALIEKFYNVRYPDLTDEELKDAIIVSKPALGTCLYEQ

SEQ ID NO: 14713 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKVESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 14714 - protein, 657 aa, Physcomitrella patens subsp. patens
MLLTRAAVDRHQSLTRASCRSREASHQALCEGLCSENPALYRIVSLVVVRVHCGSDAVGFCNPRKSFWGSFYGVRILPLLCMWRSHCATVQLQFFLRTRPSIATFSLRLCKLWACSRRAGLGVEQVEVELNRIATLRASPLSLVIVPVKACDGSLYNKLVVLRCHLRFAISGCFPQVSSDQWNGPSQVQLTSFTLAHHCGFFGCGKPGSIAVLYRHQHVITEAVLGRLQVSLSSFDTLRELDNNSALYISTHSYISREAHATVTRSSRWGRVETFAPWTRMKCLSIVTNIQYFGHDHSGKEHLVHRLVMPKEVTCESDSKSGTSSMAKLSASEKEKTKLRERQRRAITTKIFAGLRKYGGYNLPPRADINDVLKALASEAGWVVEPDGNTYRSQHFKRVHVMSEQGFSQPSSSLQHSLRQTNPAMNRLNLIPPPTTLNTGFNCTLAGLMADAGELREGNCSTTASPRHHSMGGAAGHHSNSSSMTLIGSGCISNSPFASPASSEGGPPSQRLSQGNPYLAGLSNGFLPSCGQVLSDGRDGDSSGIKEESAAAAAAAYFSADTLDARDFQMQRATLDASHFLNSRDFSGRGSLTNSNNNNMNSLFFNAAQQAPNRFGQRAAPQLPNLMMLSTGHPFLQEQRASNQNTPLGSPRLQDPN

SEQ ID NO: 14715 - protein, 486 aa, Salmonella enterica subsp. arizonae serovar 62:z4,z23:--
MIVAEKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNINDVTAALFMTGYTGNLLAVKLAANAGVTLSWGSWFMAALLPCLVSLLIVPLLVYWLTRPEIKHTPDAPDLARKELAQMGSMARGEWLMLATVGVLLVLWIFGDTLGVDATTASFVGLSILLLSGVLTWEDVKSEKGAWDTLIWFAALLMMANQLKKLGFTSWFGNLIGDSIGSTMHGTSWVIILLLLNAAYFYTHYFFASGNAQIAALYAVFLGVGLHLNIPAAPMALMLAFTSSLYCSLTQYTHARGPILFGAGYVSTGVWWRTGFIISLFNQAVFLTVGLAWWKVLGLY

SEQ ID NO: 14716 - protein, 275 aa, Salmonella enterica subsp. arizonae serovar 62:z4,z23:--
MSNPTIIRLQDGNVMPQLGLGVWKASNEEVITAIHKALEVGYRSIDTATAYQNEEGVGKALKEADVAREELFITTKLWNDDQKRSREALQESLKKLQLDYLDLYLMHWPVPAIDHYVEAWKGMIALQKEGLVKSIGVCNFQIHHLQRLIDETGVTPVINQIELHPLMQQRQLHAWNATHKIQTESWSPLAQGGEGVFDQKVIRELADKYGKTPAQIVIRWHLDCGLVVIPKSVTPSRIAENFAVWDFRLDKDELGEIAKLDQGKRLGPDPEQFGG

SEQ ID NO: 14717 - protein, 442 aa, Xanthomonas campestris pv. vesicatoria str. 85-10
MLAETPLLETTLERELATLAVGRRYGKVVEVVGTMLKVAGVQVSLGEVCELRQRDGTLLQRAEVVGFSRDLALLAPFGELIGLSRETRVIGLGRPLAVPVGPALLGRVLDGLGEPSDGQGAIACDTWVPIQAQAPDPMRRRLIEHPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPYDHSQAAGRLRRLLAKYNEVETLVQVGEYRQGSDAVADEAIDRIDAIRDFLSQPTDQLSAYENTLELLTSVTDDA

SEQ ID NO: 14718 - protein, 460 aa, Oryza sativa
MAREPSPEIDDELFNEVYGKAYSGPVATTTNNVTPRVNDEKRPLEREKSDEEDGPPDPNAVPTDFTSREAKVWEAKAKATERNWKKRKEEEMICKICGESGHFTQGCPSTLGANRRNADFFERVPARDKQVRDLFTERTISQIEKDVGCKIKMDEKFLFVSGKDRLILAKGVDAVHKIIQEGKGKNTSSSPKRDRLRSPVRTTSDIRPRHTDSRWSHSPRSAPRSQSKGYYNERPLDGRSHDDMPKFSKESPQARASANYGAKGRPAQSKSPCQPSYIDDSLRSNDGNNQYAATYVPNTWSTETRGTDSRLSLKFDLPSYPQTLEELEMEFKREAMELAIARDKEEDEENYKHRESLREMRENHMKRVTAMRSMHSRKWDEFLEQSFKRHQQAHPTSYAQTSYPDYDQRATQFAATGPPNDSKSEYPYITDSYSAPRPHAAYSEFEHERHDDFGRTYGRY

SEQ ID NO: 14719 - protein, 301 aa, Aspergillus terreus
MESKVQTNVPLPKAPLTQKARGKRTKGIPALVAGACAGAVEISITYPFESAKTRAQLKRRNHDVAAIKPGIRGWYAGYGATLVGTTLKASVQFASFNIYRSALSGPNGELSTGASVLAGFGAGVTEAVLAVTPAEAIKTKIIDARKVGNAELSTTFGAIAGILRDRGPLGFFSAVGPTILRQSSNAAVKFTVYNELIGLARKYSKNGEDVHPLASTLVGSVTGVCCAWSTQPLDVIKTRMQSLQARQLYGNTFNCVKTLLRNEGIGVFWSGVWFRTGRLSLTSAIMFPVYEKVYKFLTQPN

SEQ ID NO: 14720 - protein, 108 aa, Brassica napus
MESAVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEG

SEQ ID NO: 14721 - protein, 344 aa, Triticum aestivum
MDEAGTSSSAGSAPRGGRPARSGVFYKFTQQDLPAWKPAMTPGYVIAIFLIIGIIFVPLGLICLQASNRVAEIVHRYDIDCVPNAYRSNKQAYIKDSSISKECIQKVKVQYHMKAPIYVYYELDNFYQNHRRYIKSRSDKQLRYGLKYTDSSCSPIEKSDGLPIVPCGLIAWSLFNDTYDFTRGSMGIVVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYVYLITGSLSIFLSILFALIHVKIPRPHGDAAYLSWSRKNGNN

SEQ ID NO: 14722 - protein, 445 aa, Klebsiella pneumoniae
AVMGRNLALNIESRGYTVSVFNRSREKTEEVIAENTGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPVGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 14723 - protein, 445 aa, Klebsiella sp.
AVMGRNLALNIESRGYTVSVFNRSREKTEEVIAENPGKKLVPHYTVKEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTEWNEGELSSYLIDITKDIFTKKDEEGKYLVDVILDEAANKGTGKWTSQSSLDLGEPLSLITESVFARYISSLKDQRVAASKVLTGPKAQPAGDKAEFVEKVRRALYLGKIVSYAQGFSQLRAASDEYNWDLNYGEIAKIFRAGCIIRAQFLQKITDAYEQNAGIANLLLAPYFKQIADEYQQALRDVVAYAVQNGIPVPTFSAAIAYYDSYRSAVLPANLIQAQRDYFGAHTYKRT

SEQ ID NO: 14724 - protein, 253 aa, Arabidopsis thaliana
LSENSNMSPRISFSRDFCQSDAIPIEKRPLRSSNSKPSSLNSSIDFDFCIPGGVNSGESFDQGSWSADELFSNGKILPTEIKKKPEPGKKEPEPKPVKSKPDSRKHRKQPNEEQQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14725 - protein, 254 aa, Arabidopsis lyrata subsp. petraea
LSENSNMSPRISFSRDFCQSDAIPIEKRPLRSSNSKPSSLNSSIDFDFCIPGGVNSGESFDQGSWSADELFSNGKILPTEIKKKPEPGKKEPESKDTKPVKTKPDSRKQRKQNEEQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14726 - protein, 346 aa, Xylella fastidiosa 9a5c
MIDSKQKIAVLGAGSWGTALAALVARHAYPTILWGRDVGVIQSIDIQRQNFRYLPSIMLPQTLRATTDLAAAVSGADWVLVAVPSYAFTETLRRLAPLLSTGVGVAWATKGFEPGSGRFLHEVAREILGGDAPLAVVTGPSFAKEVTLGLPTAVTVHGEYARFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRQAEQHGVELPISEAVRAVLREEITPYAGMKALLAREQKPEYLDILFKANSSL

SEQ ID NO: 14727 - protein, 482 aa, Rhodococcus sp. RHA1
MLEEAAIASVQTGLFIGGKWRDSARTMPVHDPSNGQILCTVADADAAEAREALDAAVAAQPSWAATTPRERSTILMNAHRLLLENVDRLALVMTLEMGKPLTEARGEIAYAAEFFRWFAEEAVRIDGGYMTAPGGGSRFLVTRQPVGPSLLITPWNFPMAMGTRKIGPAIAAGCTSVIKPAAQTPLSILALADILTEAGLPDGVVNVVTTSSPDEVITPLILDGRARKLSFTGSTKVGKHLLELCARTVMRTSMELGGNAPFLVFDDANLDDAVDGAMAAKMRNIGQACTAANRILVHSSVAEEFTRKLTQRMEALPVGRGTEDGVVVGPLIDEAAVAKVSSLVADAVERGASVLTGGEALDRPGNFYPATVLTGVPDDAEMCHNEIFGPVAAISTFETEAEAVERANDTPYGLVAYVYTDSLKRGIRVCEALESGMVGLNQGVVSNPAAPFGGVKESGLGREGGTTGIDEFLETKYIGVAV

SEQ ID NO: 14728 - protein, 460 aa, marine gamma proteobacterium HTCC2080
MEYADQAELDRFMQMHPNIEVIELIMPDFSGIPRCKRIQRSEFKRLFSGTFLSPQSAPLLGVRGNFYETTPYPELGGDPDQIIRPVAGTLAVVPWYESPVAQVLVAYTDESGELDWVDTRCPLVSVLNKFAASGLHPTVATELEFYLLGHSEGERPAPLKGNIPGTQWVQEGIQYCMSDDLFDCDAFLNDVRIASELQDVPLTAIHSEFSPGQWEINTHHQTDVLLAAQHGLLLRRIVKGVARKHGFGATFMAKPFADIPGSGMHIHASVYDAAGANIFAAPEATDPPHLMPRLRHAVAGLGTLLDASMLCFAPNPNSYRRVQAGALAPSGKNWGYDHRDVALRIPRSNEQSRRIEHRVAGADANPYLVLAAVLAGIHWGLGQQGDPGAPVPREADLSEDETSLPIRLDEAIRFFSDSQIMQDYLGEKFTRVYGAIRRGESNDYYSQIPDLDYQWYLRAL

SEQ ID NO: 14729 - protein, 254 aa, Arabidopsis lyrata subsp. petraea
LSENSNMSPRISFSRDFCQSDAIPIEKRPLRSSNSKPSSLNSSIDFDFCIPGGVNSGESFDQGSWSADELFSNGKILPTEIKKKPEPGKKEPESKDTKPVKTKPDSRKQRKQNEEQQEDGVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNG

SEQ ID NO: 14730 - protein, 413 aa, Rhodococcus sp. RHA1
MTRLSPLLAQATPVTVDHGEGCYLYGTDGRRYLDFTAGIGVTSTGHCHPHVVEAARRQIGSLIHGQYTTVMHQPMLELVDRLGSVLPAGLDSLFFANSGSEAVEASLRLSRQATGRPNVIVFHGGFHGRTVATATMTTSGTRFSAGFSPLMGGVHVAPFPNAYRYGWSEEEATAFALKELDYIFATLTAPNETAAFVVEPVLGEGGYVPGNTAFFQGLRERADRYGILLVIDEIQTGFGRTGKFFGHQHFDVRPDIITIAKGLASGFPLSGIAASEALMAKGWPGSQGGTYGGNAVSCAAAVATLEVIEKEDLVANAAARGVQLLDGARTRAIDGIGDVRGLGLLVGSEFTAADGSADRTKASAAQQLAAKKGLLLLTCGAHMNVVRMIPPLIVTAEQIEDALKIWSEVLDEV

SEQ ID NO: 14731 - protein, 307 aa, Bacillus anthracis str. Ames
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSVERRNLLRAYGAELVLTPGPEGMGGAIRQATELAKEHGYFIPQQFKNQSNPEIHRLTTGPEIVEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 14732 - protein, 608 aa, Xylella fastidiosa 9a5c
MSYLVLARKWRPKRFAELVGQEHVVRALSNALESGRLHHAFLFTGTRGVGKTTIARIFAKSLNCEQGTSADPCGRCTACLDIDVGRYIDLLEIDAASNTGVDDVREMIENAQYMPSRGKFKVYLIDEVHMLSKAAFNALLKTLEEPPPHVKFLLATTDPQKLPVTVLSRCLQFNLKRLDEEQIQRQIAKILTAEQITADDAAIIELSKAADGSLRDGLSLLDQAIAYAGGVLREGAVRDMLGTVDRTQVEVMLAALIAGDGDRLLRVIATLAEFSPDWGGVLEALAEALHRIQVQQLVPSVVFAGDGLNVALLAEQTQPEVVQLWYQMAINGRHDLHLAPSPRVGFEMAVLRMLAFRPVPVVAPDLISAEGHGQSVDAPLMASVGRDAHGANGYTMSQSRSDLQSALLQTSIAVPPMGGDDIRMGKSSLLRSTAVAPHQLENVSVWAEQSVLSSSEGAMERVPLTTEVNKVGVGSLDGKITDVGQWLALVERIELSGPSKQLAAHAAFVSHENNVLCLALDPEFEYLQSTRSVADLTQGLTRLLGQAPEVKIEARNIQVETLHERTYRQKSERQQLAEEAFMSDHVVQHLIYQQAAKVVTDSIRPYDE

SEQ ID NO: 14733 - protein, 273 aa, Rhodococcus sp. RHA1
MKLDIYQIDAFAAGPFEGNPAAVMPLTDWLEDSVLQQLAEENNLSETAFYTAGLPADAGPHDPEHPAYHLRWFTPAVEVDLCGHATLATAAQIFEDVHPDADRIQFWTRSGWLHVDRGPDATLVMDFPAEPPVPTAADPRIVAALGIPVRECLKATDLVFVAESEHDIVSMAPDFAVFSPLKVRGIVVTAASDVEGLDFVSRWFGAAAGVQEDPVTGSAHSQIAPYWADVLGRNSLVGRQLSARGGTVHCAVRGDRVHLSGAYRRYLRGTVEF

SEQ ID NO: 14734 - protein, 303 aa, Burkholderia thailandensis E264
MTFMAYKTIEDTIGNTPLVQIVRLPDDEIRARNNVILAKLEGNNPAGSVKDRPALSMIRKAEERGRIKPGDTLIEATSGNTGIALAMVAAIRGYKMVLIMPEDLSVERRQSMAAYGAEIVLTPVKGGMEFARDLADQMQREGKGVILDQFANPDNPLAHYEGTGPEIWRETEGRITHFVSAMGTTGTIMGTSQYLKERNPAVEIVGAQPEEGSRIPGIRKWPEAYLPKIFDRSRIDRVENVSQAASEAMARKLAAVEGIFCGISSGGACEVALRVARQVENATIVFVVCDRGDRYLSTGVFPA

SEQ ID NO: 14735 - protein, 226 aa, Streptococcus thermophilus CNRZ1066
MDELKKLAGVYAAGFVEDGMVVGLGTGSTAYFFVEEIGRRIKEEGLSVVGVTTSSQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 14736 - protein, 308 aa, Shewanella violacea
GTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 14737 - protein, 311 aa, Clostridium thermocellum ATCC 27405
MQEKIATREAYGKTLAEIGSDPRIVVMDADLSKSTKTEYFKNKYPERFFNMGIAEANMMAAAAGIASCGKVVFASTFAMFASGRAFEQIRNSICYSNLDVKIGASHSGLTVGEDGASHQTIEDIAIMRVIPNMTVVCPADAVEARHATIAAYKTPGPFYLRLTRLAVPVIFDENYKFELGKGVTIRDGNDVAIIATGLMVSKAIEAADILKREGINARLINIHTIKPIDRDIIIKAATETGTIVTCEEHSVIGGLGSAVAEVLVETCPVPMRMVGVMDRFGKSGKPDELLKMYGLTAENIVEKVKEVLKNK

SEQ ID NO: 14738 - protein, 448 aa, Bacillus licheniformis ATCC 14580
MNQSFVEKSKQYLWLPFTQMKDYDENPLIIESGQGIKLKDIDGRVYYDGFSSVWLNVHGHRKKELDEAIKKQLGKIAHSTLLGMTNVPATELAEVLIKITPENLTRVFYSDSGATAMEIALKMAFQYWKNIGKPEKQKFISMKNGYHGDTIGAVSVGAIELFHHVYGPLMFESFKVNVPYVYRSKSGNPDECRDECLAELERLLSERHDEIAALSVESMVQGASGMIVMPEGYLAGVRELCTKYDVLMIVDEVATGFGRTGKMFACEHERVQPDLMAAGKAITGGYLPIAVTFATEEIYEAFYDDYNKLKTFFHGHSYTGNQLGCAVALENLRLFESEKIVAQVAEKSKILESLFHDLAALPHVGDIRQLGFMSGIELVQSKETRQPYPPEERIGYRVSLKMRELGMLTRPLGDVVAFLPPLASTADDLRAMVSIMKEAIQEVTGRAY

SEQ ID NO: 14739 - protein, 513 aa, Bacillus cereus E33L
MIDQKEQSNTFEERVETIKQGGAPKYHDQNKAKGKLFVRDRLALLFDNGEYVEDALFANCEQTGLPADGVITATGKIHGRTACVMANDSTVKAGSWGARTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSVSGCGDVLCKTEEDAITQARQYISYFPNNYLEKTPLVTPQEPKQFDKTLEQIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERDSFIAEKREEYKKDIDIYHLASEMVIDGIVHPNNLREELKGRFEMYMSKYQVFTDRKHPVYPV

SEQ ID NO: 14740 - protein, 232 aa, Saccharomyces cerevisiae
MDRKAVEEKRIVISIGGGHATGVGAIALDLQNTFKSLYNSINIRVINLDNMIEGNIKSYNNNDYDFDNILNLVYEKHAVTSQNDMIQHDYEDPIDLIIVCGCYALYDKRINEISQLKVFLDSDADKRLISLIKKKNVGSNEQLAQLITEYMDHLRPEMQQYIEPTRTFADLIIPSTNENLGRAVLVDGIVKAIEDTKSQIEGNNTNNKIRPRLWDFEAETMDLEKDRYYDLS

SEQ ID NO: 14741 - protein, 323 aa, Bacillus thuringiensis serovar konkukian str. 97-27
MSNLFTTVKEKVQGKGISIVLPEGTDERILGAAERLAKEELVKPILVGNKEEISAKAASMNLTLAGVDIYDPATYEEMDAMVASFVERRKGKATEEDARKILKEENYFGTMLVYMGKAHGLVSGAAHSTADTVRPALQIIKTKPGVTKTSGVFIMVREEEKYVFADCAINIAPNSQDLAEIGIESAKTAELFGIDPRVAMLSFSTKGSAKSPETEKVVEATRIAKEMAPELTLDGEFQFDAAFVPSVAEKKAPGSTIKGDANVFVFPSLEAGNIGYKIAQRLGNFEAVGPILQGLNMPVNDLSRGCNEEEVYKLALITAAQAL

SEQ ID NO: 14742 - protein, 542 aa, Arabidopsis thaliana
MERLVVLPFSIGCISVSSVAVLSPLSKPHHHHSRQVIREQEEEDNMKNVFKFLAVSKPEISIGINRIFKSFKTISQLFADKDEEKEEVETSGMEIGVPTNVKHVSHIGWESGLTAATGPGDLGPRVSGLPRNASVADALRDGVWWINGSRSRNPIIQLLKNCLPLSSVVNLQVDAEDDLFMWKVGGSEASVGFSSAATWIHLNPVGEKVDWHKAIWFKGRIPKHAFISWVNIRHRLPTRDKLLSWGLHEKSEITSLLGPMFLLLHCLRMGIAHQATVYTLWRERNTRLHTSSSRPAAGLIMEIKNLIRTHLDPLSRAQRIGPNAFCLPIERRREIETSMGLIVDDDNDGEVLIPPPNFSMVEDGIYRSGFPELENFGFLSTLNLRSIIYLCPEPYPEDNLKSLASNNIKLFQFGIEGKTDPPTPMPKDTVLSALRVLVDVRNHPILIHCKRGKHRTGCLVGCLRKVQNWCLSSVLEEYQKCAGLKWRQRDLRFIEDFDVLRLKQCLYSIIYQYNGYGLKRRKLLYQEENVVQEQQKPQATKG

SEQ ID NO: 14743 - protein, 164 aa, Triticum aestivum
  misc_feature (10)..(10): Xaa can be any naturally occurring amino acid
  misc_feature (36)..(36): Xaa can be any naturally occurring amino acid
MAPIGVGSTXLPDGQLAWFDESEQMQQVSIHSLAAXGKKVILFGVPGAFTPTCSNQHVPGFITQAEELKAKGVDEILLVSVNDPFVMKAWAKTYPDNKHVKFLADGAAAYTKALGLELDLSEKGLGLRSRRFALLADDLKVTVANVEEGGQFTISGAEEILKAL

SEQ ID NO: 14744 - protein, 503 aa, Physcomitrella patens subsp. patens
MDVDSVTEAELKENGFRSTRRTKLVCTIGPASCAPEQLEALAMGGMNVARLNMCHGTREWHTQVIRNVRSLNSEKGYSVAIMMDTEGSEIHMGDFNGAPSVKAEDGEEWIFTVRKLDSLPERTTVVNYDGFAEDVKIGDELLVDGGMVRFEVIEKIGPDVKCKCTDPGLLLPRANLTFWREGRLVRERNAMLPTISSKDWIDIDFGIAEGVDFIAISFVKTSEVIKHLKSYINARAPNGSIGVFAKIESSDSLKNLEDIIRVSDGAMVARGDLGAQIPLEQVPSVQQGIVNVCRELNKPVIVASQLLESMIEYPTPTRAEVADVSEAVRQRADALMLSGESAMGLFPEKALSVLRTVSLRMEEWCRENKAHASDRLPELSSALHDRISENICNSASQMANRLGVDAIFVYTRRGYMASLLSRSRPDCPIFAFTDTQAVRQRLNLQWGLIPFRLDLSGDMESNLRRTFALLKARGMMKKGDLIVAVSDISTSDVMQSIQVRRIP

SEQ ID NO: 14745 - protein, 714 aa, Bradyrhizobium sp. ORS278
MITDAQRAAGTELTRVVKEAAAGVVGRGIVRIDPADARLLGMVAGDVARIRGNRETHARILFLNESLRGKGIVVLDGIIRRNAGVQIGESVTLSLAQPNAATSVTLSVTGASLSSGGKSRVVAALEHIPITAGDSIRLPLMGGNSTSCEVTATRPSGPVLITTETRLDISAREVGDADRSITYEDLGGVDQELQRVREMVELPLRQPELFERVGIDPPRGILFSGPPGTGKTLLARAIAYENKCSFFQISGPEIVAKHYGESEAQLRSVFEQARAKAPSIVFLDELDAIAPKREGLSGDRQVERRIVGQLLTLMDGIRSRGAVTVIGATNLPDSIDPALRRPGRFDREIRFGAPDQQGRRQILEVHSKTMPLSQDVDLDHIARISHGYVGADLAALCREAGMAALRRVAKLTGAIEDVDVGSLFVTAADFDTGFAETRPSALREFLADVPNVSWDMVGGLDKIRQTLIEAVVWPILHADRFAALNLQPAKGVLLHGAPGTGKTLLAKALATEAGVNFISVRGPQLLNQFLGESERAVRDVFSRARSSAPTIIFFDEIDAIAPARSGTDGGTMDRIVSQLLTEIDGIEEFKNVFLLGATNRIDCVDPALLRPGRFDHIIQMPLPDAAARQAILAIYVSKVAVTPDVRIEHLAMRTSGYTGAELANLVHTAARACLRRSVDADSFEPVLGAEDFEAAFAAVDRRPPALQEQRETSR

SEQ ID NO: 14746 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14747 - protein, 467 aa, Lentisphaera araneosa HTCC2155
MEKFDLIVIGGGPGGYVAAIRGAQMGMKVACVEKYSTLGGTCLNVGCIPSKALLDSSEHFHQAKEKFAIHGIQTGDLKVDFTQMIKRKTDVVSNTTEGINYLFSKNQITRLEGLGSFVDANTVKVTAQDGSESQYQGDKFIIATGSKPVDLPFMPCDKKRIITSTEALTLEKLPESMVVIGGGVIGLELGSVYARLGTEVTVVEFMDRIVPPMDKELGKTLQRSLKKLGIKFHLSTKVTGATVKGDKVTVTAEDKKGNELSFETDHALVSVGRRPFTDGLNLEAAGVEVGERGFIPVNNHGQTSAAHIFAIGDVIGGAMLAHKAEEEGVCAVEFMNGEMPHMDHDLIPGVVYTWPEVASVGKTEEQLKEAGIKYKTGKFPFRASGRARASEESEGFVKVLADAETDRILGVHMIGPRCADLIAEAVLAMEYRASAEDIGRVCHAHPTYTESFKEAALMATENRPIHI

SEQ ID NO: 14748 - protein, 415 aa, Lentisphaera araneosa HTCC2155
MSIEIIVPAAGESVTEADIARWFKEDGEFLELDEPMVELETDKASLTITAPAAGTLHIKVEEDETVQVGEVIAVLEEGVGSAAESTAEVEETEEEVEAAPSVDMASPAARKLIAENNISAQDVVATGKDGRITKEDVIQHLAAREKVLNIPSSIPNVQDVANKNASPAPVPAVAPTPATAPEARGTRTEKMSRLRRTIAQRLVDAQQEAAILSTFNEIDMSAVMNLRKQHKDEFKDKHEIGLGFMSFFTKATAIALKEFPIMNAQVDGNSIIYHDFVDMGIAVSTPKGLVVPVIRDCDQLNFSGIERKIRELALKGRDMDLTPEEMTGGTFTITNGGTFGSMLSTPILNRPQSAILGMHNIVERPVAVNGQVEVRPIMYLAVSYDHRIIDGSDAVRFLVKIKTLLEDPTRMLLEL

SEQ ID NO: 14749 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENVDIANLLLAPYFKKIADEYQQALRDVVAYAVQNGIPVPTFSAAVAYYDSYRAAVLPANLIQAQRDYFGAHTYKRT

SEQ ID NO: 14750 - protein, 445 aa, Salmonella enterica
AVMGRNLALNIESRGYTVSVFNRSREKTEEVIAENPGKELVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYSENAGIANLLLAPYFKKIADEYQQALRDVVAYAVQNGIPVPTFSAAVAYYDSYRAAVLPANLIQAQRDYFGAHTYKRT

SEQ ID NO: 14751 - protein, 195 aa, Bacillus anthracis str. Ames
MILMIDNYDSFTFNLVQFLGELGQELVVKRNDEVTISDIENMKPDFLMISPGPCSPNEAGISMDVIRYFAGKIPIFGVCLGHQSIAQVFGGEVVRAERLMHGKTSPMHHDGKTIFSDIPNPFTATRYHSLIVKKETLPDCLEVTSWTEEGEIMALRHTTLPIEGVQFHPESIMTSHGKELLQNFIRKYSPSVTSC

SEQ ID NO: 14752 - protein, 243 aa, Arabidopsis thaliana
MVEPYETRNNGEASQMIRYQSYNHHNSRLPSSLSSPLLDLRVFYVRISNFKVDHSTPEVLTITHIPLDPDSLLEINGVRMSMYSEGVSSQLRRDRVDKKSEVATFISTDNIRLSGSVKFEVYDKDELVLSGTLEMSGSNGFTGESKHSVKRWNMNCEAEITAESGFLKEKHIGGSELSSPLPTIEVYVTGCFSGTPIILTKTLQLGFRKKHGRVTALDSIPEYETDEPHKGNSSELDYQSVLR

SEQ ID NO: 14753 - protein, 496 aa, Rhodococcus sp. RHA1
MAVISHWLNNKSYPGTRADTAPVTNPATGAVTGQVALASVEDARAVIDAAAAAFPAWRDTSLAKRTQVIFTFRELLNARKGELAEIITAEHGKVVSDALGEVSRGQEVVEFACGIAHLLKGGMTENASTNIDVSSLRQPVGPVGIISPFNFPAMVPMWFFPIAIATGNTVVLKPSEKDPTAAIWMAELWAEAGLPAGVFNVLQGDKTAVDELLTNPAIKAISFVGSTPIAQYVYATGTAHGKRVQALGGAKNHAIVLPDADLDLAADAMVNAGFGSAGERCMAISALVAVGDIADELVAKIKDRTDTLKIGDGTRDSDMGPLVTKVHRDKVASYIDAGENDGATIVVDGRTVQANGGKDGFWLGPTLIDHVTTDMSVYTDEIFGPVLSVIRVGSYDDALELVNSSPFGNGTAIFTNDGGAARRFQNEVEVGMVGINVPIPVPMAYYSFGGWKNSLFGDTHAHGTEGVHFFTRGKVVTTRWLDPSHGGLNLGFPQNN

SEQ ID NO: 14754 - protein, 658 aa, Arabidopsis thaliana
MDSKGVLMPLIHEHLMMPWKNLKRGPCCGCCGRFEAISDGYYCKTCDFFVRKNCADEPSEYIKHPSHPKHTLQLLRPERPTNFCNLCGRMCPIFYRCDLCDFDMDLYCSKYPPPEVIDISKTHHHRLTLLKKWIKQCICAKCCKIIGNEFPYNCHECDLSFHVDCVWYPPELELRLEVNHSYHSLHPLKLYAKGQLPDYSDGKCRLCARKIDETFFFHCSPCNFTLDKVCVLRPPQQSLLNLKAHDHQLTLLPKLDSFTCNACGLKGDRSPYVCFQCGFMIHQDCLGLPRLININRHDHRVSRTSVLGVVNSVCGVCRKKVDWSYGGFSCQRCHGYVVHSKCATRKDVWNGKELEGLPEETEDIEPYVVIDENTIQHFSHKEHYLRLNVNGVLCDDNKRCKACTHPICLQSFYGCMDCNFILHQNCAGFLRMKWHVLHNERLTLVTNKDEGFRCYACDRLSNGFKYQHGNKAFDVRCISISEPHIHPSHPNHPLYYFPSDEVQWCTGCNMEQDFVLSCIEDNCGFLLCFGCATLPQMVKHRVHDHPLSLCYGEKASGKYWCDICEKETNPHTWFYTCKDHQASLHTKCVLGDLSSLMRRSTIKIEGTSYEVVLNNSISRPFCSWCKMHCIFPIILKTLGATNEYSCSLECAECRYTDR

SEQ ID NO: 14755 - protein, 757 aa, Hordeum vulgare subsp. vulgare
MTVTPQITVGDGRLAVRGRTVLSGVPDNVTAAHAAGAGLVDGAFVGATAAEAKSHHVFTFGTLRDCRFMCLFRFKLWWMTQRMGTSGRDVPLETQFILIEVPAAAGNDDGDSSDGDSEPVYLVMLPLLEGQFRTVLQGNDQDELQICIESGDKAVETEQGMNNVYVHAGTNPFDTITQAVKAVEKHTQTFHHREKKTVPSFVDWFGWCTWDAFYTDVTADGVKQGLRSLAEGGAPPRFLIIDDGWQQIGSENKDDPGVAVQEGAQFASRLTGIRENTKFQSEHNQEETPGLKRLVDETKKEHGVKSVYVWHAMAGYWGGVKPSAAGMEHYEPALAYPVQSPGVTGNQPDIVMDSLSVLGLGLVHPRRVHRFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLRKLVLPDGSVLRAQLPGRPTRDCLFSDPARDGASLLKIWNMNKCAGVVGVFNCQGAGWCRVAKKTRIHDEAPGTLTGSVRAEDVEAIAQAAGTGDWGGEAVVYAHRAGELVRLPRGATLPVTLKRLEYELFHVCPVRAVAPGVSFAPIGLLHMFNAGGAVEECTVETGEDGNAVVGLRVRGCGRFGAYCSRRPAKCSVDSADVEFTYDSDTGLVTADVPVPEKEMYRCALEIRV

SEQ ID NO: 14756 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDENGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14757 - protein, 120 aa, Bacillus anthracis str. Ames
MDKIYIHDMEFYGYHGVFPEENKLGQRFKVDLTVELDLKRAGESDDLEHSVNYGELFELCRKVVEDRTYKLVESIAENIATDILKQYESISRCTIKVIKPDPPIPGHYRAVAVEITRERP

SEQ ID NO: 14758 - protein, 694 aa, Oryza sativa Japonica Group
MMAAAAGEGEAEVTREVISVSTEKAFEGKALPAWSEQITVRSLVVSAVLGTFLSFIVMKLNLTSGIVPSLNVSAGLLAFFLMKTWTSALERCGVFPKPFTRQENTVVQTCVISCSSIAFSGGFGTYILGMSKKIAEGFDEAEAKTSINVEEPSLGRLIAFLFLVSFVGLFSIVPLRKIMIISYKLTYPSGSATAHLINSFHTPQGAIQAKHQVSILFKSFVGSFLWSLFQWFYAAGPGCGFSSFPTFGMVAYSRRFYFDFSATYVGVGMICPYIINFSLLIGSVVSWGIMWPYIESKKGSWYDAGLPKSSLHGLNGYQVFISIAMIVGDGLFNFFSIVLRTAYDLYLKRRGGASKQPQETPFAGATGTERQVLSFDDRRRTQVFLKDQIPTTIAAAAYVLLAAISVVAIPHIFRQLRPKHVVWAYVVAPLFAFCNAYGTGLTDWSLSSSYGKLAIFIFGANIGAKDGGVVAGLAACGLMMGIVSTASDLVQDFKTGYLTLTSPRSMFVSQVLGTGMGCIISPMVFWMFYKANNIGMEEGFPAPYAKIYRGIALLGVNGWDQLPRYCLRFCLAFFLLAIAICALKEVAKQRGWWIQDFIPSALGMAVPFFLGSFFTIDMCVGSLVLFLWSRSDPVRAHTFAPAVASGLICGDGIWSLPSSILSLANVNPPMCMRVFSTATNDKVQLFLRTLPTPP

SEQ ID NO: 14759 - protein, 263 aa, Triticum aestivum
HYRTSLYKKAGWYRSGIPGISSTHASGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSFLLIEPLLQSAR

SEQ ID NO: 14760 - protein, 335 aa, Oryza sativa Japonica Group
ASNLSNPLELPPLDGVSFVVTGATSGIGLEIARQLALAGGHVVMAVRRTKLAQELIQKWQNDNSEIGKPLNAEVMELDLLSLDSVVKFADAWNARMAPLHVLINNAGIFSIGEPQRFSKDGYEEHMQVNHLAPALLAVLLLPSLLRGSPSRIVNVNSVMHTVGFVDAEDMNLTSGKRKFTSLMGYSNSKLAQIKFSSMLHRRIPAEAEINVICASPGIVHTNVARDLPKLVVAAYHLIPYFIFDAQEGSRSTLFAASDPQVPDYCEMLKSEDWPVCACISYDCNPMNASEESHNLETSQLVWEKTLEMIGLPPDAVDKFIEGESVQCRYGQQKAE

SEQ ID NO: 14761 - protein, 771 aa, Oryza sativa Japonica Group
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHSLHPAAEYHGAARAIGGCPIYVSDKPGNHNFELLKKLVLPDGSVLRARLPGRPTRDCLFVDPARDGASLLKIWNVNKCTGVVGVFNCQGAGWCRITKKTRVHDAAPGTLTGSVRADDVDAIADVAGTGWTGDAVVYAHRSGELIRLPKGATLPVTLKVLEFELFHVCPVMTVAPGGGGGGVTFAPIGLLDMFNSGGAVEECDVVRALDAAGEAEAEAEAAVVRLRARGCGRFGAYSSRRPARCALDAVEVEFSYDADTGLVALDVPVPAHELYKWTVEIQV

SEQ ID NO: 14762 - protein, 380 aa, Xylella fastidiosa 9a5c
MQYCRWIFLAGTSQHGMPSGCVQIIRTYSSMDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPVTKVAGVSHWGATVRQHGQSYDEAYAFACELAEQNDYHFLSAFDDPDVIAGQGTVGIEITAHEPDVVIVPIGGGGLASGIALVLRSQGVRVIGAQVEGVDAMARAIRGDTREIAPVSTLADGVKVKIPGFITRRLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 14763 - protein, 415 aa, Saccharomyces cerevisiae
SLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAVGPEIAKLMEKAKAKGVEVVLPVDFIIADAFSASANTKTVTDKEGIPAGWQGLDNGPESRKLFAATVAKATVILWNGPPGVFEFEKFAAGTKALLDEVVKSSAAGNTVIIGGGDTATVAKKYGVTDKISHVSTGGGASLELLEGKELPGVAFLSEKK

SEQ ID NO: 14764 - protein, 244 aa, Saccharomyces cerevisiae
PKLVLVRHGQSEWNEKNLFTGWVDVKLSAKGQQEAARAGELLKEKGVNVLVDYTSKLSRAIQTANIALEKADRLWIPVNRSWRLNERHYGDLQGKDKAQTLKKFGEEKFNTYRRSFDVPPPPIDASSPFSQKGDERYKYVDPNVLPETESLALVIDRLLPYWQDVIAKLVGKTSMIAAHGNSLRGLVKHLEGISDADIAKLNIPPGTILVFELDENLKPSKPSYYLDPEAAAAGAAAVANQGKK

SEQ ID NO: 14765 - protein, 307 aa, Saccharomyces cerevisiae YJM789
MLISSRIVRSSLVNVPLRLSRFFTQAHRACKEEEVNSPLSSTAEQPEQKYTHFGSKTVLKSTKQKLVGDVFSSVANRYDLMNDVMSLGIHRLWKDHFINKLDAGKRPNSTTPLNFIDVAGGSGDIAFGLLDHAESKFGDTESTMDIVDINPDMLKEGEKRAMEQGKYFKDPRVRFLVSNGEKLEEIDSDSKDIYTVSFGIRNFTDIQKGLNTAYRVLKPGGIFYCLEFSKIENPLMDFAYQQWAKVLPVMGSMIANDYDSYQYLVESIERFPDQETFKSMIEKAGFKSAGYESLTFGICAIHWGIKV

SEQ ID NO: 14766 - protein, 469 aa, Proteus vulgaris
MSLEHVLSMIEEHKVRYIDLRFTDTRGKEQHLTIPAHQVNDDFFEEGKMFDGSSIGGWKGINESDMVLMPDASTAMLDPFFQDPTLIIRCDVLEPGTMQGYDRDPRSISKRAEDYLKSSGIADTVLFGPEPEFFLFDDIRFKNDISGASYAINDIEAAWNTNTKYEDGNKGHRPMVKGGYFPLPPVDSSQDIRSTMCNIMEEMGLVVEAHHHEVATAGQNEVATRFNTMTKKADETQIYKYVVQNVAHVFGKTATFMPKPLVGDNGSGMHCHMSLSKNGTNLFAGDKYGGLSEMALYYIGGIIKHARALNAFTNPTTNSYKRLVPGFEAPVMLAYSARNRSASIRIPVVASMKARRIEVRFPDPLANPYLAFAAQLMAGLDGITNKIHPGDAMDKNLYDLPPEEAKEIPTVAGSLEEALNALDADREFLTHGGVFTNDSIDAYLALLRTDVQRVRMAPHPLEFEMYYSA

SEQ ID NO: 14767 - protein, 614 aa, Candida albicans SC5314
MIAIDLEFRQWQWQYQISTTFFIGVIVPVLYYVYNKYITAQPNNYNKIEAPVKITLPIPEEARPHWKGKRLYPPSISIPNEPDKIQSYCPATGQYLGVFNCTTREDMDEMINNASKAQKKWANSSFSLRRKLLKTMASFILENQENIARVACRDSGKTKLDASMGEIMVTLEKLNWIISHGEKVLRPSQRPGPANFLIGMMKNAEVRYEPMGVVTSIVSWNYPFHNLMGPVIASLFTGNAIIVKCSENVVWSSQWFIKFVRKCLQELDIDENLVQLCCCFPNDAEYFVSHPGLSHITFIGSKNVAHHVVSQAAKQLTPCVVELGGKDALIVLDDVKDVQSLSSVILRGTFQSAGQNCIGVERVICLPKVYEQLVEIFTERIKSFRVGSDIDQLDEIDMGAMISDNRFAQLEGLIEDAVSKGARLIHGGKQYQHPNYPQGHYFEPTLLVDVDPTMKIFQEEVFGPVLTMIRANDAEDAVNIANGTEFGLGNSIFGSNFNQVNQIADQLQSGNVAINDFATFYVAQLPFGGIKQSGYGKFGGEEGLTGLCNAKSVIMDKPLLRLFGVATSIPPPIDYPIENDKKAWNFVKSLNIAGYDGRLWNKVKALKNLATGGS

SEQ ID NO: 14768 - protein, 164 aa, Erythrobacter sp. NAP1
MSILRLSALRNVLTKARLRFFRGVMKMDIHPTVEMSLSAKMDMTFPKGVHIGECTYVAFNARILTHDRTRGLYVHTHVGKNCFLGGESLIMPGVTIGDNCVIGAGSVVTRDVPARSIVAGNPAQIIREGIEVGPYGRFLDADETERQIRDTDPSAADLPSRLAR

SEQ ID NO: 14769 - protein, 465 aa, Campylobacter coli RM2228
MQGFISQVLGPVVDVDFNDYLPQINEAIVVNFESEGKKQKLVLEVAAHLGDNRVRTIAMDMTDGLVRGLKAEALGAPISVPVGEKVLGRIFNVTGDLIDEGEEISFDKKWAIHRDPPAFEDQSTKSEIFETGIKVVDLLAPYAKGGKVGLFGGAGVGKTVIIMELIHNVAFKHSGYSVFAGVGERTREGNDLYNEMKESNVLDKVALCYGQMNEPPGARNRIALTGLTMAEYFRDEMGLDVLMFIDNIFRFSQSGSEMSALLGRIPSAVGYQPTLASEMGKFQERITSTKKGSITSVQAVYVPADDLTDPAPATVFAHLDATTVLNRSIAEKGIYPAVDPLDSTSRMLDPQIIGEEHYKVARGVQSVLQKYKDLQDIIAILGMDELSEEDKLIVERARKIEKFLSQPFFVAEVFTGSPGKYISLEETIAGFKGILEGKYDHLPENAFYMVGNIDEAIAKADKLKG

SEQ ID NO: 14770 - protein, 364 aa, Oryza sativa Japonica Group
MAGAAAMALLLSTSVLLVLCLLPVDPAAPPVAAIPHRRSGRHDVPFGRHAAFGPFATEVELLLHGGGAVPDIRTCRDTLDRLPDWSHFDAELGPLERYFGSDGELNVKERLLYLFPMLDRAPKDGGVSCGELEAWLRRQAADRLDAVARRELKRHDKDGDGVVTLREYLAVDHDQHIDWTDTEHGEPGWWLHKFISADRDHSGAMDFIELNDFLHPEDSSQEKVKLWLLKDKLSGMDHDRDGKLSLDEFISQFHMIDHNSIVEHSADDDTSCAEAEKKFRELDSNNDGYLTVEEARPVIQSLISGEFSYAKSHAKLLMKADDNKDNKLSLEEMLNHYLSFYNIVYMDDHYDYDDIGNNIHDELR

SEQ ID NO: 14771 - protein, 252 aa, Brassica napus
VDPRVRSSKHGFPFSERQGSLLGKYQHHVGSAPSSSHFNNHMIPFGFGDMGVNKSYPNAHGQANVGVNFTGSGMSLLPTVPFGGSRGLQSVRHEPFAEERRITHFETQLTDDGRYHIDLDRIATGDDTRTTLIIKNIPNKYTYMMLVAEIDEKHKGDYDFLCLPIEFRNKCNMGYAFVNMVSPLHIVPFQQTFNGKVWENFNSGKVASLAYAEIQGKSALASYMQNPSPMKDEKHLFPEVSHHNGDGQDSYD

SEQ ID NO: 14772 - protein, 355 aa, Oryza sativa
  misc_feature (187)..(187): Xaa can be any naturally occurring amino acid
MMASTTSATAAGGACARVAAGGRRRSGVVVRCDAGVEAQAQAQAVAKAASVAALEQFKISADRYMKERSSIAVIGLSVHTAPVEMREKLAVAEELWPRAISELTSLNHIEEAAVISTCNRMEIYVVALSWNRGIREVVDWMSKKSGIPASELREHLFMLRDSDATRHLFEVSAGLDSLVLGEGQILXAQVKQVVRSGQNGGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRALTEMYEDDGETDFVFQSTDRKAHVKKENKEGPGKRNKRGGNIGEIRAKN

SEQ ID NO: 14773 - protein, 346 aa, Nocardioides sp. JS614
MRALVKTTAGPGLELIDVPEPACGDRDVKIRVLRAGLCGTDLHLLSWDDWAAATVQAPMTIGHEFFGEVVEVGADVDHVSVGDRVSGEGHIVCGACRNCRAGRRQLCINTVGVGVNRDGAFADYVVIPAANAWVQPADLDPDLGALFDPLGNATHTALQWPVVGEDVVITGAGPIGIMATAIVRHAGARRIAVTDLSPERLELAASAGADLTVDVSQGQDLAWAQRQLGMLEGFDIGLEMSGAPDAVRDMLENLNHGARVAMLGLPRSAYEIDWGKVITHMITLRGIYGREMFETWYLMGSMLATTPALRDAVQSVITWRGPAEDWEEAFEHTRSGTAGKAVLDWS

SEQ ID NO: 14774 - protein, 286 aa, Raphanus sativus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPNQYQALGGGANTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRN

SEQ ID NO: 14775 - protein, 287 aa, Raphanus sativus
MAKDVEAVSGEGFQTRDYQDPPPAPLFDPEELTKWSFYRAVIAEFVATLLFLYITVLTVIGYKIETDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 14776 - protein, 881 aa, Enterococcus faecalis V583
MKKFIYSFNETHNEGKETLGGKGANLAEMTRLGLPIPQGFTITTRCCMDYLADATFFEEHLQSEILKAVKNLETETGKSFTADNEILLVSVRSGAAFSMPGMMDTILNLGLNDQRVKKFATLTSPGFAFDCYRRLIQMFGDVVYHIPKELFDQQKERLEQELNKKITAFQEEDHFALIVRYQEVFEQHQVVFPQDPVAQLFEAIKAVFDSWNNQRAVVYRNLHHIAHDLGTAVNIQEMVFGNRGLDSGTGVVFTRNPVTGENQLFGEFLLNAQGEDVVAGIRTPEPIRRLRLTMPKVYQDFRHYAELLEYHYRDMQDIEFTIENEKLYILQTRNGKRTAAATVKIALDLAKENRITKQEALLRVTPDTIDQLIHPVFDQEKRQHMERLAMGLPASPGAASGQIVFTAEKAKELTNLGKKVILVRQETSPEDIEGMVVSEAIVTSRGGMTSHAAVVARGMGTCCVTGCESLTVNEETKQLHCGPQVILEGTIISVDGSTGEIYLGEIPTISADNNDDLQELLSWADAYADLTVRANAETTQDLETAIRFGAAGIGLARTEHMFFGEERVLEMRRLILAESEKEATYALEQLLHFQQEDFYQMLKVVQDKPMVVRLLDPPMHEFLPHEKNDIQLLAKQLQRFPVTIAKQIERLQETNPMLGHRGCRLGVTQPQIYKMQVTALFTSAIRLVKEGITVYPEVMIPLIAEKEELLYLKRILKETIDGLFEEHKMTPFPYEIGTMIELPRACLIADQLAEEADFFSFGTNDLTQMTYGFSRDDIGKFINTYREKKIITQDPFQSLDQTGVGQLIQLAVEKARRTKPNMSIGVCGEVGGDPQSITFFQTLGLNYISCSPYRVPIAKLAAAQAKILTEPAVTEEQMVLL

SEQ ID NO: 14777 - protein, 534 aa, Zea mays
  misc_feature (266)..(266): Xaa can be any naturally occurring amino acid
MSPQPAPDLAEDKERDTNVFIEAAPGSPAKVAEGDGHGHGSPPTSPVAWFRMLARELHWSFVFGVVATYGISQGLGGGISRVASDYYWKDVQRVQPSVAQVYQGVTSIPWMVKPLWGLLTDVLPVAGYRRRPYFILAGFIGVIAMLILALYSKLHALFALLALMTGSASVAIADVTIDACVAENSIVYPHLAADMISLNGFCSSVGGLIGFSISGFLVHAIGAQGALGLLTIPSALVILSGTLLKEVHIPNFPYEQAHKKFVEASXKMLTALKCPEVWRPCVYMYISLALSVDIQEGMFFWYTDQSAGLSFHEGFIGFMFAIGSVGSLVGVILYQNILKDHSFRSLLFSSQLLLSLAGMLDLILVLRLNLKMGIPDYYFAVIDEGVSKMINRIKWMPLLVLSSKLCPTGIEGTFYALLMSIDNIGSLTGSWVGGLLLHLLRITRTEFKNLWAAILIRNMMRLLPLALLFLVPRSDPNSTLLPSDLLNEGDDDEAQRVENVELTSLPANRNSCDGKSLHDGERDDDEASLLANRS

SEQ ID NO: 14778 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 14779 - protein, 106 aa, Physcomitrella patens subsp. patens
RLVEEADFQNTSELFGGKLKGGPSFEDFIPTSEDDFLEYAELLAQKIRPFEKSFHYMTLLRAIMRLSVANMKASDAKEVASSMTVIANEKLKPERDTTAGNKKTGM

SEQ ID NO: 14780 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 14781 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAQRVAASKLLSGPKAQPAGNKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14782 - protein, 275 aa, Triticum aestivum
MTVVTLPEPFASIPRENFLFGASPLQPLPRISAALGGKVNVYAKREDCNSGLAYGGNKVRKLEYLAAEAQAEGCDTLVSIGGVQSNHTRAVTAVASKLGLKAATVQEHWVDWEDPGYEKVGNIQLSRLMGGDVRLDPSTFGIEHKTTLAKLKDELKSNGQKPYYIPAGASDHPLGGLGFARWAFEVEAQEKELGIFFDTVIVCAVTGSTFAGMIAGFKLAQKKNGSPARKIIGIDASGKVQQTFDQVLRIAKNTAAKIGLSEDDITADDVILDPT

SEQ ID NO: 14783 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFLDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTKWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYLWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14784 - protein, 445 aa, Salmonella enterica
AVMGRNLALNIESRGYTVSIFNRSREKTEEVIAGNPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 14785 - protein, 471 aa, Legionella pneumophila str. Paris
MNKGMNAFVFLIAVIAGFGGFLFGFDSSVIADVKDQVISQLALTDWQWAQVVSSSLLGCILGIPISGLVADKLSRRSLLKVVALGFILGSSLCALAPGFVSILLGRFIIGICIGIASYIAPLFIAEIAPPHQRGTLVLINGLTITFGQAIAYLIGYFLHDYSLMSWRYLFWIGSLPALVLFSGMYFVPHSPRWIMMKYGADATLKTLKQIRPVGYNIQQELTEISNNLVNPAPAYIQMFKKPIVFVLLLGVGLGIFQQFSGINALMYYGPVVFESFGFSPVKNAILATFFLGLVNFIFTVVTLFYVDKLGRRFLLISGTLIASISLYLVSLLSSNSLLVNKFWILGGLSFYVMGYCISLGSLFWVLISEIYPLSVRGLAMSIATVFQWGANFVVSLLFLPIYQFSGQTVTFAMFATFCLLACWFIYYFVPETTSVSLEKLEDNLSSGKKIRDIGQPVSKNIKIAKFNLIMD

SEQ ID NO: 14786 - protein, 270 aa, Zea mays
MARCSNGLLGLLNAGVLVLAIVALGGGAWLSHRASTTDCERFLERPVIALGVLLLALSLAGLAGALCRASCLLWLYLLALFLLILLLFAFTVFAFVVTNRGAGWVVSGRGYKEYRLGDYSTWLQRRVENSQNWAKIRSCLQDGKVCQKLASRKETAAQFVNSNLSPIQSGCCKPPTGCNFTYQSETVWTKPAGFNTTTDDPDCTTWSNDQTVLCYDCMACKAGVLANLKNDWKKIATVNIVFLIFLVVVYSVGCCAFRNNRQDNSYPAWK

SEQ ID NO: 14787 - protein, 206 aa, Zea mays
  misc_feature (105)..(105): Xaa can be any naturally occurring amino acid
  misc_feature (118)..(118): Xaa can be any naturally occurring amino acid
  misc_feature (183)..(183): Xaa can be any naturally occurring amino acid
TSRPAGPGLPTHSLALRFLAAPVPHPLLTQPVPSSLAHGLPSTGRRPSPTASLRWIDENDHLQQVSVHALAAGKKVILFCVPGAFTPTCSNQHGPGFVTQAEQLXAKVVDEILLISVXDTFVMKAWANTYPENKHVKFLADGSVAYTKALDLELNLTDKGLGARSKRFALLADDLTVIGANIXEGAQDYISDAEEILKALYRLRLL

SEQ ID NO: 14788 - protein, 221 aa, Bacillus anthracis str. Ames
MFKRLREDIEVVFEQDPAARSYFEVILTYSGLHAVWAHRIAHAFYKKNFFFIARWISQVSRFFTGIEIHPGATIGRRFFIDHGMGVVIGETCEIGDNVTIYQGVTLGGTGKEKGKRHPTIQDNVLIATGAKVLGSITVGENSKIGAGSVVLKEVPAHSTVVGIPGRVVIQNGVKIGQELNHSDLPDPIFDKLKVMEVELDKLKKQLEVKVERKDKNDYSHL

SEQ ID NO: 14789 - protein, 468 aa, Acidithiobacillus ferrooxidans
MGYSPSDVVKLIQEKDIKFIDFRFTDTKGKEQHVSVPGHVIEEDTFTEGKAFDGSSIAGWKGINESDMILLPDPDSAVLDPFMDETTLLLRCDVIEPATGQGYERDPRSVAKRAEIYLKSTGIADTSFFGPEFFVFDSVTWNIDMSGCAYKVDAEEAAWNSGKEYESGNMGHRLGVKGGYFPVPPVDSAQDLRSAMCLAMEEMGLKVEVHHHEVATAGQHEIGVGFNTLTPRRMRCKILKYVVHNVAAVRQTATFMPKPVVGDNGSGMHVHQSLGKDGKNIFAGDLYGGLSEIALYYIGGIIKHAKAVNALTNPSTNSYKRLVPHFEAPVLLAYSAKNRSASIRIPYVNSPKARRIEVRFPDSTANPYLAFSAMLMAGLDGIQNKIHPATAMDKNLYDLPAEEQANIPGVAASLEEALRALEADHDFLMKGGVFSESWLEGYLDVKWAEVQTLRVTTHPVEFQMYYSL

SEQ ID NO: 14790 - protein, 468 aa, Vibrio alginolyticus
MSVEKVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEESAEIPTVAYSLKDALAELDADREFLTAGGVFSDDFIDSYIELKSQDVERVNMTTHPVEFELYYSV

SEQ ID NO: 14791 - protein, 379 aa, Photobacterium damselae subsp. piscicida
MISLRHRGTVMKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDGTSRFSYNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 14792 - protein, 425 aa, Nocardioides sp. JS614
MTADLVYVVAGGSLLLAIVLPELLDRWAVSAPMVLVAVGIGIGFTPLPDGMPLDPQANRATIEHVTELAVLVALMGVGLALDRPLRPRSSASWARWSTTWRLLGITMPLCIGAVALLAWGAGVAPAAALLLGAALAPTDPVLASDVQVAGPQTGDHEIDESDELRFTLTSEAGLNDGLAFPFVYAAILLATEGAVSGWALEWVGFYLVGKVVIGVVAGIAVGRVLAWVAFRSASRSLRVAERGESLLALAALVSAYGVGEVVGGYGFLSVFVCAMTFRSAERAHDYHAAMHEVAERLERLLTLFVLLVLGIALSRGLLGGLDWRGVVLGLGLLLVIRPLAGLVALAPFARRERPPLTRGQRWAAAFFGVRGVGSIYYLAYAAGHAAELGTDWLWSTVSFTVVASVLLHGVLASPVLRRVGDPASR

SEQ ID NO: 14793 - protein, 352 aa, Chlamydomonas reinhardtii
QDIIDFQYRVWQKSGLSDNATYLPKSVHPKFCGNNPKTDMDSAAAECRMAVCGAVEGLFKKTGLRPKDIDILVTTCSVYCPTPSMASMVVNAFGMRKDVQAYHLGGMGCANGVVGINMVADLLKAHPNSNALFVTNETTTPAFYKGRDKHRLVTNVLFRMGGAAVLLTNKRALIPRAKYALQHRVRVHCGASNEAYKCIWYGPDAEGLNGIYLGLDVVKEASKGLTYAMMRVGRYVLTWGQIGQWLWTEAQRRLLGRKDVAPYSPCFGDCINHFLIHAGGAKVLDGIGKNLKITESHLWPSRTVLRYYGNVSSSTTWYTLAAVESLRGVRKGDKVLQIGVGSGIKVGVNVWK

SEQ ID NO: 14794 - protein, 486 aa, Marinobacter sp. ELB17
MTAQLHTVEKIGGTSMTNYEAVRDNIIIGNRSKDELYQRIFVVSAYAGVTNELLEHKKTGEPGVYALFADAESDWAWGDDLTKLVRFLTNINGEMFEDSMLKQQADQFIIDRVEGVRGCLIDLQRLCSYGQFQLEEHLLTVREMLAGIGEAHSAFNTTLKLQQEGINARFVDLTGWRDAELLPLDEKLKQAFDAVDLSRELPIATGYAQCKEGLMRTFDRGYSEMTFSRVAVITEAREAVIHKEYHLSSADPNIVGADKVVPLGRTNYDVADQLANLGMEAIHPRAGKGLRQNDIPLRVMNTFEPEHTGTLITKDYVSEKSQVEIIAGAKGIFAIELFDQDMQGEPGSDRKILDVLTRFKVRFVSKDTNANTITHYVSTTLKHVKRVVNALKETFPNAEVHTRKVALVSAIGSDMKALGILARSVKALADAEISVLALHQCMRQVDIQFVIDEDNYKATIVALHAALIEPHNHEYAIASAEQCALG

SEQ ID NO: 14795 - protein, 665 aa, Nicotiana tabacum
MSSPTPGASPAPTSPPAPPTNSTSPPPTAVASPPALPAQAPPPTSPTPPATTPPPTASASPPPPSTSAPSSSTPPPPTTQSTPEPSGSPPSPPSPPSGSSPSPPAPSGSGRSPAGPRGGGGSSTSSPASDEGSSGVSTGLVVGIAIGGVLILAVLSLLFICCSRRKKRRNHGPVEYYPPAQPPPMGYKADPYGDPVHHWQHNAPSPADHVVSIPPKPSPPPAGASRPPHSPVTASSLQPPPPPPYMSSSGASSNYSGFDPLPPPSPGMVLGFSKSTFTYEELVRATDGFSNANLLGQGGFGYVHRGVLPNGKEVAVKQLKAGSGQGEREFQAEVEIISRVHHKHLVSLVGYCITGSQRLLVYEFVPNNTLEFHLHGKGRPPLDWPIRLKIALGSAKGLAYLHEDCQPKIIHRDIKAANILVDFNFEAKVADFGLAKLTSDVNTHVSTRVMGTFGYLAPEYASSGKLTEKSDVFSYGIMLLELITGRRPVDSSQTYMDDSLVDWARPQLTRALEDEKFDSLIDPRLGNDYNHNEVARMVACAAACVRHSARRRPRMSQVVRALEGDVSLSDLNEGIRPGHSTVYSSHGSSDYDASQYNEDMKKFRKMALGSQEYGSTGQYSNPTSEYGLYPSGSSSEGQPTREMEMGRTKKDSRGFSGSKGFIGSS

SEQ ID NO: 14796 - protein, 416 aa, Nicotiana tabacum
MAGMCCGVNLTETEATTPVEPSSEAARRRRMEIHQFRLAPPLENGTKRHKVEKVVDQSKRRKLETSVTISLMSPLGVTEKVAEKEFDAKPLDLSESDVSSVKVDGVEVVAGDNNLSKFGITSVCGRRRDMEDAVAVHPSFCKGENENSNSLHFYGVYDGHGCSHVAMKCKDRMHEIVKNEVEKGETQWKEVMTKSFSQMDNEVVHYSSGAVGGSSSNCRCELQTPQCDAVGSTAVVAVVTSEKIIVSNCGDSRAVLCRNGVAIPLSIDHKPDRPDELNRIQEAGGRVIYWDGPRVLGVLAMSRAIGDNYLKPYVISEPEVTITERTDEDECLILASDGLWDVVSNETACGVARMCLQSRRPPSPQGPPENDVTVTGAGESSDQLCSDASILLTKLALARHSTDNVSVVVVDLRKDL

SEQ ID NO: 14797 - protein, 923 aa, Lotus japonicus
MMELPATRILSQAVTCFLCLYIFIGSASATEGFESIACCADLNYTDPLTTLNYTTDYTWFSDKRSCRKIPETELRNRSNENVRLFDIDEGKRCYNLPTIKNGVYLIRGTFPFDSLNSSFNASIGVTQLGAVRSSRLQDLEIEGVFRATKDYIDFCLLKGEVYPFISQLELRPSPEEYLQDFPTSVLKLISRNNLGDTKDDIRFPVDQSDRIWKASSISSSAVPLSSNVSNVDLNANVTPPLTVLQTALTDPERLEFIHTDLETEDYGYRVFLYFLELDRTLQAGQRVFDIYVNSEIKKESFDVLAGGSNYRYDVLDISASGSLNVTLVKASKSEFGPLLNAYEILQVRPWIEETNQTDVGVIQKMREELLLQNSGNRALESWSGDPCILLPWKGIACDGSNGSSVITKLDLSSSNLKGLIPSSIAEMTNLETLNISHNSFDGSVPSFPLSSLLISVDLSYNDLMGKLPESIVKLPHLKSLYFGCNEHMSPEDPANMNSSLINTDYGRCKGKESRFGQVIVIGAITCGSLLITLAFGVLFVCRYRQKLIPWEGFAGKKYPMETNIIFSLPSKDDFFIKSVSIQAFTLEYIEVATERYKTLIGEGGFGSVYRGTLNDGQEVAVKVRSATSTQGTREFDNELNLLSAIQHENLVPLLGYCNESDQQILVYPFMSNGSLQDRLYGEPAKRKILDWPTRLSIALGAARGLAYLHTFPGRSVIHRDIKSSNILLDHSMCAKVADFGFSKYAPQEGDSYVSLEVRGTAGYLDPEYYKTQQLSEKSDVFSFGVVLLEIVSGREPLNIKRPRTEWSLVEWATPYIRGSKVDEIVDPGIKGGYHAEAMWRVVEVALQCLEPFSTYRPSMVAIVRELEDALIIENNASEYMKSIDSLGGSNRYSIVIEKRVLPSTTSTAESTITTQSLSHPQPR

SEQ ID NO: 14798 - protein, 375 aa, Desulfovibrio desulfuricans G20
MSQRDYYEVLGVSRDAADDEIKRAYRKKAMEFHPDRNPDNPEAEAKFKEAAEAYDVLRDAEKRARYDRFGHAGVNGNGYGGGGGFSSTEDIFAHFGDIFGDLFGFAGMGGARGPRPQAGSDLRYNLNISFRQAARGDEVTLRIPKNVTCPDCSGSGAAPGTQPETCPQCGGSGQVVRQQGFFQMAMPCSACRGEGRIVRNPCPRCRGAGQVQDIRELSVRIPAGVDTGNRLRLRGEGEPGVHGGPPGDLYVVIRVDDDKTFRRQGQDLVVRKEISFVQAILGDKVEVPTLDDPVTVDIPRGTQSGEVFRIAGKGLPHLGSSQTGALLVEVTVRIPSSVNDEQEKLLREFERLEENRPLRKVKNMFKKAGKAMGMD

SEQ ID NO: 14799 - protein, 250 aa, Bacillus licheniformis ATCC 14580
MIVTNDQELEGLKKIGRIVALAREEMKAKAAPGMSTKELDLIGKEVLEAHGAASAPEKEYDFPGTTCISVNDEVAHGIPSESRILKEGDLINIDISAEFGGYYSDTGISFVLGKGDEMLHKLCQSAESAFQKGLLQARAGKKQNQIGRAVYNEAKANGFTVIKNLTGHGIGRNLHEAPNHILNYYDPFDNALFKNGTVIALEPFVSTKAEHTIEAGDGWTFKTPDGSFVAQIEHTIVITKNEPIILTQLD

SEQ ID NO: 14800 - protein, 173 aa, Campylobacter upsaliensis RM3195
MDLSKIKVGEIPNKINAVIEIPYGSSVKYELDKDSGAIFVDRVMASAMFYPANYGFIANTLADDGDPVDILVLNEYPIQAGAVIPCRLIGVLIMEDESGMDEKLLAVPADKIDARYTDIKNYTDLPQATLSKIKNFFETYKILEPNKWVKVQDFKDINAAIEILEKAVKNYKD

SEQ ID NO: 14801 - protein, 716 aa, Marinobacter sp. ELB17
MTRSKLLLILVIAVIVGFFLGFDGHKLLTLENLQANQGALAQWIDQNLLIAVVGYAAIYVVVTALSLPGATIMTLAGGAFFGNLYGLAAVSIASTLGASLAFLVARFLMRDTLRERYRETIAKMDRGIKKDGAFYLATLRLVPVFPFFLINLAMGLTGMKLRTYALVSWIAMLPGTFVFVNAGTQLGQIQSTGDIVSADLLLSFALLGLFPLVAKIVVGFLRRRKVYAGWKKPERFDYNLLVIGAGSAGLVSAYIAAAVKAKVALIEKHKMGGDCLNTGCVPSKALIRSAKAADTLRHANRYGLESVAVKGSFRNIMNRVKDVIAKVEPHDSPERYRDLGVDCIAGEASFVSPWELEVRHNDGHNERLTARSIIVATGGKPAMPPIPGLEDMEPLSSDNLWELQEQPERLLVLGGGPIGSELAHAFARLGSQVIQVEMGDRLLAKEDSDVSELVRVQFENDGVDLRLEHAAKEFAIEEGEKVVYCEHKGERVRIAFDQVLVAVGRAANTKGLGLDKIGVETLPNGTVPVEEDMSLRYPNVFACGDVAGPYQFTHAAAHQAWYAAVNALFGQFKRFKVDYRVMPWVTFTSPEVARVGLSEAEAREKGVAFEVTKYGLDDLDRAITESEDSGFIKVLTPPGKDKILGVVVVGSHAGEILAEFTLAMKHGLGLNKILGTIHPYPTWNEAAKAAAGQWKRANAPQRLLAIVEKIHSWRRG

SEQ ID NO: 14802 - protein, 662 aa, Desulfovibrio desulfuricans G20
MRSGEIMKISVLNLTKSYGGHELFSDFSLEVPSGVRLCVCGPNGCGKSTFLRMLAGAAAPDGGRVTYPKNCRLGYVEQELDETRLDTPLLEWVLDVLPDWNDFWHEWEAASERRDEAALRSLGHRQAELEQVYGYNPEHRARAVLSGLGFAESKWDRTLRELSGGWRERAKLARVLTAGADVLLLDEPTNHLDLDAVEWLEQFLTEYKGALVFVAHDRVFMDKVGTHVLYLGGSRPMYRKGTFTQFLALHEENEARKEREMQRMAEEIERKMDFVRRFKAKATKARQANSRKKQIEKMERELDGVTLEARRRTLDFAWPEPARADKTVLSVVDLTFSFGDGTALWPALSFQLYRGQKIALVGPNGCGKSTLLKLVAGRLEKTGGSVVQGSLVRMGYFSQHQLDTLNPANTVLGEIRRLSDPRTTEEELMSVLGLFMLGQAYFERQVSALSGGEKSRLILAMLFLARCNFLVLDEPTNHLDLESREALVDALDSFPGTLLMVAHDRHLLSCAAEQVWELGAQGFTVYERGYEAWDEARKARRISLDARDDSAERPVQAGLSREEQKRIKREQAELRNRLHREMKPLQQKYDALEKEFESVLAEQTETETLLASPDVYADAGRASELLRLFHSLQARGEELMEAMADLESGMADIEARRQQAGL

SEQ ID NO: 14803 - protein, 527 aa, Arabidopsis thaliana
MAEPTQPLLTDSNSSSPRSLDDTIESYIGSFGWAQFLQAALVSFSGVFDAQQTFISVFTDSEPTWHCTDSNSICHESISNICILPKTAWSWDYSPHVSVISEWGLQCAGSFVKGLPESSFFVGCLIGGLVLSTLADSSLGRKNMLFLSCLVMAISTMLTVFSPNIWVYAVLRFVNGFGRATIGTCALVLSTELVGKKWRGRVGIMSFFGFMLGFLSLPLMAYMNRGSSWRILYAWTSIPTIIYCVLVRFFVCESPRWLFVRGRREEAISILKRVASIPSTDVSSGGAISMSFSSLPFEEDEEKPSTNVNIFTTMKVLVEKRWALKRLSAVMAIAFGIGLVYYGMPLALSNLDFNIYLSAAFNALMDLPANLITLFLVDKLSRRNALIGFTALGGVSSVLIFALHNMRIGNHGALQLALELISYFSACSAFNMEMIYTIELFPTCVRNSAIAMARQALVLGGVFSPIMVAAGRKNAFWSFGLFGLAIGLLGLFAVGLPETRGSDLCDTMDEEECKDRRSKVAVNNVIA

SEQ ID NO: 14804 - protein, 133 aa, Enterococcus faecalis V583
MKETSLVIIKPDGVERKLVGKIIQRFEDKGIDLLHLKFERLTVETVKEHYEHLKDELFFPELLAYMTSGPVVVMVVVGDNVVKKVRKLVGATNPLDAESGTLRADYGLSVTKNLIHASDSVQSAKIEMQRFFG

SEQ ID NO: 14805 - protein, 445 aa, Salmonella enterica
AVMGRNLALNIESRGYTVSIFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKNAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 14806 - protein, 451 aa, Shewanella sp. MR-7
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLHLENGESVTVDCLIWAIGRSPATGNIGLENTDVQLDSKGYVITDAQQNTTHKGIYCVGDIMAGGVELTPVAVKAGRLLSERLFNGMSDAKMDYSQIPTVVFSHPPIGTMGLTEPEARAQYGDDNVKVYTSTFTSMYTAVTSHRQACKMKLVCAGKEEKVVGIHGIGFGMDEILQGFGVAMKMGATKADFDAVVAIHPTGAEEFVTMR

SEQ ID NO: 14807 - protein, 99 aa, Triticum aestivum
MPRAEVAFAMHAGDGEVEAGFAKLQGEDFEYYMQTYSIMLGRSSKKSMVDVDLSSLGGGMNISRHHARIFYDFQRRRFALDVIGKNGCHVEGVLHLPGN

SEQ ID NO: 14808 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14809 - protein, 153 aa, Prochlorococcus marinus str. MIT 9301
MLLFKNLFFKSTYLLKSFGELSVDPEIAFTNNKPTFLEFYADWCEVCKEMAPQVSSLKDEYEKDINFVFLNVDNQKWGNYIKKFSVNGIPQVNLFDKKGNLISTFIGKQDEIKIRESINNLEKEENPYEEIVNAEFSIIQENKKNEVNPRSHG

SEQ ID NO: 14810 - protein, 483 aa, Spinacia oleracea
MAPPTRIGLAGLAVMGQNLALNIAEKGFPISVYNRTTSKVDETVERAKQEGNLPLYGFHDPESFVNSIQKPRVIIMLVKAGAPVDATIKTLSAYLEKGDCIIDGGNEWYENTERREKAMEEKGLLYLGMGVSGGEEGARNGPSMMPGGSFDAYKNIEDILTKVAAQVDSGPCVTYIGKGGSGNFVKMIHNGIEYGDMQLIAEAYDVLKSVGKLSNEELKEVFAEWNRGELLSFLIEITADIFGIKDDKGEGYLVDKVLDKTGMKGTGKWTVQQAAELSVAAPTIASSLDSRFLSGLKDERVEAAKVFKAGGVEDTLSDQVVDKKKLIDDVRQALYAAKICSYAQGMNLIRAKSVEKEWDLKLGELARIWKGGCIIRAMFLDRIKKAYDRNPNLSNLLIDPEFSKEMIERQSAWRRVVCLAIGAGISTPGMSSSLAYFDSYRRERLPANLVQAQRDYFGAHTYERIDIPGAFHTEWFKLAKSKI

SEQ ID NO: 14811 - protein, 338 aa, Shewanella oneidensis MR-1
MIRVAINGYGRIGRSILRALYESGKRQQIQIVAINELAKPEAIIHLTQYDTTHGRFQPRVKLVDGQMQIGDDTIKIFHEPDPAKLPWRELDIDIVYEATGAILDRQSCEAHIHAGAKQVLISHPSSADVDGTIVYGVNHDLLRAEHTVVSNASCTTNCIVPVIDVLDKHFGVKSGAITTIHSAMNDQQVIDAYHDDLRRTRAAGQSIIPVDTKLARGIERILPHMKDKFEAISVRVPTINVTAIDLSVTLDKTVDIATVNQVLELAANGRFNGILGYTDEPLVSCDFNHDPRSSIVDGTQTRVSAGQLVKLLLWCDNEWGFANRMLDTSLAMIAAKQS

SEQ ID NO: 14812 - protein, 391 aa, Shewanella oneidensis MR-1
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLYAPIACAGPLLAQELDALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVSDVGDSDMIFDIGPDSAEALAKIIESAGTIVWNGPVGVFEFDQFGEGTKRIAHAIADSKAFSIAGGGDTLAAVDKYGIADKVSYISTGGGAFLEFLEGKELPAVAMLKKRGA

SEQ ID NO: 14813 - protein, 707 aa, Oryza sativa Indica Group
MASYGELTISCLTAIAVAGAALLAGGAEAQCLHTCGGIDIPYPFGIGSDGDCALPFYNIDCNNKKPFYRDVEVLSISLQLGQIRVSTPISSSCYNPFSKRMYSSGWGFNLSYTPFMLSDSNKFTVVGCQSLAYISDPTSNYTSGCASSCPGGKVVSATNSTCFGIGCCQITIPRGMEFCKVSFGESMNTSGIYEHTPCSYAAIMDYSNFTFSTSNLTSLLEFNNTYSGRAPVKFDWAIWGPRDCVEAQKNLTSYACKSDHSVCLNYSSGAKSAYMCNCSKGYHGNPYLQGSNGCEDINECEYPESYPCYGECHNKDGGFDCFCRDGVFACILSILFGFLGWEVIRHKRSIKRQALLRQNDEFFQQHGGQLLLEMMKVEGNAGFTLYGRQEIETATNNFNKANIIGEGGQGTVYRAVLGGIAVAIKMCREIDENRKMEFVQELVILCRVNHPNIVKLLGCCLQFEAPMLVYEFVQNKTLKELLDLQRSTRFHVTLGTRLRIAAESAGAFAHLHSLSHPILHGDVKPANILLAEGLVAKVSDFGCSTIDESTPAVPKGTPGYIDPDYLLEYQLTAKNDVYSFGVILLELLTGKKPFSKERKSLTLMFQEAMVNGTLQDLLDSDIVNEASMRVIHRVAVLASQCLVVPGTTRPSMALVVEELWRLALADELQRYPQPPLVLEELSFLDTGSTSGIYSLDNKAVLSTTFAR

SEQ ID NO: 14814 - protein, 500 aa, Arabidopsis thaliana
MTNIWLLSLIFVICILVAVFNHKNRRNYQRTPPSPPGCPIIGNLHQLGELPHQSLWKLSKKYGPVMLLKLGRVPTVIVSSSETAKQALKIHDLHCCSRPGFAGARELSYNYLDIAFSPYDDYWKEVRKLAVQELFSSKQVHSIQPIKDEEVKKLIDSISESAAQKTPINLNKTLLALTVSVVCRTAFSVNFEGTVLNSERFNNIVREALEMLGSFSASDFIPYVGRIIDLLTGLQGRRERSMRDLDAFYEQMFDLHKQKKEEGSEDFVDLLLRLEKEEAVLGNDKLTRNHIKAILMDVLLAGMDTSAITMTWAMAELAKNPRVMKKVQSEIRSQIKNKERISFDDTDKLEYLKMVIKETWRLHPTTPLLIPREAMSEFEINGYTIPVKTRLHVNVWAIGRDPDTWKDPEVFLPERFTDNNIDAKGQHFELLPFGGGRRMCPAVYMGTTMVEFGLANLLYHFDWKLPEGMKVDDIDMEEAPGLTVNKKNELILVPTKFLDP

SEQ ID NO: 14815 - protein, 392 aa, Synechococcus sp. WH 8102
MPRPPELSARAVGLKPSLTLAIGAQAKALQQAGRDICSLSAGEPDFDTPDFIVEATRQALRDGITRYGPAAGDPELRAAVAEKLSSGNGIAITPEQVLITNGGKQAIYNLFQVLLNPDDEVLLPAPYWLSYPEMAALAGAKVKLIPTQAEEGFRLDLAAVEAAISPRSRLLLLNSPGNPTGRVMKRQELEDVAELVRRHPQLLVMSDEIYEFLLAEGEQHHSFAAIAPDLADRCFTVNGFAKGWAMTGWRLGYLAGHQDVIKAAAALQSQSTSNVCSFAQRGALAAIQGPRACVSAMAESYNRRRQLLTEGLQAIEGITLVEPRGAFYAFPQLPESAGGSMDFCSRALEQAGLAVVPGLAFGNDRCIRLSCAVSRETIRDGLSRLTQLLDET

SEQ ID NO: 14816 - protein, 120 aa, Triticum aestivum
HTSLPSDLVPPSSAPAKMSTVTRAYLDQRLAAAKRCSKEAAMAGAKAAAVATVAAAVPTLASVRMLPWAKAHLNPTGQALIISTVAGMAYFIVADKTILSMARKHSFEDAPEHLKNTSFH

SEQ ID NO: 14817 - protein, 414 aa, Campylobacter coli RM2228
MLVIEDVRAYEVLDSRGNPTVKAEVVLSDGSMGAAIVPSGASTGSKEALELRDNDERFGGKGVLKAVSNVNETIADEILGLDALNQAQLDDTLRELDGTNNYSKLGANATLGVSMATARAAANALGVPLYRYLGGANASILPVPMCNIINGGAHASNNIDFQEFMIMPFGFTSFKEALRSVCEIYAILKKELANLGHSTALGDEGGFAPNLANNTEPIDLLMTCIKKAGYENRVKIALDVASTEFFKEGKYHMEGKAFSSEDLIERYVELCAKYPICSIEDGLAENDFEGWIKLTEKLGNKIQLVGDDLFVTNEDILREGIIKKMANAVLIKPNQIGTITQTMRTVRLAQRNNYKCVMSHRSGESEDVFIADFAVALNTGQIKTGALARGERTAKYNRLLEIELESDEYLGEKL

SEQ ID NO: 14818 - protein, 496 aa, Aspergillus nidulans FGSC A4
MSIKQKTCKRSLTGLAIHQDLNAIEPCWAWMKKRTTSRGAPRDKKTGEAEWRQAWADLPQETIQHWIERLIRHIQIVIELEGGNEYKEGLICFIEEQEEQEEERTEEKIINEEYKTWKKNAPFLYDMILSTALEWPTLTTQWLPDKQDASDKPYSTHRLLLGTHTSSDAQNYLQIAQVQLPNPNAPNPDDYDEERGEIGGYGGSSKKAPMEINFKIVQKIDHKGEVNKARVMIWDRSKHQSVPTGTVNPQMELLGHKQEGFGLSWSPHVAGHLATGRDLTTYTKNNKALQPVRTYTHHSSIVNDVQHHPLHSSLIGTVSDDITLQILDTRVAETTRAAATAEGQHRDAINAIAFNPAAETVLATGSADKTIGLWDLRNLKTKLHTLENHTDSVTSISWHPFEEAVLASASYDRKIMFWDLSRAGEEQTPEDAQDGPPELLFMHGGHTNRISDFSWNLNDPWVLCSAAEDNLLQVWKVADAIVGKDMEDVPTEELEP

SEQ ID NO: 14819 - protein, 90 aa, Triticum aestivum
TDDDLRPPYANNAHNRSITGSGRASGNGRAIAPVSGNGRGIAPASSYPRAQTDMETQIQQLEQEAYCAVLRAFKAESDALTWEKEGLITE

SEQ ID NO: 14820 - protein, 656 aa, Magnaporthe grisea 70-15
MKPPAAAAVGDQEEASSFESRETPRPRDDTSSPTPIDRENDCDRRRPEEKHHPRLPALSNMSTQIIGKTVSPFLKEHIPGLYAPIAKSDTATKIQSKANSKFCYRHRPDLKCRRAADETKMVSIQRSLERLPTDDQQAITHVWSLFSAAPAKHRDLMLQGIITQCCFPQLSEISFKILCYLDTVSLCKAAQVSRQWRQLADDDLVWHRMCERKRLRDWTRQQQLAKSKRPQPRDPNAPPPSLPAPLSLRSPTPPKREREAEDDGGSKRLCTTRVGDGMSEEPDQPKFRPFKDVYRDRFRIGYNWRHGKCAIKILKGHSNGVTCLQLLDNVLATGSYDSTIKLWDIETGEVIRTLRGHRMGVRSLWFDDSKLISGSLDQTVKIWNWHTGELLSSLHCHTDGVITVHSDGEFLASGSIDKKVKIFNFVTKETFCLKGHSDWVNSVRVDTESRTVFSASDDFKVKLWDLDTRQCIRTFDSHTGHVQQVLPLPPDFEPDEELLQEPPAPGSPPSQSQSSAASGAATDDLGLRALYGPSFAADPQRPLPSRYMLSGGLDSTIRLIDTATGRCLKTFFGHFEGIWGLAGDTLRAVTAANDGMVKVWEPTSGRCERTFTGHRGPVSCVGLSDSRMASGGEDGEVRIYSFGGGEEVLEVVGTPS

SEQ ID NO: 14821 - protein, 248 aa, Saccharomyces cerevisiae; identical to SEQ ID NO: 944

SEQ ID NO: 14822 - protein, 211 aa, Glycine max
  misc_feature (202)..(202): Xaa can be any naturally occurring amino acid
MDVEAEIDRLPIDLLAHIFVLFTSFTDLAQASGVCKKWKQGVKESLARRHNLSFAGWKMDDDSTARLVYHAYNLTKLDIPRSRWGCQITDAGLLRISFAKCISNLTSISLWGLTGITDEGVVQLISRTRSLQHLNVGGTFITDESLFVIARSCPKLETIVLWSCRHVTESGLFALVDQCLKLKSMNVWGTRVPEECLNNLLXVSPALQIKV

SEQ ID NO: 14823 - protein, 1119 aa, Aspergillus nidulans FGSC A4
MYKTGNHSSDPARKNHRSAPPIPERLNTGNSRLMRQTRTAAKDSSFVLISRSGHFLANQCLASSCCSSVNLLEPDAAGSEDYMAGSHRSPVLKDQWRGSSGEVGDQRGREKHSRPRGSHRDRGRERFRDQDRHHHHPPNDDRLHRSSRSPPPRSFPGPDNKPQHRDFSTNIASTRASPAPSRSEIRPSQNINRPDSPERIGYRVTNSHMRSAERNHRREDSPSAPPFKRQRTHSPPPDGFQGRPPTHSRGAPPRHGRDFDREPSHSKGRGGRPPGRGRPSRRPSPRRERERRKHDSGLRDPSRNRQPWSHDWEDKPPIHPSRRYRSPPLDGIERDSYLRSPSRVSAGTLDSRTSALSRRGSKGDIAMHPPPSPSRLSLDRVPDTGYGAGLPERSRASRSPVNSYHESTRPSSPYSTARSGRSGQHSSHPSQHSFRASNFSEHDSPSRLSHGQPTSSHHVAPSHSYRDGQQRYQETHQDRRISGIVPTAPLSHARNRFSSPQRDASASRSRAGPPSPPQGPAADDPPPPPPPPTEPRSHREGYQNLTNHRPASRETRAPDEGSGHDSGSGFRAGQTGQPDTRPPEPPSGPSKGGKISFAFKAKTGPPSAPKPVPDLAQRMLAREPPQRVAEPPRSKMSSGPPPRFKPEPRFDRRDRDRDRHRDRDRNRGRNDRRDYREPRGSREARDYRDSRRDDRRVDPRDKRRNDKASGVRPERRHDPSPEPVKRSKIMLRLKPRPTISEEFANSDSVYFRKPGNESVIGAGTYGKVFKAIHVYTQRKVALKKIRMEGEKDGFPVTAVREIKLLQHLRNHNVVSLLEVMVEKNECFMVFEYLSHDLTGLINHPTFTLTAAHKKDLAKQMFEGLSYLHHRGVLHRDIKAANILISNQGRLKYADFGLARFFSKSRQLDYTNRVITIWYRPPELLLGETQYGPAVDVWSAACVYVEMFTKKAVFPGEGGEISQLDKLYNTLGTPTRAEWPNIVEMPWFELMRPTERRKRIFEDIYRDILSPAALDMVSQVFRYDPAKRPSAEDVLAHPYFHSEEPSPQQPIELENIQGDWHEFESKALRKERDREARRAEYQRDKEKRKILAAQDERETKRIKPDTSDGLTSSVPQPGQQ

SEQ ID NO: 14824 - protein, 585 aa, Enterococcus faecalis V583
MKKTKIVCTIGPASESVDMLVNLINAGMNVCRLNFSHGDYEEHGARIKNIREAVKITGKRVAILLDTKGPEIRTNDMENGAITMKIGDSVRISMTEVLGTNEKFSITYPELINDVNVGSHILLDDGLIDLEVTDIDRDANEIVTVVKNEGVLKNKKGVNVPGVSVNLPGITEKDANDIRFGIGQGIDFIAASFVRRASDVLEITKILEEENATHIQIIPKIENQEGIDNIDEILKVSDGLMVARGDMGVEIPTEDVPVVQKALIKKCNALGKPVITATQMLDSMQRNPRPTRAEANDVANAIYDGTDAVMLSGETAAGDYPLEAVQTMARIAVRTEETLVNQDSFALKLYSKTDMTEAIGQSVGHTARNLGIQTIVAATESGHTARMISKYRPKAHIVAITFSEQKARSLSLSWGVYATVADKPSSTDEMFNLASKVSQEEGYASEGDLIIITAGVPVGEKGTTNLMKIQMIGSKLVQGQGVGEEAIIAKAVVAATAEEAVAKATEGAILVTKTTDKEYMPAIEKASALVVEEGGLTSHAAVVAIAQNIPVIVGAADATSLINNDEVITVDPRRGIVYRGATTAI

SEQ ID NO: 14825 - protein, 636 aa, Zea mays
MRWHCFTTSATACHSQCSISSSAFSVIAVHGSGDTELSHSEADKVPATAALPNLREKICCRFVDRTKLSRHVHLIHFSLPSPDQVLGIPTGTHVFDCTSVDGKPCMRLYTPPSKEDEVLATTPNRCLMNCFILTQSCFSPPVSCSWDAVMQRQPWPPPMQSNRVVSITDRHTEEASPVRKLVAEIIGVLGSKHMRTVTPLPDTGQWLLLSLIEKLPQSVVDLLRAHVINLHHYLMLFSLLGFSVLFDCIKAPDSNAICRGITQDMTYAAVQAYTDAYKPDWERINFIVDILRSTPGEGPSWYHLLKKVSGGCNDLKNNEHMLVVVLTKQQAIKTGGNFQIVEYFLVEAIQIQSYGAEGNTELNLSTGDYIVVGVSDVQVWCGCDLLFRITDWHIPWHIILAVSKISIGLGASRSSRMEKCQPYVQSSVTSRDKQKLFVRFFGVLYRVFNKMNFMLLLDDDWEPLMDNYRPLGIKSLRFSTFSLGNMSPKIEEQKIQYTIHTIGGSLTAVHGFFVQLGVNVDTSDWELQALGRLSVTVAKQAKLDRFPITISDPISATFGEPFEKANPSHSSTAIVCRAGSGIDMVVGLVSSSLGAVASGQGNFKVLVWDPGGYAYHSLGTSCISSGGECQHLRQEQ

SEQ ID NO: 14826 - protein, 341 aa, Vitis vinifera
MAFTTALSLPSAARLHHRLPNRSSLSLPRTIRCSSPSISVSPSKSMQFDLRSYWTTLISEINTKLEEAIPVKYPQQIYEAMRYSVLAKGGKRAPPVMCVAVCELFGGDRLAAFPTACALEMVHAASLIHDDLPCMDDDPSRRGQPSNHTVYGVDMAILAGDALFPLGFRHIVSHTPSHLVPEGQLIRVIAEIARSVGSTGMAAGQFLDLEGAPNSVDFVQRKKFGEMAECSAVCGGFLGGAADDDILRLRRYGRAVGMLYQVVDDVLKAKTKSEEDEEKKKKGKSYVDVYGMEKAMEVAEELRAKAKRELSGFDKYGDSVVPLYSFVDFAAERGFTIDTSV

SEQ ID NO: 14827 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14828 - protein, 473 aa, Enterococcus faecalis V583
MTKQQFGVVGMAVMGKNLALNIESRGYTVALYNRTGSKTTEVVEEHPDKNFQATYSIEEFVNAIEKPRRIMLMVKAGPATDATIQELLPHLDKGDILIDGGNTFFKDTMRRNEELANSGINFIGTGVSGGEEGALKGPSIMPGGQKEAYELVAPILEKISAKAEDGEPCVTYIGPNGAGHYVKMVHNGIEYGDMQLIAESYDLMKQILGLSVDEMAEIFKEWNEGELDSYLIEITADILTRKDDEGTDQPIVDVILDAAGNKGTGKWTSQSALDLGVPLPLITESVFARFISAYKEERVKASGILSKPAAFNFAGDKKELIEKIREALYFSKLMSYAQGFAQLRAASEEYGWDLPFGEIAKIWRAGCIIRAQFLQKITDAYEKNPALENLLLDEYFVEITKKYQQAVREVVAIAVQAGVPVPTFSSAIAYYDSYRSDRLPANLIQAQRDYFGAHTYERTDKEGIYHYSWYNEE

SEQ ID NO: 14829 - protein, 270 aa, Zea mays
MRDRNELPTPRIEGEILSSSNLKAFTFNDLKNATKNFRPDSLLGEGGFGHVYKGWIDEHTLAPSRPGSGMVVAVKKLKPEGFQGHKEWLTEVDYLGQLHHKNLVKLIGYCSDGDNRLLENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTSYAQDAVLNVTCLAYAVQRVAKAINEKTYNALLLKFSDI

SEQ ID NO: 14830 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14831 - protein, 263 aa, Zea mays
  misc_feature (172)..(172): Xaa can be any naturally occurring amino acid
LVTSSSNLTWNILVLVTVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYRDFVKDFPIVSIEDPFDQDDWSSWASLQSSVDIQMGGEDFLVTNPKRIADAMDKKACNAXLLLKVNQIGIVTESIEAALDSKAAGWGVMVSHRSGETEDNFIADLAIGLASGQIKTGAPCRSERLAKYNQLLRIEEELGNVRYAGEAFRSP

SEQ ID NO: 14832 - protein, 504 aa, Xylella fastidiosa 9a5c
MLTRKKSMDCKVGRLGMPIALAVSDCYPNPKRFPLMSLENVEKLVKDKKIEFVDLRFVDMRGVQQHVTFPVNILEPSLFKDGKMFDGSSIAGWKGINESDMVLLPDANTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNGGYRPAVKGGYFPVPPTDSLHDLRAEMVKTLEQVGIETEVHHHEVATAGQCEIGTKFNSLVKKADQLMTMKYILKNVAYRNGKTVTFMPKPMVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFIDGYIALKMQEVTQFRAATHPLEYQMYYAN

SEQ ID NO: 14833 - protein, 290 aa, Oryza sativa Japonica Group
MAKDIEAAAAAEGGEYMAKDYSDPPPAPLIDAEELTKWSLYRAVIAEFVATLLFLYITVATVIGYKHQSDPGANAADAACSGVGILGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 14834 - protein, 728 aa, Populus tremula x Populus tremuloides
MGKKQKEDASGAPSKAKAGNKDAKKEKLSVTAMLASMDQKPDKPKKGSSSTVTSSKPKPKSAPSYTDGIDLPPSDDEEEPNGLEEEQQQNDPNKRPSQRRSELKPLDVAISDKELKKREKKELLAAHAIEHARQEALKDDHDAFTVVIGSRASVLDGEDEGDANVKDITIENFSVSARGKELLKNASVKIAHGRRYGLVGPNGMGKSTLLKLLAWRKIPVPKNIDVLLVEQEVIGDDKTALQAVVSANEELVKLREEVASLQKSDGPAEGENNGDDYDEDDAGERLAELYEKLQLMGSDAAESQASKILAGLGFTKDMQGRPTRSFSGGWRMRISLARALFVQPTLLLLDEPTNHLDLRAVLWLEEYLCRWKKTLVVVSHDRDFLNTVCNDIIHLHDQKLDSYRGNFDDFEVGYEQRRKETNKKFEIYDKQMKAAKRSGNRVQQEKVKDRAKFAATKEAAKNKGRAKVDEDQAAPEAPRKWRDYSVEFHFPEPTELTPPLLQLIEVSFSYPNREDFKLSNVDVGIDMGTRVAIVGPNGAGKSTLLNLLAGDLVPTEGEVRRSQKLRIGRYSQHFVDLLTMDETPVQYLLRLHPDQEGLSKQEAVRGKLGKFGLPSHNHLTPIAKLSGGQKARVVFTSISMSKPHILLLDEPTNHLDMQSIDALADALDEFTGGVVLVSHDSRLISRVCDDEEKSEIWVVEDGTVTAFPGTFELYKEELQKEIKAEVDD

SEQ ID NO: 14835 - protein, 422 aa, Erythrobacter sp. NAP1
MKFGGTSMAGTERIRRVANIVRAQAAGKDGEANEVAVVVSAMAGETDRLVNFCREANALYDPAEYDVVVSSGEQVTSGLLALTLQSLGCKARSWLGWQLPVKTEEAHAKARISSIEAPDMVASLEAGEIAVVPGFQGITEEGRVSTLGRGGSDTSAVAVAAAVKADRCDIYTDVDGVYTTDPRIVAKARKLKAVTYEEMLELASVGAKVLQTRSVGLAMKEGVRIQVLSSFVDDDAALADDLPGTLIVSDEEMDQMVERGEMERQLVTGIAHDKNEAKVILTRVPDKPGAVAHIFEPLADASINVDMIIQNVGRDKGETDVTFTVPQADLARAQALLEDRREDIGFNRIITDSQIAKISVVGVGMKSHAGVASTMFRSLSDRGINIQAISTSEIKVSVMIDEDETELAVRVLHTAYGLDAEE

SEQ ID NO: 14836 - protein, 269 aa, Rhizomucor miehei
SINGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATVLLCALDLYQREEGLSSSNLFLYTQGQPRVGDPAFANYVVSTGIPYRRTVNERDIVPHLPPAAFGFLHAGEEYWITDNSPETVQVCTSDLETSDCSNSIVPFTSVLDHLSYFGINTGLCT

SEQ ID NO: 14837 - protein, 292 aa, Ostreococcus tauri
MSDAEDEAQTPETLRAKLREYEDNLADVEDALREDPSDAEMREMKDSLVEVIGITRDVLETTLSALEAANANDGDARETTVEVATATPTSLARTFVGRDVLVGDAERRGRCVRVREDGKLDVYVGETHERVVVDVTEVKIDFGDRGRSAAAAAAAAAAPREVYKGVPEPKRFVEHTMKTEYTRKEAPRNLLIKPTDDAVTMEAKRKKLKAFKRRQRQQEVAAEHNAKASSWQNFQAKKRKTTGIQKGSIFALPDDLSVAKGVGFGGAARGLTHAPPKRKHNADFGGEDSGQE

SEQ ID NO: 14838 - protein, 219 aa, Arabidopsis thaliana
MPVKWLLHWQPNQGSTFSSQILNEVTQSIESLNGVKEGTWKATLNYYKPMLQDQANQAEFPREFVGISLPEEPDKYYFVIRSQRIVVEADSSIQMIMESLQSYKCKLSFYFEGLEYQLGDFRLRVGKVVPTHAETIRGVVMEVEYLPISSMGMAKKLMEEFLEIWQEAMSKRSLPGKFVNKELNFEKFGLGDNYTPQHTAVGYAFFMANLMAAIQAGRG

SEQ ID NO: 14839 - protein, 106 aa, Synechococcus sp. WH 8102
MAMAVDTPTRSPGGAAVMEKAPERVRKQSPRYKVLLHNDPVNTMEYVVTTLRQVVPQLSEQDAMAVMIEAHNTGVGLVIVCDLEPAEFYCETLKAKGLTSTIEPET

SEQ ID NO: 14840 - protein, 235 aa, Burkholderia thailandensis E264
MTLLMTQDELKRLVGEAAARYVTDNVPQGAVIGVGTGSTANCFIDALAAVKDRYRGAVSSSVATTERLKSHGIRVFDLNEIESLQVYVDGADEIDESGAMIKGGGGALTREKIVASVAETFVCIADASKRVAMLGQFPLPVEVVPMARTAIGRRLAALGGVPVLRVKQDGTPYVTDNGNEILDVKGLRIDDPRALEAAINGWPGVVTVGLFAQRGADLCLLGTEHGVETLRYAAR

SEQ ID NO: 14841 - protein, 332 aa, Bacillus cereus E33L
MNPLIFKENRPFDLIAVGRLCVDLNANETQRPMEETRTFTKYVGGSPANIAIGAARLGLQTGFIGKVSDDQMGRFITGYLKDNKINTDQIRIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEQSNDQVTAERWFSHYAKIVVIKHGGDGSIAYTRDGQSHRGGIFKTKVLKTFGAGDSYASAFIYGLIQGLEIPQAMRLGGASASIVISKHSCSDAMPTRAEISAFMETAEELV

SEQ ID NO: 14842 - protein, 275 aa, Streptomyces coelicolor A3(2)
MGYARLQSIHVHPVKAFRSLSLQEAVVEPWGPAGDRRWMLVDHGGKVVTQRRQPRLALAAAELLPGGGVRLSAPGMAPLTVPVPRAVGTVGVQIFRDKVEALPAEDAAAHAWCSTLLGTDVRLVHLDDPATRRPVDPAYALPGETVSFADGFPLLLTTTASLDALNSLIARGEHAHEGPLPMDRFRPNLVVSGTEPWAEDRWSRIAVGEVVLRVAKPCGRCVVTTTDQGTADRGAEPLHSLGRHRRVDGKLVFGQNLVPLGPGTVRVGDPVRIAQ

SEQ ID NO: 14843 - protein, 488 aa, Bacillus cereus E33L
MTVQTAPQIVKNYIGGEWVESISTKMEAVYNPATGEVIAQVPLSTKVDVEQAVSAANEAFKSWSKTAVPKRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVGRLVEEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 14844 - protein, 277 aa, Campylobacter coli RM2228
MCEINFFTQTSYIISKEYFESLTMFKLDNLLKTAIDASNEASKAILKERKNLQIWQKQDQSPLTSADLASNEILNDILGKTDIKILSEEGLLSQEESKNLQSYWLIDPLDGTSGFLKGSDEFCIMISLIHEDRPILALIKNPSKGDIFYAHQNTRVYKNDKILDISEQDFIDNQSKALLSVNHLSKEDENFAKKHNLTPINIGSGLKFCAILEGRAGVYKRFEKLNSWDIAAGDFLVNQKGGFMGTFSKEMILYSPLNYKCEPFICVSKKSFLNIYT

SEQ ID NO: 14845 - protein, 595 aa, Oryza sativa Japonica Group
MAAPGPGWVVPPPPQPQPQQQQQAVVVDGRDGLVAWLRGEFAAANAIIDLLLAHARDAADPAGFDAVAAAVQRRRHHWAPVLHLQHYFPVTEVALALHHAAARQGPPPPPPPPRPPSGSAGAEGDDAAIASGGVKEVETSAEATQNSQLVSHISHATEAQPQKGLHVISNVVPVPTCFVVNEVIDGRMVNVLEGLKLYKGYVDLTEIGKVLSFVNEAKTMRRKPGLEGQTVVVAKRPMKGHGREIIQLGLPITEGPPEDEHLREVKVDPIPGVLQNLFDSLVHQKVVPSSPDYCVIDIFNEGDYSHPHHHPPWYGRPICTLCLTDCDMVFGHVIAADSRGDHAGPLKLSLSTGSVLVFEGKSADIAKRALPATSKQRILLSFGKSVSRKHVQSESSLLITPPLTPPPMPWAAPLRPGNIAIHPSSPKQLVYNPSNRVPAVSTPGLHHIPSNGIQTVFVAPLPITPKAVPFASAVTLPNSTAAWIAEAAPRPASPRLPLQGTGVFLPPGSGNPPPAQKLGVKHADAKPFFPQESSASSSGVSARAHKANGSVSSKPTRKDDMAEAKPKCNGSSDGGSSVAHAKATGGLEEQNVVAK

SEQ ID NO: 14846 - protein, 239 aa, Xylella fastidiosa 9a5c
MILAQVSGHSLSSERFMSNCLIAPSILSADFARLGAEVDAVLAAGADWIHFDVMDNHYVPNLTFGPMVCKALRSYGITAPIDVHLMVEPVDRIVPDFTQAGASMISFHMEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHAPDYGDVIAHMRAAVAAVR

SEQ ID NO: 14847 - protein, 431 aa, Bacillus licheniformis ATCC 14580
MSKQEIHNETIAVIGLGFVGLPLAMLLISKGMRVIGVDLDKKKVEALRKGTSYISDINDQAVQDGIGTGFFRPVSDYSLIGEADAVIICVPTPLNDDAGPDLNYVKRAAQLIGAHLKKGQLVVLESSTYPGTTRDIVKPILEKSGLVCGKDFYLAYSPERVDPGNQFPIEVVPKVVGGATDACLEKVHQLYSGIYEEVVPVTSPETAELTKLLENTYRFINISFINEFAMICDRLGVNVWEVIEAASTKPYGFAAFYPGPGIGGHCIPVDPLYLQFVMKQSGLSSDFIELSEATNDRIVRYISERSLQLAGKDKATDARILIYGVTYKRNIADVRESKSLDIIEKLIGMGADVSYHDPHVPDLDLSGKKLASVPIDSKMLKEYDCVVILTDHDALPKELLLNHANVIFDTRGVLREAAGKAKVIQLGNGRS

SEQ ID NO: 14848 - protein, 540 aa, Campylobacter upsaliensis RM3195
MGDFLEIFLITSGLAVLLNVFFKKFEIPTIIGYILVGIIISYAYGFNGGAELSHIAEFGIVFLMFTIGLEFSFTHLMAMKKEVFLNGSLQVTICGLVCFLLVLGILGLGGKVGIIVGFALALSSTAVVLKILNDSGDIKEQYGRKALGILLFQDIAVIPLLLLVDIFSSNNQNITQLILTTLISVVILLTLLYLIGKYLIDRIFRFVIRASSNELFILTILFIVMGASFLAHYFGFSYSLGAFIAGVLIAKTKYKYKIEADLVPFRDLLLGLFFISVGMQINFKVVFENWDLILLLTLLVELLKFGVIFGILVIYNKKQVAIKTAFSIAQIGEFALAIFSLLQAKNMLDGQTTQILIVLSIITMILTPFILNNIRRISNAVEDIMQTQEVTQPQAVNSTLKNHIVIFGYGVIGQEVVQKIKNSGVPYLVLENDLNLVELGLSRGENVYFANAAQEETLKIANIEECAVAIITISNEARLTMLYQALESYKDIDIVIFTNSDSKKLFYSKIDKNVEIVQTERVLARALISAALEKRINKNA

SEQ ID NO: 14849 - protein, 449 aa, Zea mays
METQVAAPPHQQQQQQQKAANLARTFTKLLRRKRAEAAAQGGAPEAPASVAPGDALEEERTEPPPAIPSLSKLKLSGNLAAAYSFDAFFRNAAEKKAAAAGGGAVRQAAGAGEVTLEAAADALLANLFAGVSAVKAAYAQLQLAQFPYDAEAIQSADAAVVAELTRLSDTKRRYLRDPAAAARGAAAAGHTALAAHAEEQRHLLKTYQITARKLESDLRARDAEAERARSSLTAELRAERALEARLHPGRTLASLDELHLSGLNPTHFLTALRHTVKSIRSFSRSMLSSMQSAGWDLGAAAAAVHPGVPLRRAGDAKFVFESYVAMKMFANFHRRDFNFSFLGEREFYERRRFFEEFTELKAEPASAFLDARSPRWGGLGKFLRAKYLSLVHARMETAFFGRLEQRGIVSAGPGFPESSWFADFAEMARRVWLLHCLFFAFDGGAEEDG

SEQ ID NO: 14850 - protein, 388 aa, Chlamydomonas reinhardtii
MRAVTWHGPKKIVMEERPRPMITDPTDAVLRVTSSAICGSDLHLYLGSAPGMQRGDVLGHEFMGFVEEVGPEVKHVKKGDRVVACFDIACGHCRSCSRGAFSGCDITNPSKDQEMMYGARTAGMFGYAHVTGGYEGGQTDYVRVPFADVNLLHVPKDLPDNKLLLLSDIMSTAWFANELGSVGPDTTVAIWGAGPGTCQRASVSASQRVRGAPRIILIDNQHTCRLACTHAHTHTHTHTHTHTHVKEALERLVPGGPDVCIEAVGFHYCKSLVHAVMVKVRTLMETDTADILNELIYCCRKGGTIACIGVYVGLVNGFNIGALMEKGLTLKAGQTPVQKYWGHLLEMVKSGKLDPTMIITHELPIEDAPHAYKIFNDKTDGCIKVVLK

SEQ ID NO: 14851 - protein, 760 aa, Oryza sativa Indica Group
MSKQGESVFQRSYVVRTVSTGRTGQHPLNGARLRSEETNPEQQRRRIQDSQKSSVPFHMLPSLLWLCIGIAAYCSAASAGICERSCGRVEIPYPFGLDPACALPGFNLTCNATGDGKPYYKDVELLNISLTEGQVRMRMDIANYCYNSTSGGMNGRSWSLNLTGTPYRLSDFGNKFTAIGCQTLAYLIVGDELTTGCVATCKEDDLVRLTDGVCSGIGCCQTAIPKGLQYYGVTFEQGFNTTKIYNMSRCSYAALVEASSFNFSKNYSTSSAFNDHYHGQAPLLVDWAIGNETCKVARGKSNFTCISKNSECVDSLNGPGYRCNCSQGFHGNPYLKPEDLDSCQDIDECKEPYKYPCHGKCRNKVGGICASLVVALTTLLGIELIKYKQRIKRQDIMRKRGEYFHLHGGQLLTDMMNIENNISFKLYDRDDIELATKGFDKTSIIGEGGQGTVFKGYNLDQLNNPVAIKKCKGFDENSRTEFTQELLILSRVNHENIVKLLGCCLQFEVPVLVYEFVPNKTLHYLIHSQNDPSIRTLEIRLKVAAESAEAFSYLHSLDHPILHGDVKSMNILLSNNFIAKISDFGCSKIRAADGHDDVVKGTIGYLDPEYLLKFELTDKSDVYSFGVVLLELLTRRTPLSKQKISLASVFQEAMKEGQFLELIDTEILHEDNMGLIGDLARLACQCLAMTSESRPTMCRIAEELRRIEKQVRQHRGVLTTISSLSLLASSSADTSLHFTGETNGYNSLRSVAAMSIEFAR

SEQ ID NO: 14852 - protein, 593 aa, Borrelia hermsii DAH
MKKCLLSLKNLIILLILLLNANLAYSQRLIKIGQEEIKNKNYLQAIKILSEAIQKYPKVQNGYYFLAIAYRENNQLTEAEGALLDGIAIGGDIDYKLYFELGNIMFKRGEGYYNLAIKYYSNSVKNMPNYDKALLNRANSYVEQGKINFKEKDYKNAWDSYSMAIHDYSQFITLRYESEKKNSILHMIDLLRNKKAALEKLDKSLKNRSEHIAIGQQQDHGNKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKDKPADKEPQINKKEPTGKNKPADKDKFKDNLKTDSLIELDKINWQEELNIDE

SEQ ID NO: 14853 - protein, 299 aa, Glycine max
MEETIPVIDVEKINCEEGECKKLREACERWGCFRIINHSIPATLMADMKKVIEALLDLPMEIKKRNTEFIAGSGYMAPSKVNPFYEALGLYDLASSQAMHNFCSQLDASPHQRQIMEAYGQAIHGLAVKIGQKMAESLGVVVADFEDWPCQFRINKYNFTPEAVGSSGVQIHTDSGFLTILQDDENVGGLQVMNNSGSFVSIPPFPGTLLVNLGDIARVWSNGRFCNLTHRVQCKEATKRFSIATFMIAPRNRNVEAPAELVDHDHPRLYQPFIYEDYRKLRISNKMHKGEALELLRLA

SEQ ID NO: 14854 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNCELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 14855 - protein, 532 aa, Enterococcus faecalis V583
MKNSEEHEPKQRHHLIEYANGPSLEEINGTIDVPKNMSFWKTLFAYSGPGALVAVGYMDPGNWSTSITGGQNFQYLLMSIILISSLIAMLLQYMAAKLGIVSQMDLAQAIRARTSKTLGIVLWILTELAIMATDIAEVIGGAIALYLLFHIPLGLAVFITVFDVLLLLLLTKIGFRKIEAIVVALIVVIFVIFAYQVALSNPVWGDVIKGLVPSAEAFSTSHAVNGQTPLTGALGIIGATVMPHNLYLHSSVVQSRKIDRKDKTDIQRALRFSTWDSNIQLTMAFFVNSLLLIMGVAVFKSGSVKDPSFFGLFDALSNPAVMSNSILAHIAGSGILSILFAVALLASGQNSTITGTLTGQIIMEGFIHMRVPIWLRRMVTRLLSVIPVLICVLMTSGKSTVEEHIAINNLMNNSQVFLAFALPFSMLPLLMFTDSRVEMGEHFKNSWLIKLLGWVSVIGLIYLNMKGLPDQIEGFFGDNPTASQITLADNIAYVIIALVILLLVWTVVELYKGDKRYAQQLAAMEQQVEEVK

SEQ ID NO: 14856 - protein, 195 aa, Lentisphaera araneosa HTCC2155
MFFCNFVWCRCLKIKYKINLGKRMSEDFSSCLRDIPDFPSPGIIFKDISPLLANPQKFTAVIEAMAKLVKDKEIDYLLGIDSRGFIFAAALAQKLNLGMVMARKPGKLPGDVVSQSYELEYGTATLEIQTDAFKAGDRVLIIDDVLATGGTARAAGDLVEKMGAQTAGFAFFVELEFLNGKQVLDSSSVTSLVKF

SEQ ID NO: 14857 - protein, 445 aa, Salmonella enterica
AVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 14858 - protein, 524 aa, Magnaporthe grisea 70-15
MASSFITRATSDSRFQFAATALLSGAVAAGAILSYQRVAKEERLSKLKSSIPAPDEDGDMSRSQQLTDFGATLPTNPDKEDLRNAALARRAMAGDYDEELILEQLARNAVFLGDEGMTKLRRSFVIVVGCGGVGSHCATSLARSGVGRIRLIDFDNVSLSSLNRHAVATLADVGTQKTACLKRRLVAIAPWIRFDLCTEKFDSEAEERLLGPWAEDGAKPDFVVDAIDNIETKVELLRYCHEHKIPVISSMGAACKGDPTRVMVGDVGVSTDDPLSRATRRRLKLLGITSGIPVVFSTEQRGEGKAELLPLSEEEFQKGSVGDLGVLPDFRVRILPVLGTMPAVFGYTAANHVILSITGYPTDYAPGKSRDKLYDQALASLQGTEAKVVRSFNGGNADIVVGLRTPLSPGDIAFMIEEVFRGRSAITGIATRLVLVRWRRPATDPLMVIEGAPDDDGPQKSAPAPQKSTRLRLSDLVCMTKDEAMVHLREVLLAGKQPEEMYDAETVERVNMRLSEAAGYEKFR

SEQ ID NO: 14859 - protein, 242 aa, Solibacter usitatus Ellin6076
MSGAKPLGARDEQEAARWVRGMFGRVAHRYDLANHLLSLNIDRYWRAHTVNKVRDVLERPGARVLDICCGTGDLVLALAKTGHPVLGSDFCHPMLIAAHQKIANRRAPAVLFESDALRLPLRDASLDLLTVAFGFRNLANYEAGLAEVRRVLRPGGLAAILEFSRPPNPAFGALYNFYSRRILPIIGGAISGSRDAYTYLPDSVSKFPDAPQLAAKMTAAGFSGVDFEYLTGGIVALHLGRT

SEQ ID NO: 14860 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14861 - protein, 628 aa, Lentisphaera araneosa HTCC2155
MKERGIPLLDAIDLTYAIGHRMLLDHVSFTIHNKDRVGLIGRNGTGKSTLLKILSKQLEPFEVSEIRFSKGLKVSYLSQDFDIDPNLTVIENIREGAGYIYELLKQYESGDQTEDEMFRIQDQITALDAWDLDAYVFELISRLSCPSADTPCKDLSGGEKRRINLAKVLVSKPDLLILDEPTNHLDSHAVEWLEKWLETYSGALIMVTHDRCFLDSVCNRILELREGQADFFPGNYSVYLEQSAARDMAMLRADNKRHQFLKKELEWVRRSPKARTTKSQSRVDRFNDLNDKENYAVQADAELVLPPAKVIGNVSVSLENVCKSFGDKQLFKDLSFELEPGSRIALMGGNGMGKTTLLKMIIGQAEADSGTIVRGASLDYNYVDQSRSQLNEDNTVFKEVADGAESVRLGDISLSTRSYLRRFLFTDDRINTKVSKLSGGERNRLLLARLLRKPCNLLILDEPTNDLDLSTLQVLEEALVAWKGTLLLVSHDRWFVNRVCNGILGFEGNGQVYYQDGDYDYYLEKKAERETKQVKVEVETKKVAPKAEEPKKATKKLTWKEERELEGMEDFVMELDEQISAIETAMHEPDFFQQEAELIQEKTNELESLRQKLDQAYARWEELEAKKA

SEQ ID NO: 14862 - protein, 445 aa, Salmonella enterica
AVMGRNLALNIESHGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPASDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14863 - protein, 293 aa, Rhodococcus sp. RHA1
MSPRVPSIVLNSGTIIPQLGLGVWQADNDETEHAVGFALDEAGYRHIDTAAAYGNEEGVGRGIANSGVAREDIFLTTKLWNADQGYEPALKAFDASLGRLGVDYVDLYLIHWPLQDDDRILRTWDALEKIAESGRAKAIGVCNFEPRHLQLLIDRGGVVPAVDQVELHPHLAQQEIRTFAVEHGIAVESWSPLGGTSNSGWGDDSKPNTLLTDPIITRIGDRHSKSPAQVLIRWHLQSGLIVIPKSVHESRIRENIDVFDFELSEQDLSEIETMDDGVRVGAHPDELNIDAPE

SEQ ID NO: 14864 - protein, 96 aa, Zea mays
  misc_feature (30)..(30): Xaa can be any naturally occurring amino acid
GSISFFNTQNHRGGCPLCWWVAASTHEHHXSRMHNNPTISTTSRLANIYQHPDMITPAFHAQGQPIDPDTMQEHFQDFYDDIYEQLGNRRENENLN

SEQ ID NO: 14865 - protein, 365 aa, Sphingomonas sp. CHY-1
MEAYAAIIERQGGEFVLDTVSLEDPRDGEVLVKIAAAGMCHTDLTVRDQHFPTPLPAVLGHEGAGVVERVGRGVSTVKPGDKVVLSFSYCGTCPSCLKGHQAYCPSLFPLNFMGRRLDGSTPITRNGEDVNACFFGQSSFATYSIASENNCVKVADDAQLELLGPLGCGIQTGAGAILNSLQPAPGSSIAIFGVGSVGLSALMAAKSSGCLKIIAVDRNPARLEIARELGATDVIDASTTDAQEAIVAMTGGGADYAMDTTAMPQVLRSAVESTHNMGETAVVGGAKMGTEFILDMNNILFGRKLRGVIEGSSTPQVFIPQLIAMQKAGLFPFEKLCSFYDFDQINQAVEDTEKTGSAIKAILRM

SEQ ID NO: 14866 - protein, 337 aa, Streptococcus thermophilus CNRZ1066
MSILITGGAGYIGSHTTVELLNAGFDVVLVDDFSNSSPAVLERLEKITGKKFPFYQGSILDTEFLDKVFTKEDIELVIHFAAFKAVGESVKKPLKYYKNNISGTITLLEKMKEYDVKNIVFSSSATVYGTNNPSPMTEDMPTSAINPYGYTKLMMEQILTDVAASDPSWSVTNLRYFNPIGAHESGLIGELPNGIPNNLMPYITQVAIGKLPELNVFGDDYPTPDGTGVRDYIHVLDLASGHLAAVKYNLSHKGAEIFNLGTGHGYSVLDLVKTFEAENKVTIPYRIQGRRAGDIATCYASPEKAKEVLGWEAKKTLKDMVRDSWRWQTTNPNGYED

SEQ ID NO: 14867 - protein, 495 aa, Erythrobacter sp. NAP1
MSKRDNTRIDPRGRKVKILATIGPASRSPEMLRKLFKAGADAFRVNMSHGEHADHAKAIASIRALEKEFARPIAILADLQGPKLRVGPFKDGQAVLRHSGHFTLDRDDTPGDETRVCLPHAELFGILERGQRLLINDGKIRLLVKEADEDKIFCTAEVGGVISDRKGVNVPDAEVPIPALTDKDKKDLAFAVEQGVDWIALSFVQRPADLAEARKLIASHAAGGHCPALCAKIEKPQAVGRLEEIIELSDAIMVARGDLGVELEPHEVPPLQKRIVAASRSAGKPVIVATQMLESMIESPMPTRAEVSDVANAVYDGADAVMLSAESAAGDWPEESVTMMHKIAAQVERDEGYRERIRMLDTPPDATTSDALAHSCMTIADTVPISAITVFTSSGSTARRVARERPGTPMLVLTPSMRTARRVALLWGAHAVVTRDIGSFEEMIAKGKRMALRHGFGTAGSKQVVLAGVPFGTPGATNLLHVVTLAGDELEKHRK

SEQ ID NO: 14868 - protein, 423 aa, Candidatus Kuenenia stuttgartiensis
MNKFTGGFVLVTKTQKLSKEGSAITKEKTHLVVPNDPIIPFISGDGTGPDIWNASVRVFDAAVSIAYKNKKRVHWLEVLAGEKTFNECGEWLPGETLKAIKKYKVAIKGPLTTPVGGGIRSLNVTLRQELDLYACVRPVRYFEGVPSPVKSPEKLNVIIFRENTEDVYAGIEYKKGSPDAKKLIAFIEKEFRVKIRKDSGIGIKPISVTGTKRLVRRAIQYAIDKKLCSVTLMHKGNIMKYTEGAFCEWGYEVAREEFSKSVITEEEVQKKYNGKAPKNKVVIKDRIADAMFQQVLLRPDEYSVIATPNLNGDYISDACAAQVGGLGMAPGANIGDNAAIFEATHGTAPKYAGKDIVNPGSVILSGVMMFEHLGWDKAAMLIITALEKTIRQKTVTYDLERQMDGAQLLKCSEFADRIIANMS

SEQ ID NO: 14869 - protein, 568 aa, Erythrobacter sp. NAP1
MANPLIPNLSSLKGYEGKTALADAIAGTILAILLVPQAMAYAQLAGLPPQAGLYAALVPPVLYLLFGTSPFVSVGPVALISLVIAEAASGTDVEVIEAAAIVGIEAGIILAAIGALRLGRLVNFISEPVLLGFTASVAILIFTSQLPTLIGTNPERAGNLPDALAAMWSVLPQWNVTTAAIGAAALALLLLFDWLAAPALWKIGVRPPWRQAIAKSLPLLVVVGCAIAASYVSADVARVSPPSGEMPSFSLPPLDPQLWLQFAPSALAVAVVIFATATAVAKSLAGSDRSRLDTSREAVALGLGNIGASLTGGYAVSASLSRSALVEDSGGKTPIAHVIGAALVLAVILFFAPILAFLPETALAALVISAVFGLIKPGEMKKVWQHDRLEGVVIAITFAATLLLGVMLGLAVGALAGLAHHLWISSLPRVTRVDTNDGGRSFRSIERDEMDLRTLPILILRIDRSLFFANAAFVEDEFFRLLGEHDVVTCLVIDMRAVNAVDASGAAMMQRLTERVHSQGIAIHFAAVHEPVRERLTRLDSNRCHFHRTVGDAMESCGSPQDEPIAPS

SEQ ID NO: 14870 - protein, 325 aa, Campylobacter upsaliensis RM3195
MIKSIAEWSEQECLMLALPHKNTDWKPYLSEIIEAYKEFVKTASHFQKLLLIAPNDEDFTPFKEFGNVEFFKCETNDTWIRDFGAIDVLENGRLKALDFTFNAWGGKFQSDLDNALNTKLFKEKFQTRLEKCDFILEGGSIDFNGAGTMLTSSFCLLNSNRNVNLNQAKIEEKLKNYFGLERIIWLENGFIKGDDTDRHIDTLARFIDENTIAYCICEDEKDEHYTSLKAMEKELLKTNFNLIPLPIPKPLFYEDRRLGATYANFVFVNNALIVPFYKDENDEVVQKRLQAHLKDREVIGVDARVFLRQNGSLHCSCQNRFKGPR

SEQ ID NO: 14871 - protein, 467 aa, Marinobacter sp. ELB17
MSDNNVHIAVIGSGGSAMAAALKATERGARVTLIERGTIGGTCVNIGCVPSKIMIRAAHIAHLRRKSPFDEGITATEPMVDRSLLLAQQQARVDELRHAKYERILEDNPDITVVQGEARFMDARTLLVKGTDGKAHEIGFDRAFIGTGARPTIPPIPGLSGTPYWTSTTALASDTLPDRLIVIGASVVAVELAQAFARLGSEVTILARSRLLSREDPAVGEAIQTAFQAERISVLNDTQASQVSYTNDEFIVASNAGELRADRLLVAVGRTPNTEGLNLDAIDVETDHGAVIVNEQLQTRVPGIYAAGDCTNQPQFVYVAAAGGSRAAVNMTGGDARLDLSAMPEVIFTDPQVATVGLTATEAIRRGFKVDTRSLNLENVPRALLNFETGGFIKMVAERDSGRLLGVQAITGEAGELIQTAVMAMRARMTVQEIGDELFPYLTMVEGLKLCAQTFTKDVSQLSCCAA

SEQ ID NO: 14872 - protein, 381 aa, Zea mays
MPDVKSAAATVAKAVAGDSPSPAATPPAPAVASSNGTPQKPPPIPAATFDMPKPNLRGLNKPKCIQCGNVARSRCPFQCCKSCCYKAQNPCHIHVLKQSNTLPDKPSPATAPSTEQPSTNLPATSSASRLAALQKLPQHFLKSLQTKKSLTKKDAVAINKWRFMKLREHMQGDIDDENEAYERYTQNVRLLEETFYPMEDADVEPEAEAPSSDEERMDLLVSEAKVRLKSDNEIADRFKERVAAILDQKLKKLLESQSADEDDKLSDPDQDDHLNPAKFSAKQKAERSASLNELLGKLTRARSEDDLKPCRDLIEQLFGKEKGSSTDRPAGVEMEQRDQESAAAAVAQPYSVPELCARMEVDEDFAAKISDEFSLSQVAQL

SEQ ID NO: 14873 - protein, 450 aa, Chlamydomonas reinhardtii
GFVDRGGPASLPEANATMAFPSADAPWYKKLFAFAGLGFLISVGYMDPGNWATDLAAGSAFGYSLLFVVLLSSVCAMFLQYLSLKLGIATDRDLAQACRDAYHPAVNRVLWAVAELAIGATDLAEVVGCAIAFNLLLGMPLWAGVLVTAADVLLLMAAEARGGFRSLEVLVGLLTAIIAGCFVYELARSQPDFRAVAAGYLPDIRMVTDSQQLYLATGILGATVMPHNLYLHSSVIQTRAYPRTPAGRSLAVRLGGLDSSLSLLLAFFINSAILILAAAAFHEHGRTDVADIGDAYELLATSLGAKAASILFGVALLAAGQNSTITGTLSGQIVMEGFLAIKCRPWLRRLITRGTAIIPAAVVAAVMGREGVGQLLVLSQVILSLTLPFAVFPLVHFTGSRKYLGKYANGWMVSATAWTLFVLISALNINLVVQSVRDGSFGGFSTRRLF

SEQ ID NO: 14874 - protein, 409 aa, Oryza sativa Indica Group
MDTVTTMEAINAKIVSMDIVRAEIKAVDAQESLGGGVTVLVTGHLTGSDDVRREFSQSFFLAPQEKGYFVLNDILRYVGGEGDQEVEPEPELELSFPPSQQPDSVPAPSANGTSVPREQEAFSQPEQHVADPAPNAQEADLNGEEVYNPPNNTEGPVVEETPIPEVIDEVPNNVAVAMPTPSALPLPLPLYHKRRPPRSRMLQLPAPPKQEKQVAPAPVAPVADAPTFSPNPESSNIQEAEVDAHAIYVRNLPLSATPEQLEEAFKKFGAIKPDGIQVRSHKIQGFCYGFVEFEDPSSVQSAIAGSPVTISDRQCYVEEKRTAGSRGGGRGRFAPGRGGNFRGEGMRGRGNYTGGRGYGRGEFNYRSDYGGRGAGRGGSSRGGDVGYQRVDHSAGRAARAPSGTSAVAK

SEQ ID NO: 14875 - protein, 351 aa, Bacillus licheniformis ATCC 14580
MSRFFFWMMAAGVPLSVAGSLLHWPQVLLFIIYCLTIIALASYMGRATESLAIIAGPRIGGLLNATFGNAVELIISIFALREGLIGIVLASLTGSVLGNLLLVAGLSFFIGGLKYKRQEFNVYDARHNSGLLMFAVIVAFVIPEVFSAEMTEPRKLSMSVGISIIMILLYLAALYFKLVSHRGVYQTNQNEQEESHEEPEWSGKRATLILFLATVAVAYISEHLVHTFDTVAEQFGWSELFIGVIIVAIVGNAAEHASAVIMAYKDKMDVAVEIAIGSTLQIAMFVAPVLVISSLFFPTSMPLVFTLPELVAMASAVLLMIIISNDGDTNWFEGATLLAAYIIMGIGFFLL

SEQ ID NO: 14876 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14877 - protein, 334 aa, Solibacter usitatus Ellin6076
MAHQITLIPGDGIGPEVADATVRAVDATGAKIEWERVDAGARALAEQGQLIPDDVFASLECTRVGLKGPTATPIGGGHQSINVALRKKLGLYTNFRPVRMLPGLKTRYHDLALDLAIFRENTEDLYSGLEHEVVPGVVESLKIITQNASMRIARAAFEWSRRESRKKVVAIHKANIMKLSDGLFLKCCREVASHFPDVAYSEMIVDNACMQLVMRPETFDVLVLPNLYGDIISDLTAGLVGGLGIVPGANIGDNHAIFEAVHGTAPDIAGKCMANPTALMQSAVLMLAHLGERDASARLHAAIYQTYAERDHLTGDVGGKSSTTEFTEAVIRRL

SEQ ID NO: 14878 - protein, 387 aa, Enterococcus faecalis V583
MEELLMNRFVEIFGEKGTACYFAPGRINLIGEHTDYNGGHVFPAAITLGTFGVARKRDDQKIRMFSDNFKEVGLIEFSLEDLTYSDSDDWANYPKGVLNYLIESGHNIDSGLDVLFYGTIPNGAGLSSSASIELLMGTICNDLYALHCPMLELVQIGKKVENEFIGVNSGIMDQFAVGMGEKDQAILLDTNNMHYEMVPAKLGEYTIVIMNTNKRRELADSKYNERRAECEEAVRLLQKELSIEFLGELDSETFEQYQALIGDPALIKRARHAVTENERTLLAKQALTEGDLEEFGLLLNASHRSLKEDYEVTGIELDTLVACAQEQPGVLGARMTGAGFGGCSIALVPKQNIDAFIEAVGQSYQDKIGYAADFYPASIDDGARKLF

SEQ ID NO: 14879 - protein, 329 aa, Enterococcus faecalis V583
MSILVLGGAGYIGSHAVDQLISKGYAVVVVDNLLTGHRSAVHEQATFYEGDIRDKAFLRSVFEKESIEGVLHFAANSLVGESVEKPLMYFNNNVHGTQIALEVMQEFGVKHIVFSSTAATYGEPKAMPITEETPTNPKNPYGESKLMMEKIMKWCDNAYEMKYVALRYFNVAGAKKDASIGEDHTPETHIVPIILQVALGQRAELSIFGDDYDTPDGTCIRDYVYIEDLIAAHILALEYLKNGGESDVFNLGSNNGYSVKEMLDAAREVTGQEIPATIAPRRAGDPSTLIASSEKAKRVLGWQPEVTEVKDIIATAWQWHVKHPQGYNE

SEQ ID NO: 14880 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGQNLSNEELASTFTEWNNGELSSYLIDITKDIFTKKDEDGNYLVDVILDEAANKGTGKWTSQSALDLGEPLSLITESVFARYISSLKAQRVAASKVLSGPKKHPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14881 - protein, 192 aa, Wolbachia endosymbiont of Drosophila ananassae
MNNNINIGAQNCHHKKFGSYTGEISAEMLKELGCTYVILGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLNISNLSGVLIGSASLDFDHFYKIIQQVEKKFSLINSKISN

SEQ ID NO: 14882 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASGEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14883 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14884 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVSYAVQNGIPVPTFSAAVAYYDSYRAAVLPANLIQAQRDYFGAHTYKRT

SEQ ID NO: 14885 - protein, 281 aa, Parvularcula bermudensis HTCC2503
MVFPLLRSSASFGNMSTLPSTARLDDLIRLSLAAGDVIMEVRSRAFEVQEKADGSAVTAADQAAEEVITAGLNALDNSIPIIAEEAASEGKIPEAGSRFFLVDPLDGTKEFINKRDEFTVNIALVVDGLPVMGVVFAPAKGILWAGDPDGAIRQKASGSPFALVGEPEPIRARDVPADGRIAIASRSHRSPETDEALQKLKTGDIRSAGSSLKFCVIAEGEADVYPRLGRTMEWDTAAGHAVLKAAGGRVHVFANGEEQGPLTYGKVERDYDNPHFIAWGA

SEQ ID NO: 14886 - protein, 189 aa, Shewanella oneidensis MR-1
MTQSIINSTIKPFKATAYHNGEFVPVTEQDLLGKWSVVFFYPADFTFVCPTELGDMADHYAKLQGMGVEVYSVSTDTHFTHKAWHDTSDTIKKINFPMLADPTGTISRNFGVMIEEEGLALRGTFVINPEGQIKVAEIHDLGIGRSAQELVRKIQAAQYVATHDGEVCPAKWQPGDETLAPSLDLVGKI

SEQ ID NO: 14887 - protein, 376 aa, Karenia brevis
ITTVGGIFARAAVPSGASTGIYEACEMRDGDKSRYVGKGCMKAVASVNNVLAKELKGMSVKDQKALDKKMCDLDGSPNKSVLGANAILGVSLAAAKAAAQGKGIPLYEHIAELAGNTGPMVLPIPCFNVINGGSHAGNKLAFQEYFIIPVGAETFAEAMRIGCECYHTLKGILKKKFGGDATLIGDEGGFAPPCDAKSGVEFCWEAIKKAGYEGKCKIGMDVAASEFKVEGQDCYDLGTWYPEAEKTPDLKKTAAEFQALYAELCKDFPIITIEDPFDQDDWDGWVGMTGAIGEGTQVVGDDLIVTNVKRVATAIEKKACNALLLKVNQIGSLTEAIDAVKMCKREGWGIMCSHRSGETEDTTIADIAVGLCCGQI

SEQ ID NO: 14888 - protein, 133 aa, Glycine max
  misc_feature (68)..(68): Xaa can be any naturally occurring amino acid
  misc_feature (76)..(76): Xaa can be any naturally occurring amino acid
MAEHTFIMIKPDGAQRGLIGEIISRVEKKGSYLKGSKLVTVDRPFAEKHYARCAARPFFSGSVDYIIXGRVVAMIXDGRNVVTTGRKIIGTTNPAQSEPETIRGDFAIDTGRNVIHGSDAYDSAIKEIALWFP

SEQ ID NO: 14889 - protein, 768 aa, Burkholderia thailandensis E264
MSTSSSSSSKDKLREAALDYHEFPTPGKVAIAPTKQMINQRDLALAYSPGVAFACEEIVENPLNAARFTARSNLVGVVTNGTAVLGLGNIGPLASKPVMEGKAVLFKKFAGIDVFDIELNESDPHKLVDVIAALEPTFGGINLEDIKAPDCFIVERECRKRMKIPVFHDDQHGTAIVVAAAVTNGLKVVGKSIKEVKLVASGAGAAALACLDLLVDLGLPLENITVTDLAGVVYKGRTELMDPDKERFARETDARTLSEVIGGADIFLGLSAAGVLKADMVKTMAARPLILALANPTPEILPEVALEARPDAVLATGRTDYPNQVNNVLCFPFIFRGALDVGATTITREMEIAAVNAIAELAQHEQSDIVATAYGIQDLSFGPEYLIPKPFDPRLIVKIAPAVAQAAMDGGVATRPIEDMEAYKVHLQQFVYHSGTTMKPVFQIARSAPAEKKRVVFAEGEEERVLRAVQIVVDEKLAKPILIGRPAVIEHRIQRYGLRLTPGVDFTIVNTEHDERYRDFWQTYFKMMARKGISEQLARVEMRRRTTLIGSMLVKKGEADGMICGTISTTHRHLHFIDQVIGKRAGCSVYGAMNALVLPGRQIFLVDTHVNVDPTPAQLAEITIMAAEEVRRFGIEPKVALLSHSNFGTSNAPSAQKMRDTLAILHERAPELQVDGEMHGDVALDAALRKEILPESTLEGEANLLVLPNIDAANIAYNLLKTAAGNNIAIGPILLGAAQPVHVLTESATVRRIVNMTALLVADVNAAR

SEQ ID NO: 14890 - protein, 378 aa, Karenia brevis
LTTKAGISVRAAVPSGASTGIHEACELRDGVKTRYLGKGVTKAVESVNTTLNEALKGMSVAEQKALDEKMIELDGTPNKSKLGANAILGVSLAAAKAAAAARGVPLFKHFADLAGNTGPMVLPVPCFNVVNGGSHAGNKLAFQEYFIVPVGAATFKEAMQIGAECYHTLKGIIKKKFGGDATLIGDEGGFAPPCDARGGCELVMEAIEKAGYKDKCQVGMDVAASEFKTEGKDEYDLGTWYPEAEREADPGLKMTGAQLADFYAGLCKDFPLITIEDPFDQDDWEGWKVFTEKVGEPTQVVGDDLTVTNVSRVKKAIDEKACNALLLKVNQIGSVTESIDAVRMCKQSGWGVMCSHRSGETEDTTIADLAVGLCTGQI

SEQ ID NO: 14891 - protein, 217 aa, Zea mays
  misc_feature (169)..(169): Xaa can be any naturally occurring amino acid
MDSVMAAPDSPPQTVVLVSAGASHSVALLTGNVLCSWGRGEDGQLGHGDAEDRLVPTVLSGFDAPAITSVICGADHTTAYSEDELQVYSWGWGDFGRLGHGNSSDVFTPQPVKALQGLKIKQIACGDSHCLAVTMAGEVQSWGRNQNGQLGLGTTEDSLLPQKIQAFEXTEDGDLYGWGWGRYGNLGLGDRNDRLLPEKVSSVEAWCLSRQQQSGVP

SEQ ID NO: 14892 - protein, 99 aa, Arabidopsis thaliana
MAFLLNNASISSHLRSSSSQTGDALSISRRGFHIEPGTREKALLAEDSALKRFKSHKKSVHKLKRIGDVLTVVVVAGCCYEIYVKAVMKKEALAAGKSS

SEQ ID NO: 14893 - protein, 349 aa, Bacteroides fragilis YCH46
MNNHVVIMAGGIGSRFWPMSTPECPKQFIDILGCGKTLIQLTVERFGNVCPQENMWVVTSEKYIDTIREQLPGIPESNILAEPCPRNTAPCIAYACWKIKKKYPEANIVVTPSDQVVIDTTEFRRVIEKALLFTDKSSAIITLGIKPARPETGYGYIAAGEPITRDKEIFHVEAFKEKPDKETAEKYLAAGNYFWNAGIFVWNVRTITAVMRVYAPGIAQIFDRIYPDFYTEREEESVKKLFPTAESISIDYAVMEKAEEIYVLPAQMGWSDLGTWGALHTLLPKDKEGNATVGPDIRMYESQNCMVHASQEKRVVIQGLNDYIIAEKDNILLICQLSEEQRIKDFSKE

SEQ ID NO: 14894 - protein, 312 aa, Yarrowia lipolytica CLIB122
MGGSSDTQHFWIDFLMGGVSAAVSKTAAAPIERVKLLLQNQEEMIKQGRLSRPYKGIIDCFRRTWGEEGLASFWRGNTANVIRYFPTQALNFAFRDKFKAMFGYNRKKDGFWLTLYGNIASGGMAGATSLFFVYSLDFARTRLANDAKSVTKGPDGKPVEGQRQFKGLIDVYVQTIKSDGVQGLYRGFVPSVIGIVVYRGLYFGLYDTLKPIVLVGPLEGNFLASFLLGWVVTTGASTASYPLDTVRRRMMMTSGQKVKYKSSIDAFSKIVAAEGVGALFKGCGANILRGVAGAGVLSIYDQLQMIMWGKKF

SEQ ID NO: 14895 - protein, 472 aa, Candidatus Kuenenia stuttgartiensis
MSNSAFDLAIIGGGPAGYVAAIKAAQSGLKTALIEKEKVGGTCLHKGCIPTKTLLYSAELYRKFANAGEYGITTGSLNVDYPLIHRRKEYVVKRLFQGVQSLLKKNGVDVFSAEGRIISNQEVSIVSDGIETNRIKVKNIILATGSAPFIPKNIPYDKKYVLTSDDILLREEIPKSIIIVGGGAVGIEFACLFNAFGTEVTVLELLEDILPSEDKEINGTVKNLLIRRGVNVLTQTSLEKVEIENGVKLEIKGVNDISGNREFLHADLLLLAAGRVPLLDNIGIEEMSLNFDGQYLRTNEGMETSQRGVYAIGDITGAPLLAHKAINEGILSVTHLTGKDMHIINRKNIPRVVYSFPQVASIGLTQKEAEEMGYKVKIGKFPFAANSMAIIEGESLDGFVKIVSEEKYGEILGVHAIGHHVGEWMWGLSLNSILEGTVQEVSNAIFPHPTLSEALFEAAHSIVDKPICNAVE

SEQ ID NO: 14896 - protein, 286 aa, Gibberella zeae PH-1
MADTYGMNGHNGHVKDRRSSSMNGRNRLYAQQEPQRTTHLSEFGKHMVAASGEFVGTFLFLYFGYAGNIVAVLQEPISGPNGTLANNTVMYIAMAYGFSLLVNVWTFYRISGGLFNPAVTFGLCLSGQLPWIRALFLFPSQIIAAMCAGGLVNAMFPGSASIANTTLGPNTSIAQGVFLEMFFTAQLVFVVLMLAAEKSRDTFLAPVGIGLALFVALIPGVFVTGGSANPVRSFGCAVGSRDFPGYHWIYWVGPLLGAALAAGYFRLVKMMHYEEANPGQDSPVDV

SEQ ID NO: 14897 - protein, 438 aa, Karenia brevis
TFIKLVSWYDNEWGYSNRLVELASYMAIVDGVVPKPAKVVSIKAREIFDSRGNPTVEVDLLTDMHLFRAAVPSGASTGIYEALELRDGDKKRLLGKGVLKAVENVNTIIGPKLVGMDVTKQSEIDKLMVETLDGSQNDWGWSKSNLGANAVLAVSMAICRAGAASMQIPLYEYVAYLSGRPTDKFVMPVPSFNVINGGSHAGNRLACQEFMILPVGAKSFKEALIIGAEVYHTLKSCIKKKYGQDACNVGDEGGFAPSVQDNNEALDVLMDALDKSGHAAKVKIGTDVAASEFYIDGKYDLDFKNPASPPEMKKTAVEMIAYYKDWFAKYPFVSIEDPFDQDDWDAYSLFQADVGNSMQIVGDDLLVTNPKRVSKALSCSACNALLLKVNQIGSITESIEAANMSMRAGWGVMVSHRSGETEDSFIADLVVGLRTGQI

SEQ ID NO: 14898 - protein, 288 aa, Zea mays
  misc_feature (81)..(81): Xaa can be any naturally occurring amino acid
MPEIDWNLENTQIVCKLFVEQVGKGNRPNTYLNSVGYAEVEKGFKDRTGIDVTKSQLKNKWDKLKEDFKAWRKLKLRQTGXGWNREKGTIDMDDDWWKRARADIPGCGKFRKLGLQNEDEMARCFGDITNIGCDHWSPRVANDSIATNVEQPDVVPMFETQDEEFIPATQDNEDNASTPSPGSGKRLARPVQGKGKKAKTGNALLIQEAVSSMASSANEFVAKKDGKYSIDQVMEIVIACGAGYETNEHYIASELFVKKEQREMFMTLPTNEIRFNWLRRKYNDKHAK

SEQ ID NO: 14899 - protein, 480 aa, Chara vulgaris
MATATMAASGAATATATSKLNVRAPRGSSSSSSSGRKSSAIAAQALPCARSSQKGAGLCEYKGLKASTAHVFGGVTGRDAADASDLFVDSVTRDVSSKVIGSGHRGETEAKLRVAINGFGRIGRNFLRCWHGRPDSPLEVIAINDSGGVKQATHLLKYDSMLGTFNADVKTVDETHISVDGKVIQIVSNRDPLKLPWAELGIDIVIEGTGVFVDGPGAGKHIQAGAKKVIITAPAKGSEIPTYAVGVNEGDYHHDVSNIISNASCTTNCLAPFVKVLDEEFGIVKGTMTTTHSYTGDQRLLDASHRDLRRARAAALNIVPTTTGAAKAVALVLPKLKGKLNGIALRVPTPNVSVVDLVVNVENKGCTAEDVNDAFRKAANGPLKGVLAVCDEPLVSVDFRCTDVSSTVDSSLTMVMGDDMVKVVAWYDNEWGYSQRVVDLAHLVAAKWPGAKPAPDGKDADPLGTYCESNPDDAECRVFE

SEQ ID NO: 14900 - protein, 121 aa, Synechococcus sp. WH 8102
MSSQPLQWQCISQCGACCRLAPEERPEALEALNDEDQATYLAMVGKDGWCIHYDSGGRRCRIYDERPRFCRVRNMDQLFGVEPDQLDAFAIGCCQQQIRSVYGGRSREMRRFNRAQRRPDG

SEQ ID NO: 14901 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGSPTPGGVDKALNLAFNFNGTNFFIDNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAGFAIVFAEDVADVKAANPVPKAWSDLCPIYDGLSEANQ

SEQ ID NO: 14902 - protein, 479 aa, Yarrowia lipolytica CLIB122
MSKPGWTTVALAAALSSLATACVLTFTKCNPNFYDDVRTQKPAESASKSTSASKPFLAPSDDEQEELILEQLARSRVFFGDDGLEVIRKSSVVIVGAGGVGSWAATMLLRSGVGNVRLVDFDQVTLSSLNRHATASRAHVGIPKVESVKQYFSGVVPWANIEAVQDLWVPAKLSKSEQEYTEMAERLIYVNGDKPDWVLDCIDNIDAKVDLLHFCKSRDIKVISSMGAGCKSDFTQVRIADISQTAEDPLSKATRVKLRKLGVYEGIPVIFSTEKPGEAKLLPLEDSEFEKKNEENETTVGELSVLPQYRVRILPVLGSLPAIFGLSMATHVLTSIGDYASIPEYIVTQSRHKPKAYDQIQQTLVGQLARESKRRTGENGIRIAAPFDSADVGYLVEEVYKNKSVISGECSRLSLSRWRKEGPINLQNVVVMTKDEQKKHEELVLRDENPMTVEEVYPEWVLNQVEHRLRQEKHYSMYR

SEQ ID NO: 14903 - protein, 488 aa, Aspergillus nidulans FGSC A4
MALSKHIHRIAVIGAGPAGLTSVKYLLAEKCFDTVDVFERRSHMGGVWNYSPGTLKEAVSTPVPQLSPDEDIQEPVWLPRDASRPNQEPTFISPIYDTLDTNLPKELMAFGEKQFPSDVQDFPRHFTVKEYVREYGEDIKKHIQFETQVLDVQKDSSTETWSVTTQSLRSGTTTTSSYDAVVAASGHFDVPYLPEIRGIVSWNNAYPGVITHSKFYDVPDPFRNKKVVVVGSSASGLDIGNQISKVCKGKVLASQRTDLYVSPSTAMDKAYYPEIVEFLPPATHERAVRFADGRVEDNIDAIIFCTGFLYSFPYLSSLTPPIITHGRRVENTYQHLFYIHDPTLVFPVLPQRIIPFPLSENQAAVFSRVWSGRLKLPSTAEMKSWENSAVAQKGDGPGFHLMPYPLDANYLNMLHDWVSTAESRPGLVNDGNGKPCNRWGRKERWMREMVPEMRKAFFSKGEERRLVKTLEELGYDFNRWRTEQDHFP

SEQ ID NO: 14904 - protein, 409 aa, Shewanella sp. MR-7
MTYSISAENASLEDKMPNLIKPMNIVVVGMGYVGLSNAVLLAQQNRVTAIDLMPERIELVNARKATVADSLIEEYLQHKTLNLSATTDKNVVKNADFVIIATPTDYDPQTNYFNTQSVENVAKEVLTLNPDTTIVIKSTVPVGFTEGLRNKLNSDNILFSPEFLREGKALYDNLHPSRIIVGERSERAQVFADLLARAAIKQDISILLTDSTEAEAIKLFANTFLAMRVAYFNELDTYAESRGLNTRQIIEGVCLDPRIGDYYNNPSFGYGGYCLPKDTKQLLANYNNVPNNLISAIVDSNTTRKDFIANAIISKQPKRVGIYRLIMKSDSDNFRASAVQGVMKRIKAKGIEVVVYEPVLKEDEFFNSKVIRDLHEFKTMCDVIISNRMASELEDVAAKVYTRDLFHHD

SEQ ID NO: 14905 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRALYLGKIVSYAQGFSQLRAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYFGAHTYKRT

SEQ ID NO: 14906 - protein, 335 aa, Shewanella sp. MR-7
MKYLVTGAAGFIGAKVSERLCAQGHEVVGIDNLNDYYDVGLKLARLAPLETLNNFRFIKLDLADRDGIAALFAEQGFQRVIHLAAQAGVRYSLDNPLAYADSNLVGHLTILEGCRHHKIEHLVYASSSSVYGLNQKMPFSTEDSVDHPISLYAATKKANELMSHTYSHLYQLPTTGLRFFTVYGPWGRPDMALFKFTKAILAGDTIDVYNHGDLSRDFTYIDDIVEGIIRVQDKPPRPTPDWRVETGTPANSSAPYRVFNIGNGSPVQLLDFITALESALGIEAKKQFLPMQPGDVHSTWADTEDLFKAVGYKPQVDINTGVSRFVEWYRAFYAK

SEQ ID NO: 14907 - protein, 500 aa, Cytophaga hutchinsonii ATCC 33406
MGKPTGFMEFGRELPGKRDPQARLKDYKELYLDFSATQIKNQAARCMNCGVPFCHSGCPLGNIIPEFNDAVYRNDWEEAAEILFSTNNFPEFTGRICPAPCEASCVLGINKPPVTIENIEKSIVETAFEKGILKPNPPKKRTGKTVAVVGSGPAGLAAAAQLNSAGHTVTVFERADQVGGLLRYGIPDFKLEKWVIDRRVKLMEEEGVIFKTNTNVGVTVKAKDIVKEFDAVVLTGGSTVGRDLPIPGRQFKGVHFAMEFLSQQNKRVANIKPEIDHTGEAYKNGDLLATAKNVVVIGGGDTGSDCVGTSNRHGAKSVLQFELMPKPPENKNETTPWPNWPMILRTSTSHEEGCDRLWSITTKEFIGDADGNLTGLKIAEMGWVTAPDSKLPKYQELPGTERVIPCELTLLAMGFLHPQHAGMLNELGVEYDERGNIKANGKYQTNVDKVFTAGDMRRGQSLVVWAISEGREAARNVDIFLMGTTSLEAKDHGMLDTVYA

SEQ ID NO: 14908 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYFGAHTYKRT

SEQ ID NO: 14909 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQPAGGKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 14910 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAILPANLIQAQRDYFGAHTYKRT

SEQ ID NO: 14911 - protein, 470 aa, Sulfolobus solfataricus P2
MMSLEVIEVRSPSNLKVIGTVKRMSKDEVRGEIEEAYKGFEIISRMPLYKRTAILRKISEILEREQERLARLLAMEAGKPISDSRVEVLRASRLFRQAAEEVGIVLEGKNYRVDAYEYPPGNENRIVLSTREPIGVVTAILPFNFPINSFAHKVAPALAVGNSVVVKPSINTPLAAVEMKKILVEAGLPDSAVRVVTGYSSEIGDEIITHPLVGLITLTGSTQTGLKIASKAISLGKRIIMELGGSDPIIILEDANIERASSIAVRARFEYAGQNCNAGKRIIVRQEVYDKFVKAFNEKAKALKVGEPLDETTDVGPVINKESVENLNSVLEDAKVKGGRVEILNRGPESGSFFPLTMVTNPSLDMLVLKSEVFGPIVPIVSVKSDEEAIRIANSTEYGLQSAIFTNDVNRALKLSRELKFGAVIINDSTRLRWDSLPFGGFKKTGIGREGVRETMLEMTENKLIAITLL

SEQ ID NO: 14912 - protein, 174 aa, Brassica napus
MLPSGLKETQLNNNNNNQKVHPQPMEQCINQNPEAMEALISNLFGNISSLKSAYIQLQSAHTPYDPDKIQEADKAVISELKNLSELKHVYRENNPKPVCVSPKDSRLAAEIQEQQSLLKTYEVMVKKFQSEIQNKDSEITHMWEKIEEANQKRLKLEKNLKLRGMSSTNESSGD

SEQ ID NO: 14913 - protein, 358 aa, Karenia brevis
LELRDGDKGRLLGKGVLKAVDNVNNLIAPKLLGLDVTKQTMIDKLMVETLDGTQNEWGWCKKKLGANAILAVSMAVARAGAAASKMPLYKYLARLSGKPTDKFVMPVPSLNVINGGSHAGNRLACQEFMILPTGASTFKEAMIIGAEVYHNLKSVIKKKYGQDACNVGDEGGFAPSVQDNNEALDVLMEATEKAGHSAKVKIGTDVAASEFYIADTKKYDLDFKNPDSPASMKKSADEMIAYYKDWFAKYPFVSIEDPFDQDDWDAYTKFQADCGNTMQIVGDDLLVTNPKRVQKALDVKACNALLLKVNQIGSITEAIEAALMSQFAGWGVMVSHRSGETEDSFIADLVVGLRAGEI

SEQ ID NO: 14914 - protein, 382 aa, Karenia brevis
LCTESALFRAAVPSGASTGIYEALELRDGDKGRLLGKGVIKAVNNVNSLIAPKLIGMDVTRQTEIDKLMVETLDGSVNEWGWSKAKLGANAILAVSMALCRAGAAASTQTLYEYIANLAGQPSDKFVMPVPSFNVINGGSHAGNRLACQEFMILPTGATNFKEAMKIGAEVYHTLKKVINKKYGQDACNVGDEGGFAPSVQDNNEALDVLMTAIDQSGHKDKVKIGTDVAASEFFLADTKKYDLDFKNPDGSPDSMKKTADEMIDYYKAWIDKYPLISIEDPFDQDDWEAYTKFTAAVGKDVQIVSDDLLVTNPKRVATAIKKAACNALLLKVNQIGSVTEAITAAMMSIKQGWGVMVSHRSGETEDSFIADLVVGLRAGEI

SEQ ID NO: 14915 - protein, 268 aa, Haloarcula marismortui ATCC 43049
MLEATRAPSVRMSVLDSFSLDGETAIVTGAAQGLGKQMATGLTDMGADVAIADVNVEKAERTASELDGETDVIATEVDVTDEGSVEAMVEDVTDRLGPIDVLVNNAGIVENSPAEETSVESWRRVVSVNLDGVFLCAKHVGQQMLNRGEGRIVNISSMSGFDVNVPQKQASYNTTKAGVRMLTQSLAVEWGDQGVRVNAIAPGYMRTELVDEVLEENPEMEETWLENTPMGRLGRPEELKELVVYLASDASSYMTGSTVVMDGGYTSR

SEQ ID NO: 14916 - protein, 222 aa, Bacteroides fragilis YCH46
MNVTDNLKQVLAELPSGVRLVAVSKFHPNEAIEEAYRAGQRIFGESKVQEMTGKYESLPKDIEWHFIGHLQTNKIKYMAPYVSMIHGIDSYKLLAEVNKQAIKAERVIRCLLQIHIAQEETKFGFSFDECKEMLNAAEWKALANIQICGLMGMATNTDSKEQIEREFRSLNCFFHEVKKQYFANEPTFCELSMGMSHDYHLAIKEGSTLVRVGSKIFGERVY

SEQ ID NO: 14917 - protein, 457 aa, Marchantia polymorpha
MASITVGASAVSSKLTLQAQATSAARSSNVAAQAASFKRSSLGEFSGLKASSAVTFGKSSSENGFFDAVASQVAVKAGASGAIKGETSAKLRVAINGFGRIGRNFLRCWHGRGDESPLEVVAVNDSGGVKNAAHLLKYDSMLGIFKADVKVGDDTTLLVDGKPITVVSNRDPLKLPWAELGIDIVIEGTGVFVDGPGAGKHIQAGAKKVIITAPAKGADIPTYVMGVNEGDYSHEVANIISNASCTTNCLAPFVKVLDEKFGIVKGTMTTTHSYTGDQRLLDASHRDLRRARAAALNIVPTSTGAAKAVSLVLPQLKGKLNGIALRVPTPNVSVVDLVINTEKKGLTAEDVNNAFREAANGPLKGILAVCDIPLVSIDFRCSDVSSTVDSSLTMVMGDDMVKVVAWYDNEWGYSQRVVDLAHLVAAQWPGVAKPSGDPLEEFCVTNPDTDECRLHDV

SEQ ID NO: 14918 - protein, 204 aa, Geobacter metallireducens GS-15
MKVSSAEFVTSGTRPAHYPPPELPEVAFAGRSNVGKSSLINVLVNRKGLVRTSSTPGRTQLINFFRVNGSLMLVDLPGYGFAKVPLAVKKEWGPMVETYLSTRPNLSCVVLIVDIRREPTEEDQLMLQWLRAYNVAVLVVVTKCDKVSKNERAKQAAIITRTLGLARDEMAFFSALSKEGRDEVWARIEVMLAAGQEEAEESGE

SEQ ID NO: 14919 - protein, 742 aa, Erythrobacter sp. NAP1
MPRTAFQQLGITEGDVVEISGKRATAAIAMAAYPEDDSLDVVRLDGLQRGNAEAASGEHVEIVVAESRPATRVVFAPAQREMRLQGPAQALKRNFFKKPITAGDLVATTGQQPVQNMPPDVRQMLRAPAYALTQIRLSVHSTSPKGIVHIDENTEVELRTEFEEPRDARGMVNYDDVGGMEDTIQQLREMVELPLRYPELFTRLGVDPPKGVLLHGPPGTGKTRLAQAVANESDAEFFTINGPEIMGSGYGESEKRLREVFEEATRASPAIVFIDEIDSIAPKRSGVPGEAEKRLVAQMLTLMDGIESRANLVVIAATNRPDAIDEALRRPGRFDREIVIGVPDQRGRREILAIHTRGMPLEEAVDLSELARVTHGFVGADIAALAREAAIDAVRRIMPRLNLEERTIPQDVLEDLCVTRADFFSALKRIQPSAMREVMVQVPNVGWDNIGGVGDAIDKLKEGIELPLKNAEAFRRLGIRPAKGFLLYGPPGTGKTLLAKAVAKEAEANFISMKSSDLLSKWFGESEQQIAKLFARARAVAPCVVFIDEIDSLVPARGSGQSEPQVTGRVVNTILAEMDGLEELQSVIVIGATNRPALVDPALLRPGRFDELVYVGTPDKEGREHILGIHTKDMPLASNVDLAEIAEKTDRFTGADLEDVVRRAGLGALRRMGGDVKAVEMQDFEDALEDSRATVTPRMEAEYRRMRGELKKRAAEANPIGFFAPDSLAPARAKKHGSDEEA

SEQ ID NO: 14920 - protein, 605 aa, Yarrowia lipolytica CLIB122
MPWKTLLSLVYMSRACQVHGKQHVCTMTEEKTHSLSPNDSVSSGIGEIKTTSKWRNFVDSFKEADLHDVDTEGMTELEISQLKAANSPLQRSLKDRHVKMIAIGGSIGTGLFVGSGGALAQGGPAALLIAYTLVGSLLFCTINSLGELAVAFPVSGAFATFSSNFIDPAWGFAMGWNYTLNWFITFPLELVAASITVDLWREFNNSNISPAAWVAIFYVAIVSINFFGAKGYGEAEFIFSIIKVVAVVGFILFSLILVCGGVPGNGYIGGKHFHDPGAFANSFKGVAATFINAAFAFGGTELVGLAAAETENPRRAIPSATKQVFWRCFIFYFLSLLFIGLIVPYNSPELLAQGSVLGSASPFVIAIKNAGVKGLPSVMNVVIMVAVLSVGNSAIYGCSRTVAALAAQGMAPKIFGYIDRTGRPLVGIIACSIFGLLAFVCAAPKEVENEVFFWLLSVAGLSGTFTWGSVNLCHIRWRLAIKKQGRELKREVTFKSRVGIWGSIYSFVFCIVILAFQFWVALFPVGGADPTPRVFFQAYLCVPVILVFYFVYKIWKRTKIWKLADINLDVGRREFDYDALQRQLEAEKIEMATRPWYVRWGNYWC

SEQ ID NO: 14921 - protein, 1073 aa, Oryza sativa Japonica Group
MDGAKSGKQCHVCQICGDGVGTAADGELFTACDVCGFPVCRPCYEYERKDGSQACPQCKTKYKRHKGSPPILGDESDDVDADDASDVNYPTSGNQDHKHKIAERMLTWRMNSGRNDDIVHSKYDSGEIGHPKYDSGEIPRIYIPSLTHSQISGEIPGASPDHMMSPVGNIGRRGHPFPYVNHSPNPSREFSGSLGNVAWKERVDGWKMKDKGAIPMANGTSIAPSEGRGVGDIDASTDYNMEDALLNDETRQPLSRKVPISSSRINPYRMVIVLRLIVLCIFLHYRITNPVRNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALAETSEFARKWVPFCKKYSIEPRAPEWYFAQKIDYLKDKVQASFVKDRRAMKREYEEFKVRVNALVAKAQKVPEEGWIMQDGTPWPGNNTRDHPGMIQVFLGHSGGLDTEGNELPRLVYVSREKRPGFQHHKKAGAMNALVRVSAVLTNGQYLLNLDCDHYINNSKALREAMCFLMDPNLGRRVCYVQFPQRFDGIDRNDRYANRNTVFFDINLRGLDGLQGPVYVGTGCVFNRTALYGYEPPIKQKRPGYFSSLCGGRKKTKKSKEKSTEKKKSHKHVDSSVPVFNLEDIEEGIEGSGFDDEKSLLMSQMSLEKRFGQSSVFVASTLMEYGGVPQSATPESLLKEAIHVISCGYEDKSDWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLLYCILPAICLLTGKFIIPEISNFASIWFISLFLSIFATGILEMRWSGVGIDEWWRNEQFWVIGGISAHLFAVFQGLLKVLAGIDTSFTVTSKASDEEGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQKCGINC

SEQ ID NO: 14922 - protein, 200 aa, Synechococcus sp. WH 8102
MTETGCLRVGQQAPDFTATAVVDQEFKEISLSQYRGKYVVLFFYPLDFTFVCPTEITAFSDRYADFSSKNTEVLGVSVDSQFSHLAWIQTPRNQGGLGDINYPLVADLKKEIATAYNVLDDAEGVALRGLFIIDPDGVIMHSTINNLPVGRNVDETLRVLQAFQYVQSNPDEVCPANWTPGEKTMKPDPKGSKEYFSAIG

SEQ ID NO: 14923 - protein, 352 aa, Candidatus Kuenenia stuttgartiensis
MKAFAMLGIGSVGWIEKEKPVAGPYDAIVKPIAFAPCTSDIHTIEGAIGDRKNLVLGHESVGEVVEVGSEVKYIKPGDRVVVPAITPDWRSVELQDTGLGQHSGGMLAGWKFSNIKDGVFSEYFHVNDGDMNLAVLPDGITLEAAVMLTDMVTTGFHGVELANVEYGDTVVVLGIGPVGLMSVAGAQLMGAGRIVGVGSRPALIEAAKFYGATDIVNYRERSVVDRVLEMTNNRGADKVIVAGGNCDILIDAVKILKAGGAIGNINYFGGDEFIPIPREAWGVGMGHKAINGGLTPGGRVRMERLIELVKYSRLDPGKLVTHVFYGFDKIEEALQLMKEKPADLIKPVVLID

SEQ ID NO: 14924 - protein, 534 aa, Arabidopsis thaliana
MSSSDSSSAESRLATAKTVLTTAASVAATAMLARSLVQDYLPDEVHHYISYGFRSIFGYFSSQMTIIIEEFEGFAHNEVFEAAEAYLATKISPSNKRIKVSKHEKENNYNVTVERDEEVVDTYNGVKFQWILHCRHVESKHFHNPRDLNSTLRSEVRSFELNFHKKFKDVALESYLPFMVKRATLMKQEKKTLKIFTLSPENMYGNYSDAWTSVTLDHPSTFKTLAMDSDVKTSVMEDLDKFVKRRDFYKRVGKAWKRGYLLYGPPGTGKSSLIAAMANHLNFDIYDLELTAVNNNSELRRLLIATANRSILIVEDIDCSLELKDRTSDEPPRESDDIEDPRYKKVTLSGLLNFIDGLWSSCGDERIIIFTTNYKEKLDAALLRPGRMDMHIHMSYCTPSTFKALALNYLEIKEHRLFSKIEEGIEATEVTPAEVAEQLMRNDSVDKVLEGLIEFLKVKKIENEQDKAKTEKQELENKKKTKEGTDSVVKKEVDEQLVRNDRVDKVLEGLVELLKAKKIEDDQDKAKHEEVEQH

SEQ ID NO: 14925 - protein, 413 aa, Bradyrhizobium sp. BTAi1
MKSSDNLTTERPTFVTHLECAMEGDHYPADQVHNLSKAGKPLLVRYDLAGVKQALTKDALAQRPADMWRYRELLPVRKCQDIVSLGEVMTPLINLPKLSKKLGGGEIIVKDEGRLPTGSFKARGLVMAVSMGKALGITHMAMPTNGNAGAALAAYATSCGIKTTIFCPADTPEVNVSEIELQGATVYRVNGLIDDCGKIVGEGKAKVGWFDTSTLKEPYRIEGKKTMGLELAEQLGWDVPDVIFYPTGGGTGLIGMWKAFDELEKIGFIGSKRPRMVAVQASGCAPMVRAYEAGVEHATRWEDAHTIASGIRVPQAVGDFLILRAVRESKGFAIAVDDDKISSALSEVAREEGLLLCPEGAATYAAYKQSLADGRVTKNDRVMLFNCATGLKYPLPPVTRTLDRHQPIDFGQF

SEQ ID NO: 14926 - protein, 510 aa, Thermus thermophilus HB8
MDREALLERLKEPFDLLVLGGGATGAGVLWEATLRGLKAALVEAGDFASGTSSRSTKLLHGGVRYLELAFKRLDRRQLKLVVDALHERKVVMDLAPHLAKPLTLVTPLFRPLEIPYYTLGLKLYDLLAGKRRLAPSRYLPPEEVARLFPDLPKTLGGVAYQDGQFADFRLNLALVLSALERGAVALNHAEATALLLEGGRVRGAVVRDGLSGKEVEVRAKAVVNATGSLADRVRRLLDPHLPPLLTASSGVHLVLDYPLEAGLLVPKTRDGRVLFLLPYRGMALLGTTDLPAEPASCPLPREEEVAYLLEEIRPYLGDVSGRVRAVWSGLRPLVGKGETKLLVRDHYIEERRGLYTLVGGKWTTFRLMALDLVERLAKDLGLALPPSKSHATPLLGAGPRPPLPLPEEAARRLWETYGTLAPEVLALGDRPLLPGLPYLEGEVVWAVRRELARKPLDVLARRMGLAFLDQEKTREALPKVVELMAGLLGWDERERALRLKEAEEGLPGLC

SEQ ID NO: 14927 - protein, 315 aa, Klebsormidium flaccidum
EFGINGFGRIGRNFLRCWNGRENSPLEVVVINDTGGVKQASHLLKYDSILGTFDADVKVVGDDAISVDGKVIKVVSNRDPTKLPWGEMNIDLVIEGTGVFVDEAGAGKHLEAGAKKVLITAPGKGNIPTYVIGVNEEKYKHSEKIISNASCTTNCLAPFVKVLDQKFGVVKGCMTTTHSYTGDQRLLDASHRDLRRARAAALSIVPTSTGAAKAVALVLPQLKGKLNGIALRVPTPNVSVVDLVIQTEKKTFAEEVNNAFREAANNELKGILDVNDEPLVSIDFRCSDVSSTVDSSLTMVLGDDMVKVVAWYDNE

SEQ ID NO: 14928 - protein, 473 aa, Bradyrhizobium sp. BTAi1
MADTSFDVIIIGSGPGGYVTAIRAAQLGFKTAIIEKSYLGGICLNWGCIPTKALLRSAEIYHYMQHAKDYGLSAEKISYDPKAVVARSRGVSKRLNDGVGFLMKKNKVQVIWGKAAIDAPGKITVTKSDVESPKGALGEGTYQAKHIIVATGARPRVLPGLEPDKKLVWTYFEAMVPEKMPKSLLVVGSGAIGIEFASFFRTMGSEVTVVEVLPQILPVEDAEIAGIARKQLEKQGLKIMTGAKVTKLDKKTDSVVATIDDGKGKIEAVEFERVISAVGVVGNIENLGLEKLGVKTDRGCIVIDGYGKTNVPGIYAIGDVAGPPMLAHKAEHEGVVCIEAIKGLHPHAMDKNLIPGCTYCHPQIASVGLTEAKAKEQGRDIRVGRFPFVGNGKAIALGEDQGLVKVIFDKKTGQLIGAHMVGAEVTELIQGYVVAMNLETTEEELMHTVFPHPTLSEMMKEAVLDAYGRVLNM

SEQ ID NO: 14929 - protein, 1789 aa, Aspergillus nidulans FGSC A4
MAAPTPQLPTRFPCWCRAIYSWGGEAKSDLGFIEGDLIECLNAGDGQWWMGRLRRDRRMVGLFPSNFVQLLGEDFVPVTRATSPMLPAAASPITNPTSAPKKQKTVFRKPFQAHKEALAPSGSGGSPSSTSLVGSTIPQTPPRDGSLSRRTKTGRTPTRANRQQSSLSRPLSIARPPSRGVSPHPPPEPTPQQHDISSRSRSRPPSRAVSPRPQLPEVTHSSPLVSPAGPTYAQTSHYPSHASSSRPQLPDFGRHSPLVSPSFPMYSHVQDTHSWSRSASPRPQLPEITHHSPLSPSVPMHNHSQLSHQSSREISPLQLTEREDSPPPPPPPPHRVAVQRQPSPGPAVPRQLDMNDRYVVFTRTPSPAGHSDANGQTPSPLRDAMEDVMTSLEDMGMPRDSRSPSPQPEFDNPWSPAAFDSLRESRHPQRNNRPLTSLGFEGEKEFYHSDAVHRNSVYTHDPFIEGPPQINNYVQRMESRLRQMQEQGRRGSEDIQPPVENSEEDDDMPPPPPPRHGSYHGRHNSIPAHLPSLRSRRSGHDLRNDMLNRSFTKSSNTTNSSSGVHSNATNQTSSTDRTSQSLMSGPSAGGFSATSAGSYARRGIAAGERPSTAVDAVRSRGFSDLTRMPRPESPMSGISYHSSHNTSRQGASSAIPWSTSATTPEEPNSVFGGLATPKAKKQGFFKKILESAKTGAANARSSIAVGQSGGSFSPTKGRAISPIRSSHSHRDTAAREMGTGNNPMDWVQVRRDVNRASSPSRNERIERAERCQMMDHPVIYAVEELYETAEGEESIDGLPISEPTDFGNVNLTLVDKSARFVNSLPPMTNPLSLAQGYVCRPYKSDVQRLRAIFTWVSEKIAWDEPIEDADIDLKRVLQTKRGCAQEVAYLVREMCAAVGIHADAIEGFLKPPGEVFDLDSLSRPNHWWNAVLVDGDWRFMDCSLANPTNPIRNQFVTTNTTVAESWYFLARPLELCYTHVPLEPEGQHICPPISPDVLLALPTVCPTYFKMGLQFPDYDTSVFRIEGLEVLQVRILVPADVECAAEVEAPGFARDADGDFFESGEIVRKRALVQPDWVNGQKRITIKAVLPGDEGQGMVKVYAGRKGLMHSSRDIPHPLAFALPIIHTGENPPYEFVLRHPTPHAQRHDLYIIQPQCAKLAVNNTFVFAVRQHPSSPTPQTSSNENSFSGRISPSVFSRPASALSMVSSSAGGSTVSTVSNEFSASTSAISSTRSNSGREKPAKLAIQSPSGKILRLTRKADHMISSPKTSDSPSECTADGSVWETVIKIGEGASPLQQQAFEFTPLLIPRDDIWHLALPRLASFEWTCTYLIYIEASKREMSPRLNLPDPFATIPRVSLLYPFSSPIHPLQSLSGLASAPAPASASASASTTHSAPGSTRSQGARTEGIHVSLYAKREDHSSPLACAGNKYRKLEYIVPDILSSSPRYGAGIAADVPTPIHGKGKVTTLVTEGAIQSNHTVQVASVASRIGLESVVLLHKGTGGGLASAKDKAAFLRTGNVQIVKLLGAEVRMFEKPVAPKTQDDIVEEVLNNLRAEGKVPYWIPSGASLHPLGGLGYARCAFEIAAQEKDILGSPNDRGSGGYGIKQPRFDYIFVACGSGSTVGGLIAGFKLLEKMENSQPHEQTRGERKRRVIGILTSPTMRKRYHEERILRFARGAGKLIGLNPQTDITMDDVVLDDRFAGERYGVLDAKTNDMLSLMAEKEEVILDPVYTAKVARGMMHWVAEGEIEKDLLASPATYRGQDGEQVNVLFIHTGGQSALGAYAST

SEQ ID NO: 14930 - protein, 230 aa, Pneumocystis carinii
MAPSSLSFPSSHILMSGAMYPGSRDEKGMEHGVVSTSLNQTATNTFAGVSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDVKFPIRLEGLAYSHGTFSSYEPELFPGLIYRMVKPKIVLLIFVSGKIVLTGAKVREEIYQAFEAIYPVLSEFRKSS

SEQ ID NO: 14931 - protein, 372 aa, Mycobacterium avium 104
MPHQLRKRRPAVSAALPEFPWDTLAEAKALAGSHPDGIVDLSVGTPVDPVAPVIQQALAAAGSASGYPATAGTARLRDSAVAALARRFGVVGLTEASVLPVIGSKELIAWLPTLLGLGPADLIVVPELAYPTYDVGARLAGARVLRADSLTQVGPQSPALYYLNSPSNPTGRVLGVDHLRKVAAWARDRGCLVASDECYLGLGWDAQPLSILHPQVCDGDPTGLLAIHSLSKSSSLAGYRAGFVAGDAELIAELLAVRKHAGMMVPTPVQAAMVAALDDDAHERAQRQRYERRRAALLPALRSAGFAVDHSEAGLYLWVTRGEPCRDTITWLARRGILAAPGEFYGPRGAQHVRVALTADDERIAAAVRRLA

SEQ ID NO: 14932 - protein, 229 aa, Pneumocystis wakefieldiae
MAPSSLSFPSSHILMSGAMYPGSRDEKGLEHGVSTSLNQTATSAFAGVSGIVPSLQNIVATVNLDCRLDLKTIALQRRNAEYNPKRFAAVIMRIREPKTTALIFASGKMVVTGAKSEDDSKLASRKYARIIQKLGFNAKFTDFKIQNIVGSCDVKFPIRLEGLAYSHGTFSSYEPELFPGLIYRMVKPKIVLLIFVSGKIVLTGAKVREEIYQAFEAIYPVLNEFRKSS

SEQ ID NO: 14933 - protein, 411 aa, Dioscorea tenuipes
MYNGEKINCTENRSVLHIALRAARDKVIKSDGKNVVPDVWHALDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVTIDGVPLPFETGEIDFGESGTNGQHSFYQLIHQGRVIPCDFIGIMRSQQPIYLKGEVVSNHDELMSNFFAQPDALAYGKVAEQLLNEKVPDHLIPHKTFPGNRPSLESSITFIKCLQRWTVTSNI

SEQ ID NO: 14934 - protein, 641 aa, Mycobacterium avium 104
MLEQIRGPADLQHLSTHQLRELAAEIREFLIHKVAATGGHLGPNLGVVELTLALHRVFDSPHDPIIFDTGHQAYVHKMLTGRAHEFESLRKKGGLSGYPSRSESEHDWVESSHASAALSYADGLAKAFELSGHRNRHVVAVVGDGALTGGMCWEALNNIAASGRPVIIVVNDNGRSYAPTIGGVADHLATLRLQPAYEQALQRGRDALRALPLVGKFAYRVMHSVKAGIKDSLSPQLLFTDLGLKYVGPVDGHDERAVEAALRHARGFGRPVIVHVVTRKGMGYAPAEDDEADQMHSCGVIDPITGQATKVAGPGWTATFSDALIGYARKRRDIVAITAAMPGPTGLTPFGQQFPDRLFDVGIAEQHAMTSAAGLAMGGMHPVVAIYSTFLNRAFDQIMMDVALHRLPVTMVLDRAGITGSDGASHNGMWDLSILGVVPGMRVAAPRDAARLREELGEALDVDDGPTALRFPKGDVGEDIPAIERRGSGLSGVDVLALPASGCNHDVLLIGVGAFAPMALAVARRLADQGIGVTVVDPRWVLPVSDSILELAARHKLVVTCEDNGVNGGVGSAVSAALRRAELDVPCRDVGLPQRFYEHASRGELLADLALTDQDIARRITGWVAALGSGVAEAEIREHLD

SEQ ID NO: 14935 - protein, 341 aa, Shewanella sp. MR-7
MKALSKLKAEKGIWLVDAPKPEMGHNDLLIKIKKTAICGTDMHIYNWDEWSQKTIPVPMVVGHEYVGEVVDIGQEVRGFKIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFHAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 14936 - protein, 567 aa, Dioscorea tokoro
  misc_feature (238)..(238): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 14937 - protein, 161 aa, Triticum aestivum
SGAVTATAITEDILFPLAMSLRSVCLKDLYSALCFVPLVSSSPNLRSLKILRCSGAWDLPLEVIAARAPGLVEIHLEKLQVGDRGLTAVSACANLEVLFLVKTPECTDGGIISVAQNCHKLRKLHIDGWRTNRIGDCGLMAVARGCPDLQELVLIGVNPTV

SEQ ID NO: 14938 - protein, 330 aa, Vitis vinifera
MAPVIGVNGGAGGLILSFGEMLIDFVPTVSGVSLAEAPGFLKAPGGAPANVAIAVTRLGGRSAFVGKLGDDEFGHMLAGILKENGVRGDGITFDVGARTALAFVTLRADGEREFMFYRNPSADMLLKPEELNLELIRSAKVFHYGSISLIVEPCRSAHLRAMEVAKEAGALLSYDPNLRLPLWPSAEEAREQIMSIWEKAEVIKVSDVELEFLTGSDKVDDETALSLWHPGLKLFLVTLGEKGCRYYTKNFHGAVEGFHVKTVDTTGAGDSFVGALLCKIVDDQSVLEDEARLREVLKFANACGAITTTKKGAIPALPAEADVLSLLHGA

SEQ ID NO: 14939 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDDKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 14940 - protein, 820 aa, Ostreococcus tauri
  misc_feature (1)..(1): Xaa can be any naturally occurring amino acid
XVDLPGYGFANAPEALREKWAEFTREYLLKRETLITVMLLIDSTVKPQRLDLECLDWLGAAGIPVTIVFTKVDKRKKIAAGKRANPQETMEEFCREAMDNWDWDELPPMIYTSSETAEGKREVLNHIASLRQFFKKPLKEDFVKSIQGDAGASVADANTSTTTNPRTTGISDTVARPRVPNVSSRAPVSLRPARPHIGACTPTGSERDVTRVAASPSRAKDGDAAPEPEKPSTSSATDDVTTPIRAKVNSRKKPVKTEDERSVVAIEPEGWEKTLETIKRWRADGPPAAVDTMGCEKIADVEDDRVNVDGDRYRRYLTLTSAMLSSQTKDEINHAAMRRLRAHGCTPENILNTDEDALDAMINPVGFHRRKAQYLRATAKILLDEYDGDIPPSVETLCALPGVGPKMAYLVMNVGWGEPTGICVDVHVHRISERLGWVAKDVMGKNGSPRKKTPEDTRAALESWLPKHEWIEINPLLVGFGQLTCTPLRPKCHACPLAKDGSCPSAFKENPASRATTRDPIVSARIVYKSKHKPHRHRRRQRSRYLAPFAPGCGTYATRADVGAATRAVSTPTPPSPPAVDRVAPIAIAPIPPPSRRLPTPPPRSRPRPSASSSSTPPRPRSPSPSLARLSIVALCRWPHTPPPKSMARLFLDQEPLTQYKDRAFEGTIEAYLDALRASATLYVGNLSFYTSETQARALFARCGVVRRIVFGLDRERRTPCGFAFVEYETRAAAERCARYLNGTKLDDREIRVDFDWGYREGREFGRGKSGGQVRDEYRTYYDSGRGGYGKLLRDELEGMKARGEGGAEVAAGEKRARDA

SEQ ID NO: 14941 - protein, 358 aa, Arabidopsis thaliana
MSAFVGKYADELIKTAKYIATPGKGILAADESTGTIGKRFASINVENIESNRQALRELLFTSPGTFPCLSGVILFEETLYQKTTDGKPFVELLMENGVIPGIKVDKGVVDLAGTNGETTTQGLDSLGARCQEYYKAGARFAKWRAVLKIGATEPSELSIQENAKGLARYAIICQENGLVPIVEPEVLTDGSHDIKKCAAVTETVLAAVYKALNDHHVLLEGTLLKPNMVTPGSDSPKVAPEVIAEYTVTALRRTVPPAVPGIVFLSGGQSEEEATLNLNAMNKLDVLKPWTLTFSFGRALQQSTLKAWAGKTENVAKAQATFLTRCKGNSDATLGKYTGGASGDSAASESLYEEGYKY

SEQ ID NO: 14942 - protein, 493 aa, Cucumis melo
MGFHQTHETNQVLLSKIAISDGHGEDSPYFDGWKAYDNDPFHPENNPLGVIQMGLAENQLSPDLIVDWIRKHPKASIYTDEGLLNFKDIANFQDYHGLPEFRNAIASFMGKARGGRVKFDPSRIVMGGGATGASETVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLICDEIYSATVFKSPSFTSIAEIIEEMDHCKKELIHILSSLSKDMGLPGFRVGILYSYNDTVVSIARKMSSFGLVSSQTQHLLAAMLSDEEFVDNFLVENSKRLAKRHARFTEELEKMGITCLNSNAGLFVWMDLRKLLKDQSFESEMELWRVIINEVKLNVSPGSSFHVTEPGWFRVCFANMDDNTVGVALDRIHSFVGKIDKKENSTIPMPPKKKHRENKLRLSFSFSGRRYEEGNVLKSPHMMSPHSPLVRAKT

SEQ ID NO: 14943 - protein, 400 aa, Streptomyces coelicolor A3(2)
MALDVAAIRAHVPALKSGTARFDAPGGTQTPQPVIDAIAAALTAPLANRGRNTEGERNADRIVDEARSALADLLGTTPGTVVFGRSATQLAYDLSRTLAKGWGPGDEVVVTRLDHDSNIRPWVQAAEAAGADVRWADFDPATGELRPEHLAAVLGPRTRLVAVTAASNLIGTMPDLPALASLVHANGAHFHVDAVHYASHAVVDLAATGADTLVCSPYKFLGPHLGVLTGRAELLESLRPDKLLPSADTVPERFELGTLPYELLAGTSAAVDFLAGLEAEAEGSRRDRLVASFAALEAHEEALRERLERGLAELGGITVYSRAARRTPTLLFTVAGLRPADVYRQLAERAVDAPAGSFYAVEAARRLGLGDEGGVRVGLAPYSSAEDVDRLLTALGALER

SEQ ID NO: 14944 - protein, 391 aa, Shewanella oneidensis MR-1
MSSYDIAIIGGGISGVGIAQYAAAAGYSTLLIEKGEIGGQTSANSSKLIHGGLRYLESGQINLVRKSLLERRNLLDLAPSLVKPVAFYIPVYQDSRRNPLTIRAGLSLYALLSEFDPLGRFVSIPAVHWHRFKGLKLSGLKAVFQYWDAQTDDKLLTQAVARSAQALGAHIYAEAEFLQLNHLKEQIELSFRHRGEVQQIETKLVINAAGPWVNEVLAHVEPPLAGVEIDWVQGAHLLLDLPAPEGILYLESCFDKRVIFVMPWYGQMLIGTTETVLTSIDTPPQVTESETQYLLGIYCHYFPLSPSIEELKTKIVQTYCGVRVLPKQASSAFERPRDTLMQTSISHPRLLCLYGGKLTTFRSSSAEVLEWIEQKLGKRQPIADIDTLKLT

SEQ ID NO: 14945 - protein, 214 aa, Xylella fastidiosa 9a5c
MRILLARHGETLWNAEGRYQGQIDIPLSSVGEAQARALGERLRDVVIARAVASPLVRAQYTAQLALGESRAAQLLIEADLKEISHGDWEGLLDTEIHAMDPTRLHAWRKAPETVIMPNGESLHQVLERSWRGLTTAAVGLGIDDILLVVAHDAVNRVILCRVLGLPLAHLWRFHQAPTTLNLLEGKNIDQLQVVRLNDCSHHTPFFGEAKHRAL

SEQ ID NO: 14946 - protein, 345 aa, Glycine max
QGQVIVRFDDTNPAKESNEFVDNLIKDIDTLGIKYEQITYTSDYFPELMEMAEKLIREGKTYVDDTPREQMQKERMDGIESKCRNNIVEENLKLWKEMIAGTERGLQCCVRGKLDMQDPNKSLRDPVYYRCNPMPHHRIGSKYKVYPTYDFACPYVDAIEGITHALRSSEYHDRNAQYYRIQEDMGLRKVLIYEFSRLNMVYTLLSKRKLLWFVQNGKVDGWDDARFPTVQGIVRRGLKIEALIQFIVEQGASKNLNLMEWDKLWTINKKIIDPVCPRHTAVIADRRVLLTLTDGPEKPFVRIIPRHKKYEAAGDKVTTYTKRIWLDHADAVSLSAGEEVTLMDW

SEQ ID NO: 14947 - protein, 145 aa, Streptococcus pyogenes str. Manfredo
METSEELKQRIGDLSYEVTQHAATESPFTGEYDDFFEKGIYVDIVSGEVLFSSLDKFNSGCGWPAFSKPIENRMVTNYDDSSYGMRRVEVKSREAGSHLGHVFSDGPKEAGGLRYCINSAALKFIPYEQMEKEGYAQWLTLFDET

SEQ ID NO: 14948 - protein, 358 aa, Karenia brevis
LEMRDGDKGRLLGKGVLKAVNNVNEIIAPKLIGMDVKEQTKIDKVMVEELDGSKNEWGWSKEKLGANAILAVSMAVCRAGAAASEMPLYQYIAQLAGKPMDRFVMPVPSFNVINGGSHAGNRLACQEFMILPTGATSFKEAMCIGCEVYHTLKSVIKKKYGQDACNVGDEGGFAPSVQNNNEALDVLMDAIKKSGHEAKVKIGTDVAASEFYNAETKLYDLDFKNKDSPPEMKKTAAQLIDYYKSWLGKYPFVSIEDPFDQDDWDAYKMCMDAFGKDQQIVGDDLLVTNPNRIKKALEVGACNALLLKVNQIGSLTEAIEAAVMSMNSGWGVMVSHRSGETEDSFIADLVVGLRTGQI

SEQ ID NO: 14949 - protein, 158 aa, Triticum aestivum
  misc_feature (102)..(102): Xaa can be any naturally occurring amino acid
  misc_feature (106)..(106): Xaa can be any naturally occurring amino acid
  misc_feature (110)..(110): Xaa can be any naturally occurring amino acid
  misc_feature (137)..(137): Xaa can be any naturally occurring amino acid
  misc_feature (140)..(140): Xaa can be any naturally occurring amino acid
  misc_feature (152)..(152): Xaa can be any naturally occurring amino acid
KKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDXFDQXDDWXHYAKMTEEIGEQVQIVGDDLLVTNPLXLLXLSKENHQCLLLXGNQIGL

SEQ ID NO: 14950 - protein, 498 aa, Rhodococcus sp. RHA1
MPVTVLLDTGSVRGTLRTRHQFSNAGHIDTGVDMSVESLHTTADATIPHPRWRLPVVGDVFGISIRTPLQNSMEIGRKLGPIFERNVLGNRFVFASGADMVAELSDESRFAKHLAPGVASLREVGGDGLFTAYNHEPNWSKAHNLLAPAFTKSAMRSYHRTMLDVAGELTEHWDERVDGSPVDVSSDMTKLTLETIGRTGFSYSFDSFGRERPHPFVQAMVGALSHSQRTTFVKSSALGRLLMRRSDRRNIANLEHMAEVVDEVIRARRDSAEDGPEDLLELMLRAARENDPHRIDELNIRHQVVTFLVAGHETTSGALSFALYYLSRHPDVLAKAQAEVDAVWGDEEPAFEQIAKLRYVRRVLDESLRLWPTAPAYGREATVDTTLVGKYPMKVGDWVLVLIPALHRDPVWGDDPEAFDPDHFLPERIRSRPAHVYKPFGTGERACIGRQFALHESVLVLGTILRRYDIVGDPDYRLKVAERLTLMPEGFTLQLRRR

SEQ ID NO: 14951 - protein, 353 aa, Karenia mikimotoi
CELRDGDKSRYVGKGVLKAMANVNTELAKELKGFDVRDQRGLDDKMIAVDGTPNKENMGANAILGVSMAAAKAAADGKGIPLYKHIAELAGNAGPMVLPMPCFNVVDGGSHAGNKLAFQEYFIIPTGAESFSEAMRIGAECYHTLKGIIKKKFGGDATLIGDEGGFAPPCDARGGVELVWEAIQKAGYESKCKIGMDVAASEFKVDGQDCYDLGKWYPESEKGDPALKMTGEQFAQFYAGLCRDFPIVTIEDPFDQDDWAAWTGLTANIGVATQVVGDDLTVTNVTKVNKALETKACNALLLKVNQIGSLTEAIEAVKLCKTNGWGVMCSHRSGETEDTTIADISVGLCCGQI

SEQ ID NO: 14952 - protein, 491 aa, Pseudomonas mendocina
MDTTRPAYQNLELQPLAGQWRAGSSGRPLEVFDPYNDELLLRIALASREDLDAAYRKARDSQREWATTAPAERARVLLEAVKIFDERREEIIDWIIRESGSTRIKAQIEWGAARAITLESASLPNRVHGRIIASNISGKESRVYRAPLGVIGVISPWNFPLHLTARSLAPALALGNAVVVKPASDTPITGGLLLARIFEEAGLPAGVLSVVVGSGAEIGDAFVEHPVPALISFTGSTQVGRNIGRIASGGEHLKHVALELGGNSPFVVLADADVEQAVNAAVVGKFLHQGQICMAINRIIVEQPLLEDFTRRFVERVKALPYGDPSKPGTVVGPVINARQLAGLKEKIATAKAEGATLLLGGEPQGNVMPPHVFGNVTADMEIAREEIFGPLVGIQSARDAEHALELANSSEYGLSSAVFTASLERGVQFARRIHAGMTHVNDIPVNDEPNAPFGGEKNSGLGRFNGDWAIEEFTTDHWITLQHSPRPYPF

SEQ ID NO: 14953 - protein, 484 aa, Dichelobacter nodosus VCS1703A
MPFKRDLHRISHHTKIVATLGPASNSVEMLEQLIRVGLNVVRMNFSHGDRAFHAENARRVRLASENVGRQVAIIADLQGPKIRIGAIAGGKVSLIEGQTYILDAAYCGEGTAERVGLDYADLPKDVRIGDVLLLDDGLVTLTVSKIVGDEIHTVVGNSALLKSNKGINKQGGGLSAPALTDKDRQDLKTAVELGADYLAVSFVKSAADMELARQLVAQACPNTHHPALIAKIERAEAITHLEEIVMASDGIMVARGDLAVEVGNAAVPVLQKRMIKLARRHRRFVITATQMMESMITNPVPTRAEVSDVANAVIDGTDAVMLSAESAVGLYPFETVQTMALVCQAVENAQNPMENIDMDIPITDRIDHTIAAGAVFTAQKIGAKAIIALTNSGTTAFQLSRYGINIPIYALTSSLSVQRKMAMYRGVRPLMADISNDHQNAIAEAEAHLAWRGVVHSGDLYVITSGMKMGLTGSTNTLQICRAK

SEQ ID NO: 14954 - protein, 348 aa, Candida boidinii
MSIPTTQKAVIFYENGGPLEYKDIPVPTPKPNEILINIKYSGVCHTDLHAWKGDWPLATKLPLVGGHEGAGVVVAKGSNVTNFEIGDYAGIKKLNGSCMSCEYCQQGAEPNCPDADLSGYTHDGSFQQYATADAVQAAKIPKDCDLATIAPILCAGVTVYKALKTADLRPGQWVCISGAGGGLGSLAIQYATAMGLRVIAIDGGDEKATFCKSLGAETFVDFTKTKDMVKAIQEATNGGPHGVINVSVSDAAISQSVEYVRPLGKVVLVGLPAHSVVKSPVFEHVVKSIEIRGSYVGNRLDTAEAIDFFSRGLVKATIKIIGLSELPKVYELMEQGAIIGRYVVDTTK

SEQ ID NO: 14955 - protein, 514 aa, Yarrowia lipolytica CLIB122
MISALFILDPSFKPLLSRNYRGDVPLSCISDLPGLIQIAQQNGNVAPPVLEDRGIHYMWMESGSVIFVAVSPQVSCNSMETLVFLSQLATVLTSYFEQLHAESVQDNFVLIYELLDEMMDFGVPQITDAGILKEYITVDAHKSLLGAVGDLVNAAVGEEGAAGNSGDIDVATHTTSRISWRPTGLQYKKNELFLDVVESVNLLYANDKVVRHEIQGRINVTSYLSGMPELRLGLNEKAMLEHKLAATGATTHKKPRSKTVEMEDVRFHQCVELSKFNVDRQISFIPPDGKFELMSYRLNLANAEEDHAEEEEGQKVRNYAARNRPLILVTTDVEKKGNTRLLISVKLKSQFRKRSTANDVEVFVPVPPDATSPRFRATAGTVVYMPERNAIRWKIKQLQGGGKEFSMKAEISVSRTEEQGESLSELLHLNNTPQSQIPVQVTFEIPYYAMSGLQVRYLKVNEPTLKYRSLPWVRYITKNGDDYSYRLKKPREKESKKKDKTKAEPAAGDANTST

SEQ ID NO: 14956 - protein, 375 aa, Candida boidinii
MLSQTFLRRTPIIRKSPISLALRLQSTFQIPEKQMAVIFETNGGPLEYKEIPVPKPKPTEILINVKYSGVCHTDLHAWKGDWPLATKLPLVGGHEGAGVVVAKGESVTNFEIGDYAGIKWLNGSCMSCEYCEQGHESNCPDADLSGYTHDGSFQQYATADAIQAAKIPKEADLAEVAPILCAGVTVYKALKTANLQAGQWVAISGAGGGLGSLAVQYAKAMGYRVVGIDGGADKGELVKSLGGEVFIDFTKEKDLTKAIQDATNGGPHGVINVSVSEAAISQSCDYVRSTGKVVLVGLPAGAVCHSPVFQHVVKSIEIKGSYVGNRADTREAIDFFSRGLVRSPIKVVGLSELGDVYEKMEKGAILGRYVVDTSY

SEQ ID NO: 14957 - protein, 280 aa, Dichelobacter nodosus VCS1703A
MNLNNYRDRVEHALERALPHDESLLTKAMRYSTLNAGKRLRAALIYAVAEDFSLPLSLVDNAACALECIHAYSLIHDDLPAMDNDDLRRGKASCHKAFDEATAILAGDALNTLAFALLARDEKNGLAQIRCLSAAAGAMVCGQSLDMIYTGTAIDVQKLQIIHQKKTGALLTAALHLGALPSPDYAHYQTQLTAIGEHIGIAYQIIDDMLDATSDSQTLGKTAGKDAQQLKNTYMNFFSPANIQSLIAHHEQCTRQQLNALPNCGQQLSAVIDLIFHRQQ

SEQ ID NO: 14958 - protein, 291 aa, Haloarcula marismortui ATCC 43049
MDDGTGAKRTKATVLQRVSSVLNADAHDATALDGGEVGSVYRVSFHDRPDVAVKVDDSPLGIEAAMLQSLDRDTPLPVPEVLHVEPELLVLSFIRGDGRFDERAERDLARHVAALHDTSADVFGFPFDTLSGPFSQSNPWTDSWIDFFRAQRLLPFATAARNEGALPAGEFDRVQRLAETLDARLVEPATPSLLHGDIHPGNAVVADGTVRAVLDPAIYFGHAEVDLAYVDRLDSIGAAFYDEYRQHRDISAGYFEERRDVYVAFHALENVRFFGEDELPRLERALDRLGM

SEQ ID NO: 14959 - protein, 376 aa, Karenia mikimotoi
LTTKGGILARAAVPSGASTGIHEACELRDGDKIRYVGKGVLKAVAAVNEKLAKELVGMDVREQATLDKKMCEIDGTKNKSNLGANAILGVSMAAAKAAAAGKGVPLYRHIAELAGNDKEMTLPVPCFNVINGGSHAGNKLAFQEYFIIPVGAENFREAMRIGCECYHTLKGIIKKKFGGDATLIGDEGGFAPPCDERQGVELIKEAIDKAGYADKCAIGMDVAASEFKTEGKDEYDLGTFYSEAEKSESLKMTGAQLGEFYASLCKDYNIITIEDPFDQDDWDAWVGMTANLGVPTQIVGDDLTVTNVERVKTAIEKKACNALLLKVNQIGSITESIDAVKLCKQKGWGVMCSHRSGETEDTTIADIAVGLCTGQI

SEQ ID NO: 14960 - protein, 371 aa, Candida boidinii
MLSQVFRRSMINRSSLMTRFQSTFTIPEKQMGVIFETNGGPLEYKEIPVPKPKPTEILINVKYSGVCHTDLHAWKGDWPLPVKLPLVGGHEGAGVVVAKGESVTNFEIGDLAGIKWLNGSCMSCEFCEEGNESNCLDADLSGYTHDGSFQQYATADAIQAAKIPEGTDLAEVAPILCAGVTVYKALKTADLAAGQWVAISGAAGGLGSLAVQYAKAMGLRVLGIDGGAAKKELFHSMGGDVFIDFKEEKDIVKAIQDATNGGPHGVINVSVSEAAISQSCDYVRPTGKVVLVGLPAGAVCKSPVFQHVVKSLEIKGSYVGNRADTREALEFFSRGQVKSPIKIVGLSELPMVYGLMEKGAILGRYVVDTSY

SEQ ID NO: 14961 - protein, 432 aa, Candidatus Kuenenia stuttgartiensis
MKICCIGSGYVGLVAGTCLADMGNDVICVDSNKGKIDNLKKGIIPIYEPGLKDMLERNARVRRITFTTNIKDGIQKSDVIFIGVGTPSDLNNCADISAIISVAESIGKYMNGYKVIVNKSTAPVGTLEKIGKVVKSFQKKAIRFDLASNPEFMREGEAIKDFTNPDRIVIGVQGEKAKKIMESIYNGISRTDKPIMFTDIRSAELIKYASNAMLATRISFMNELAQLCEKVGGDIKEIAKGTGLDSRIGPRFLQAGIGYGGSCFPKDVNALIQIMNENGIDAKILTAVNEVNEQQKRSLFEKIQILVPKMKNKKIAIWGLAFKPKTDDMRDAPSITLIKQLQEAGAQINAFDPEAMDNAKTIFRGIKYYDDPYSAVKNCDALVIVTEWNEFRDLDLKKVKRLLKCPNIVDGRNIYEPKDMKELGFHYLCVGR

SEQ ID NO: 14962 - protein, 377 aa, Bacillus licheniformis ATCC 14580
MAVEVVMPKLGMSMKEGTVSVWNKKVGEAVEKGESIASINSEKIEMEIESPANGTVLDIQVSEGEGVPPGTVICRIGNENEQTQESQTKQPDPTKERIKISPAARKIAQSANIDIKTLKGTGPGGRITKADVLQALPGRPNKQAAKAEAEERPPASPMRKTIAARMTESLQNSAQLTITMKADITKLTVLQKQLNETAQSRYDTKLTITDFAARAAVFSLLDHPAMNSVYQDGRLATFEHVHLGVAAALDEGLAVPVIRHAERLPLIELAKKIKWYAKKAREGRLLHDEIEGSTFTITNLGAYGVEHFTPILNPPETGILGVGQMYSAPVYQDGELTKGAILPLSLTFDHRALDGAPAAAFLSDVKNYLEDPASILL

SEQ ID NO: 14963 - protein, 227 aa, Erythrobacter sp. NAP1
MFREWLWGYSCSWLPFVVSGAITTKGGLSQWLRNRYRRGHPIPLPIKNEKIMRIDNIPTGDNPPESLNVIIEVPTGGEPVKYEFDKASGALFVDRILHTPMRYPANYGFVPHTLSPDGDPLDALVIARSPFIPGCVVKARPIGVLNLEDEHGGDEKLVCVPVDTTFPYYSDVGETKDLPSIIMQQIEHFFTHYKDLEAEKWVRVGKWGDRAEARQIVIEAIERAKKS

SEQ ID NO: 14964 - protein, 343 aa, Oryza sativa Indica Group
MANPAAAAGPSGGARSFLQAVSTVTEEAPSPLRVVQMEGLAVLKIIKHCEEFAPALVTGQLLGLDVGSVLEVTNCFPFPMREDDEEADADGANYQLEMMRCLREVNVDNNTVGWYQSCLLGSFQTVELIETFMNYQENIRRCVCIVYDPSRSNQGVLALKALKLTDSFMDLYRNNGLTGEKLREKKLSWVDIFEEIPIKVSNSALVSAFMTELEPESPVSQCDFDRLKLSTAPFMERNLEFLIGCMDDLSSEQNKFQYYYRNVSRQQSQQQAWLQKRRQENMARKAAGEEPLPEEDPSNPIFKPIPEPSRLEGYLVTNQISSYCNHINGMDSLQVYAYSLGVP

SEQ ID NO: 14965 - protein, 458 aa, Bacillus licheniformis ATCC 14580
MTLAIIGGGPAGYVAAITAAKNSREVILIEDGSLGGTCLNEGCIPTKALLESADMFEKIKSAGAFGIGLSGESPTVQWEAVQSRKREIIQRLAGGIEYLMNKNKIKVLQGKASFLSEHDILVEKDGKQEVINAGHVIIAAGAAPAALPFASFDGSWIIHSGDAMSLPSIPETIFIIGGGIIGCEFASIYSRLGANVIIAEQAEQILPEEDPDIAAFLRTSLEESGVRVFTSVQVERLDPARQRVFLKNGDDSFNIQADRCLVAVGRKPRTDDLKLDHIGVQYDRKGIHVNQHMQTNIPHIYACGDITGGVQLAHAAFHEGTVAASHASGRDMKVNSDIIPRCIYTSPEIASVGLNEKKARERYRDVRIGEFPFSSNGKALILNETAGKVKIIIEPEYQEIVGVSIVGPGATELIGQAAVMLHAELTADAMEHFIAAHPTLSETIHEALLQAAGRAIHC

SEQ ID NO: 14966 - protein, 281 aa, Campylobacter upsaliensis RM3195
MQELVKLIQEAVIDISNALKFPDTSYSEEKNSSGDTQLKFDILSDEIITHHLSKSKALKALISEEKEEILKLNENAQFIVAYDPLDGSSLMDVNFAIGSIFAIYKEKVSPKNLKAALYSVYGARLELVCCEGKEVKLYRLNEGGKFDFVKELKMAEKGKINATGGTQKFWDNKHANFIKELFEEGYRLRYSGAMVSDIHQILLKGGGLFSYPATKDAPNGKLRAFFEIFPLAFIIEKAGGATTNGQNASLLELEFNQIHATSPCFFGSEYEINKLLKAYNG

SEQ ID NO: 14967 - protein, 427 aa, Bradyrhizobium sp. BTAi1
MTAIVDIIGREILDSRGNPTVEVDVVLEDGSVGRAAVPSGASTGAHEAVELRDGDKHRYLGKGVLKAVEAINDEIYEALSDMSVQDQVQIDQILIELDGTPNKSRIGANAILGVSLACAKAAAISYDMPLYRYVGGTSARTLPVPMMNIVNGGVHADNPIDFQEFMIMPVGAPSFAEALRCGSEIFHTLKGELKKAGHNTNVGDEGGFAPNLPSADAALDFVMSAIGKAGYNAGEDVMLALDCAATEFFRDGKYVYEGENKSRSRSEQARYLADLVARYPIVSIEDGMSEDDMDGWKELTDLIGSKCQLVGDDLFVTNVNRLADGIRNGRANSILIKVNQIGTLTETLAAVEMAYKAGYTAVMSHRSGETEDSTIADLAVATNCGQIKTGSLARADRTAKYNQLLRIEQELDAQARYAGRSALKALA

SEQ ID NO: 14968 - protein, 611 aa, Zea mays
MDMALASKASPPPWNATAAEQPIPKRDKAAANDSTYLNPQAHDSVLGINRAGDAKAKRQTGSSETPRAGRGTPLRSVSHCPPITPPALSRPLPRARFDPPPMATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 14969 - protein, 161 aa, Aspergillus nidulans FGSC A4
MPLLEPTKLTSHRSFIAIKPDGVQRGLVGPIISRFENRGFKLAAMKLTSPSRSLLEQHYSDLKEKPFFPGLVTYMLSGPIVAMVWEGKDVVKTGRTILGATNPLASAPGTIRGDFAIDVGRNVCHGSDSVESAKKEIGLWFTPEEIQNYKLNAFGWIYEKE

SEQ ID NO: 14970 - protein, 522 aa, Pyrococcus furiosus DSM 3638
MSMEEKVKDLYERKKKIMQMGGEEAIKKQHDKGKLTARERIELLLDPGSFVEIGMFVKHRATEFGMDKRELPADGVITGYGTIDGRLVFVYAQDFTVMGGSLGEMHAMKIKRIMELALEAGAPVIGLNDSGGARIQEGVDSLKGYGEIFKMNTILSGVVPQITAIMGPCAGGAVYSPAIGDFILMVDNPSTFMFITGPQVVKAVTGVEVSPVQLGGAMVHAQKSGQAHLIGKSDEEVIMLIKKLLSYLPSNNMEKPPKIKPKDEPFRRTPELYDIVPDDPNKGYDVRQVIYAIVDRDENGNPDFLELQPYFAPNAVIGFGRINGQPVGIVANNPIHLAGVLDIDSSDKIARFVRFCDAFNIPIVTLVDVPGYLPGVDQESRGIIRHGAKVLYAYAEATVPMVTVILRKAYGGAYLAMGSKHLGADFVFAWPTAEIAVMGPEGAANIIFRKEIAAAENPEEVRQQKIKEYREKFANPYVAAARGYIDDVIDPAETRAKIVMALEALENKRVKLPPKKHGNIPL

SEQ ID NO: 14971 - protein, 219 aa, Shewanella sp. MR-7
MTESHIDFRRAKFLISAPDIAHLDQYLPGDVGVEIAFAGRSNAGKSSALNALTEQKNLARTSKTPGRTQLINVFELDAQRRLVDLPGYGFAQVPLAMKLKWQQSLGEYLQKRACLSGVVVLMDIRHPLKDLDMQMIEWAVASEIPVLALLTKSDKLAQSAKMKTVNEVRKALVEFGDWVQVEPFSALKGTGKPKVLSILNEWCHPQWLADELENQEDAE

SEQ ID NO: 14972 - protein, 450 aa, Enterococcus faecalis V583
MSETQQTTLKKQLSSRHITMLALGGAIGAGLFKGSGEAIGIAGPSVLIAFLIGGAVLFIVMSGLGKLVLDGGDTHHGLSGLVRPFLGAHSADFIDWVYYSMWTINIIAEAVAAASFLQLWFPNIPAWFFVFILAILTTLINLYSVRLFAETEYWLAFAKISVIILLIIFGVYLVGQQMLGSGVFPTLQSITDHGGFAPHGMKGIVNSLLVVIYSYGGSELIAITVSEADDPKKAIPKAIRGVMGRIISFYIIPLFLLLIIFPWNTLAGTTVSPFVMVFEKMNIPFAADIVNFVIILALFSSINSGVYASSRLLYFRLKDKKGPMSKLGVLNKHQVPQRSVFFCASVLYLGVILSYFVGDELFGYLAGSLSYTVLLIWILISAAAFVLSLKRGSLFEKSINLLALIILGLIFIGILFTNSLGVTLLTGLLYFVIFFSYRKKNDSFLLSDES

SEQ ID NO: 14973 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPRAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 14974 - protein, 98 aa, Solanum lycopersicum var. cerasiforme
GNVYKVKLVCPDGTEHEFEAPSDTYILDAAENAGVDLPYSCRAGACSTCAGKIESGTVDQSDGSFLDDNQIKEGYLLTCVSYPNSDCVIHTHKEGDLY

SEQ ID NO: 14975 - protein, 567 aa, Dioscorea tokoro
  misc_feature (112)..(112): Xaa can be any naturally occurring amino acid
  misc_feature (129)..(129): Xaa can be any naturally occurring amino acid
  misc_feature (238)..(238): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDXKNVVPDVWHVLDKIKEXSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 14976 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 14977 - protein, 567 aa, Dioscorea tokoro
  misc_feature (503)..(503): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWXINSFDQWGVELGKSLASQVRKQLHLSRTKAEPVEGFNFSTTTLLTRYLEAETGVPSDQSQLPKL

SEQ ID NO: 14978 - protein, 249 aa, Xylella fastidiosa 9a5c
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRASEMVANQGKAK

SEQ ID NO: 14979 - protein, 1428 aa, Shewanella oneidensis MR-1
MIELRIDNKIVSAEPSDNLLHAARKAGIAIPSLCDPTDASRQLDTQAHAEKQDCNLCLVQIENSDASLRCVKACETPAQTGMKVITQSAFLTKQRQAALNAILSDHFADCEAPCQQACPAGVDVQRYLYHIAQGDHTQAVKVIKETLPLPLSIGRVCPAFCETECRRGLIDDPIAIRQLKRHAADLDLADDEHGNSYQPPRLADTGKKIAIIGSGPAGLSAGYYLSNQGHNIEIFEAMPKAGGWLRYGIPEYRLPKAILDKEIELLCRNGLTIHTQMRLGHEIHLNQLITDFDAVCLAIGAQKAVPMHYKGSELAGCYLGVDFLKDHCLDKQLKLGKKVAVIGGGNTAIDCARTAVREGCDVTLIYRRTRAEMPAEAYEVHEAEVEGVKFHFLTNPLENHSDADGRVQSVTFSKMTLGEADASGRRAPVDTGETFTEAFDTVIAAVSQAPDLSFMQDPKGQLSHGELALSRWNTLMGCEQTMSSGVEKLFVMGDARRGPATAVAAIGDGRKAAKAIDKMLQIGLSCDLHAHEFNSVKTIPGSLKQAEVKSAEASSPLYPHTKRQPRLKMPELTALQRLLNYSEVELGFPADAAMQEAARCLECACQANTDCKLRDYATDYGVESKSLATENARYFSVDKSSPFIQFDANRCISCGKCVDVCQQQSGHCAIQFAKDSYQVLPQSISPADERRAPRVGFSASMADSHCVQCGNCVQVCPTGALVDARDKRQGDCTELTTASTICTYCGVGCRLDLKIDPSTNRIRHIEGNKDSVVNQGMLCVKGRFGFDFIHSDKRLTTPLIRKNGKLQPCSWPEAIDYVAKRLTEIKQKDGSNAFASLASAKATNEDNFVLQKFVRSVLGTNNIDHCARLCHSSTVTGLQQSIGSGAMTNDILSIKDSDVIFILGSDTTCAHPIIASKIQQAVNLYGARLIVADPKRVGIAEKAELYVAHRPGTDVMLLNAIMAEIIRNNWQDKDYIAKRTEGIEALYAELAKEDYSLEKAALITGVKAENIARIARTIGTAQKTAVYYAMGITQHTTGHDNVTAISNLQLLCGNIGVSGAGINPLRGQSNVQGACDMGALPNYFTGYQKVTDIHARMRFESHWQTPLSGEIGVTATHMMHDIAKGKINALYVMGENPVLSDPDQAHVLNALSQIEFLVVQDIFLTETAELAHVVLPAAAFVEKRGHFTNTERRVQRLEQALASPGEALPDWQIVQAIANAMGANWDYKDEAAIWAEINALTPQYRGILWERLTAGEDGQIPQGIQWPCPDEKHPGTPIMHQGQFTRGLGLFTPVSYRLPAEMPCNEYPLTLSTGRLLEQFHTGTLTRKTPGLDLLGAPKVMISVYDAEQLGINNGDKIRLTTRRGEIEIDAFVTKRAQAGVLFLPFHFVEAAANKLTINALDPVAYIPEYKVCAVRVEKVTKQMCEPT

SEQ ID NO: 14980 - protein, 168 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVIKEVEEVKKEYPDAYVRIIGFDNMRQVHCVRFIAFKPPC

SEQ ID NO: 14981 - protein, 438 aa, Karenia mikimotoi
TFVKLVSWYDNEWGYSNRLVDLACHMACVDGIVPPAAKVVSIKAREIFDSRGNPTVEVDLLTDMHLFRAAVPSGASTGVYEALELRDGDKKRLLGKGVLKAVENVNNLIGPKLVGMDVTKQSEIDKFMVETLDGTQNDWGWSKSTLGANAILAVSMAICRAGAASMQIPLYEYIAYLSGRSTDKFVMPVPCFNVINGGSHAGNRLACQEFMILPVGATSFKDALITGAEVYHTLKSVIKKKYGQDACNVGDEGGFAPSVQDNNEALDVLMDAIKQSGHEAKIKIATDVAASEFWINGKYDLDFKNKDSPPEMKKTGDELADYYMKWFDRYPFVSIEDPFDQDDWGAYSKFMERVGDKMQIVGDDLLVTNPKRVAKALDCCACNALLLKVNQIGSITESIEAANMSMRAGWGVMVSHRSGETEDSFIADLVVGLRTGQI

SEQ ID NO: 14982 - protein, 205 aa, Bacteroides thetaiotaomicron VPI-5482
MLIIGIAGGTGSGKTTVVRKMIESLPVGEVVLLPQDSYYKDSSHVPVEERQNINFDHPDAFEWSLLSKHVMMLKEGKSIEQPTYSYLTCTRQPETIHIEPREVVIIEGILALCDKKLRNMMDLKIFVDADPDERLIRVIQRDVIERGRTAEAVMERYTRVLKPMHLQFIEPCKRYADLIVPEGGSNAVAIDILTMYIKKHLKNEE

SEQ ID NO: 14983 - protein, 356 aa, Karenia mikimotoi
LELRDGDKKRLLGKGVLKAVDNVNNIIGSKLVGMDVTKQSEIDKLMVETLDGTQNDWGWSKSTLGANAILAVSMAICRAGAASMQIPLYEYIAYLSGRPTDKFVMPVPCFNVINGGSHAGNRLACQEFMILPVGASSFRDALNTGAEVYHTLKSVIKKKYGQDACNVGDEGGFAPSVQDNNEALDVLMDAIKQSGHESKIKIATDVAASEFWIDGKYDLDFKNPNSPPEMKLTGDQLTEYYKKWFDKYPFVSIEDPFDQDDWLTYSKFHEAIGDKMQIVGDDLLVTNPKRVAKALDCNACNALLLKVNQIGSVTESIEAANMSMRAGWGVMVSHRSGETEDSFIADLVVGLRTGQI

SEQ ID NO: 14984 - protein, 381 aa, Karenia mikimotoi
LCTQMALFRAAVPSGASTGVYEALELRDGDKSRLLGKGVLKAVENINKIIAPKLIGMDVTKQKEIDELMVQTLDGTTNEWGWCKSKLGANAILAISMAVCRAGAAASEMPLYQYLAQLGGKPTDKFVMPVPCLNVINGGSHAGNRLACQEFMIVPTGAKNFKDAMIVGAEVYHTLKNVIKKKYGQDACNVGDEGGFAPSVQDNDEALDILMEAIEQAGHKDKIKIATDVAASEFYNEKTKKYDLDFKNPASPDSMKKTADELIEYYKVWLKKYPLVSIEDPFDQDDWDAYKKFMDAVGADVQVVGDDLLVTNPKRIKKGMEVGACNALLCKVNQIGSITESIEAVTMCQNAGWGVMVSHRSGETEDTFIADLVVGLRAGEI

SEQ ID NO: 14985 - protein, 426 aa, Oryza sativa Indica Group
MADGASANPGDPPSPASARSGQRKHVPDWLNSPIWHYRGVLHELLMVLISDRVFSLVLGFGGAQLQLGRKVVDLAELRRLACQGVPDAAGVRPVVWKQLLLGYLPTDHALWAYELEKKRSQYSAFKDELLVNPSEVTRRMEEMTISKGNRHNSEGTGVLPRAEIVHDEHPLSLGKTSVWNQFFQESETIEQIDRDVKRTHPEMQFFNGDSSDALSNQESLKRILTIFAKLNPGIRYVQGMNEVLAPLYYVFKNDPEENNAESAEPDAFFCFVELLSGFRDNFCKQLDNSVVGIRSTISKLSQLLKRHDEELWRHLEVVTKCISAPTLTLCIFQVNPQFYAFRWITLLLTQEFKFRDCIHIWDALLGDPEGPQATLLRICCAMLFLVRRRLLAGDFTANLKLLQSYPPTNIDHLLHIANKLRGPIPY

SEQ ID NO: 14986 - protein, 217 aa, Zea mays
MTFAYDTDVVMDDGTIIKTTVTNSGDATKLFLREVRQTRKPLIVGLDTEWRVIRRQGRRPRNRMAVLQLCVGHRCLVFQIVAADYVPAALKAFLASPQHRFVGVVVDVDVERLRCDCNIVVNNTVDLRYAAADVLGRPHLRTAGLKILAREVMGVEIEKPKHLTCSEWDRPLSQAQVRYAAIDAFVSYEVGRLVLTREHAQDAAFTGAMTILPSQLP

SEQ ID NO: 14987 - protein, 792 aa, Heterocapsa triquetra
MAVKMGINGFGRIGRLVFRAGMENQSVTVAAVNDPFMDLEYMKYLLKYDSVHKQFVGNVETKKEGDAEYLVVDGLPIRVFHEKDPGAIGWGAVGAAYVCESTGVFTTQEKAALHLKGGCKKVIISAPPKDDVKMFVMGVNHLDYSKDLTVVSNASCTTNCLAPLAKVINDKFGIVEGLMTTVHAMTATQLTVDGPSRGGKDWRGGRCASQNIIPSSTGAAKAVAKVVPALNGKLTGMAFRVPTPDVSVVDLTCRLEKGATMDEICTAIKDAAALDKAKGGMKDVLGFVDEEVVSTDFATCPLSSIFDKCAGIALTEKFVKLVSWYDNEWGYSNRLVDLACHMAVVDGVVPPPAKIVSIKAREIFDSRGNPTVEVDLVTDAHLFRAAVPSGASTGIYEALELRDGDKTRLLGKGVLKAVSNVNELIAPKLIGMDVTKQKEIDKLMVETLDGAQNDWGWSKANLGANAILAVSMAVCRAGAASMQMPLYEYIANLAGKPTDKYVLPVPSFNVINGGSHAGNRLACQEFMILPVGATSFKEALIMGCEVYHTLKDVIKKKYGQDACNVGDEGGFAPSVQDNNEALDVLMTALEKSGHAGKVKIGTDVAASFYKEGKYDLDFKNPDSDKSAWKTGAEMAKYYMEWFDKYPFVSIEDPFDQDDWEAYSGFQAMVGDKMQIVGDDLLVTNSKRINKALDVKACNALLLKVNQIGSITEAIDAACLSMRNGWGVMVSHRSGETEDSFIADLVVGLRTGEIKTGAPCRSERLSKYNQLLRIEEELGAKAVYAGENFRCPK

SEQ ID NO: 14988 - protein, 546 aa, Glycine max
MGFEISTVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFLSNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSLKSVTIPLLGSAQESEVDIDGHDIHRPSSIRALLTTPTHTVHRLWRKFDDAFMRPVFGGRGFVPVEPGSPTERNGHQWR

SEQ ID NO: 14989 - protein, 588 aa, Marinobacter sp. ELB17
MDPMLTLVGALMLVISIVLSPLSSRVGMPVLLIFLVVGMMMGEDGPGGIRFDDYQLAFLIANLALGVILLDGGMRTRAETFRVGLRPALVLATLGVFLTAAGAAVVAWWVFDLHWMLALLIGAIISSTDAAVVFSMLQGSGIHLNERVSATLEIESGSNDPMAIFLTLLMVTLIGNAGENNVGPALRLLVEQFGIGSIAGLIGGVAVVALANRMRLAPPLYPLLVAAGGIAVFSATNALGGSGFLAIYLTGVVIGNRPVRMMPMILQVHDGLAWLAQLCLFLMLGLLVAPSELLPLAGGGLILALALIFVIRPLTVMATLWPFGFNRRELGFISWVGLRGAVPIVLALFPIIAGLPDAQLVFHAAFFIVLVSLLVQGTTMAPLARWLKLEVPADNAPFRRFPLDAPAAGDHELMLFPLRGKNWELPRRLDQLKLPDNTAVAGVFRNQLCLQSQADLEVIQGDVIAVFSTPGVLPELNKSLSGAYTSSHLAERAFFGDFVLNGDALLGDVEQVYGIEFDELPPDLSLAECFAQRTKGRPVIGDLVALGPVTLVVRSMNGDTVAKVGLKMDAQQNAAEAKHNNTKDDKTH

SEQ ID NO: 14990 - protein, 329 aa, Arabidopsis thaliana
MTSSNGDNKGLVVSFGEMLIDFVPTESGVSLSESSGFLKAPGGAPANVAIAVSRLGGRAAFVGKLGDDEFGHMLAGILRKNDVDDQGINFDKGARTALAFVTLRSDGEREFMFYRNPSADMLLRPDELNLELIRSAKVFHYGSISLITEPCRSAHMKAMEVAKEAGALLSYDPNLREPLWPSPEEARKQIMSIWDKADIIKVSDVELEFLTGNKTIDDETAMSLWHPNLKLLLVTLGENGCRYYTKDFHGSVETFHVDAVDTTGAGDSFVGALLNQIVDDQSVLEEEERLRKVLRFANACGAITTTKKGAIPALPTDCEALSFLKIQVE

SEQ ID NO: 14991 - protein, 270 aa, Glycine max
MGTLGRVFYAVGFWIRETGQAIDRLGSRLQGNYLFQEQLSRHRPLMNLFDKAPSVHRDAFVAPSASLLGDVHVGPASSIWYGCVLRGDVNSITIGSGTNIQDNSLVHVAKSNLSGKVLPTIIGDNVTVGHSAVLQGCTVEDEAFIGMGATLLDGVYVEKHAMVAAGALVRQNTRIPYGEVWGGNPARFLRKLTEDEMTFFSQSALNYSNLAQAHAAENAKGLDETEFVKVLYKKFARRGEEYHSVLGGVQETPAELNVPDNVLLDKVPKA

SEQ ID NO: 14992 - protein, 251 aa, Bradyrhizobium sp. BTAi1
MTDHIRPLIAGNWKMNGLKASTAEFEAMLAGAAEVTGKADLLVCPPATLLAGFADKARGTRAVAVGAQDCHAKASGAHTGDLSAEMLADAGASAIIVGHSERRADHGESDVVVHQKTEAVWRAGLVAIVCVGETQQQRDAGQTLDILRGQLNLSLPQGSTAANLTVAYEPVWAIGTGLTPTAKDVEQIHAFIRTLLIERFNGEGARMRILYGGSVKPSNAAELMAVANVNGALVGGASLKAADFLAIAKGC

SEQ ID NO: 14993 - protein, 2218 aa, Stigmatella aurantiaca
MSSFLERVAELSPEKRAALAELLRLAPEPIAIVGMACRYPGGVKDSDSYWDLLKRGGDAVTEIPAARWDINAFYDPNQDSPGKTTTRWGGFLDDVEGFDPHLFGISPREAASMDPHQRLFLEVAWEALENAGQQTDRLAGSKTGVFVGLYTSDYSPVVLSDLNAINVYTGTGTANNVAAGRLSYLLDLQGPSFVVDTACSSSLVAVHLACQSLLNRECRMAVVGGVTLLLTPLTLVMASKMQLMAADGRCKTFDSRADGIAMGEGCGVVILKRLSDAQADGDRILAVIKASAINQDGRTNGLTAPSGASQQVLLRQALTRAGISPSQVTYVEAHGTGTPLGDPIEVEALAEVIGQPRPSGPPCVLGSVKANLGHTGAAAGVAGLIKVVLSMQNEAIPPQLHYRELNSNISLENTSLVIPKELHPWPAGKGPRIAGISAFGWSGTNAHVLVEEAPAAPKARAAVERPVHLLTLSARTEAALREFAERVKTYVSAHADLPIADLCYSANTGWSKFEHHLAVPAGTTAQLSERLSAFLEGQPQAGTSYGQVTGRRGPGVAFLFTGQGSQYAGMGRQLYQTQPTFRRALDRCDELLRPLLGRSILSVIYPEAGQASPIDETAFTQPALFAFEWALAELWRSWGVVPTVVMGHSVGEYVAACVAGVFTLEEGLALIVERARLMQSLPPGGEMAAVFTDGARTAQAIAPYASQVSIAAFNGPSETVISGDGKAVEAILGALSAEGVKVRRLGVSHAFHSPLMDPMLDAFERAAAKTRFMPPKITLISNLTGGPSEEFSARALRRHAREPVRFSDGMAALKARGVSVAVEIGPNATLLGIGSRCLPEGSVAWLPSLRKDKDEWEVLLATLGALSVRGVPVNWAGFDSDYPRRRVSLPNYPFQHERFALKQMDGRGVAPSGQVVGHPLLGSRLRVATVDGTLFESKFRADEPSFFSEHRVYGMSTVPATAYLEGALAAAEEIFGAGEHALESVDIQEALVLSDAPRTVQYLIGSREEGGTARFQVFSLASSGSGSEGVWTTHSSGQIRIASGAEPLSGTPLTPEQALEAIRTRCPRGLEPRAFYDWLEGQGLEYGPRFRGVQQVWRGDGEALGLVELPESAVDEAKAFKVHPGLMDACVQLFGVIEYREGAQDDTEVYLPVSIDRYRLKGRLGSKVWSHARIRPSEGTARETLKADIRLYDEAGRIVAEVEGMCIKRAPREMLARFGQAQFSNWLHEVEWKEEVRSAAAGAARPGSCRWVVFADRSGVAEALIDRLTARGEPVVRVLADDHYSREGDLVRLHPEQPEHVRSLMESAASSGGAVTRYLYLWGLDSSGPVSRGEASRVDTRAIGSNPLLHLVQELAGQQGSHQLFLVTRGAQATTREHAPIDAFQASLWGFARTIAFEHPELRPVRIDLEPSRKGGSPRETEILLGEVTRSDAASAEDAIAFRGSLRLVSRLMRQAKRASSNRKLRIPPAPAFRLEISQRGTLEDLTVRPVERRPPGPGEVEIRVRATGLNFRDVLNALGMYPGDPGLLGGECAGVISAIGPGVEGFKVGDPVVAVISLGSFATYCTVLADFVAHKPAALSFAQAAAIPIAFLTAQYGLQQLGRMAAGSRVLIHAAAGGVGMAAVQLAKRAGAEVFATASSGKWDVLEAMGVEHRMNSRTLDFADEVMARTEGQGIDIVLNSLADDFIPKSLSVLRSGGRFLEIGKRGVWTSAQVAERYPGVSYAIYDLGEVGTKDPSIIRSMFRALMAEFEQGTLVPPPLRVFALQDAVEAFRHMALAKHVGKVVITVNDGAPESAETTARAGAAVPIRGDSTYLITGGLSGLGLKTAQWMARRGARHLVLVARSEPGPEALGVIGELELSEVQVVVARGDVSRIDEVRGILDRVRDSLPPLRGIVHSAGVLDDGVLRQQTAGRFDRVLAPKAGGAWNLHLLTRDLPLDFFVLYSSIASMFGSASQGNYAAANAFLDALAHHRRALGLAGLSINWGAWSEAGMAARLSQRDMNRLSGQGIGTIAPDQGTQVLEMLLGQDAAQVGVLPIDWGTFFQRNPASKTSPFFSSLEGGTSVKKAAPTQVPSDILPRLREAAVGRREQLLSAHIREQAIKVLGLNPSHPLNPLQPLNEIGLDSLTAVELKNALGRTLGSSLHATLLFDYPTIDALTRYLAKEVMGWSAPALAPEAAEGAEDAEKARRVAEIQQLSDDEVAASINEELAALRQES

SEQ ID NO: 14994 - protein, 489 aa, Helianthus annuus
MALAPPTTTTSLSNPLLSSKPSLSSPFVNLPTVSRRSPTKFTVRNSVSVAQSPSVSAAKSSTVKSVKARQIIDSRGNPTVEVDLVTDGLYRSAVPSGASTGIYEALELRDGDKSVYGGKGVLNAVKNINEVLGPKLIGVDVRNQAEFDGIMLEIDGTPNKSKLGANAILGVSLSACRAGAGAKSIPLYKHIQEISGTKELVMPVPAFNVINGGSHAGNNLAMQEFMILPVGATSFAEALRMGSEVYHTLKGIIKAKYGQDACNVGDEGGFAPNVQDNREGLVLLIDAIEKAGYTGKIKIGMDVAASEFLTKDGKYDLNFKKQPNDGAHVLSAPSLGDLYREFVRDFPIVSIEDPFDQDDWTSWTSLQSSVDIQLVGDDLLVTNPKRIAEGIQKKACNALLLKVNQIGTVTESIQAALDSKAAGWGVMVSHRSGETEDNFIADLSVGLASGQIKTGAPCRSERLAKYNQLLRIEEELGNVRYAGEAFRSP

SEQ ID NO: 14995 - protein, 346 aa, Rosa odorata
QKWSNGEHSNELLHAQAHIWNHIFSFINSVSLKSAIQLGIPDIINKHGYPMTLFELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKSGKVIIIDMMMENQKGDEESIETQLFFDMLMMALVTGKERNEKEWAKLFTDAGFSDYKITPIL

SEQ ID NO: 14996 - protein, 715 aa, Mycobacterium avium 104
MAENTIKWDKDADGIVTLTLDDPTGSANVMNEHYKESMHNAVERLVAEKDSITGVVITSAKKTFFAGGDLKSMINLGPENAGEAFDTVEAVKRDLRALETLGKPVVAAINGAALGGGLEIALACHHRIAADVKGLVVGLPEVTLGLLPGGGGVTRTVRMFGIQNAFMNILSQGTRFKPDKAKEIGLVDELVGSVEELVPAAKAWIKANPDAHEQPWDKKGYKMPGGTPSSPALAGILPSFPALLKKQLKGAPMPAPRAILDAAVEGAQVDFDTASRIESRYFTQLVTGQVAKNMIQAFFFDLQHINGGGSRPEGIEPVKINKIGVLGAGMMGAGIAYVSAKAGFDVVLKDVSLEAAQKGKGYSEKLEAKALQRGKTTEEKSKSLLDRITPTADAADFKGVDFVIEAVFENQELKHKVFQEIEDIVEPNALLGSNTSTLPITGLATGVKRQEDFIGIHFFSPVDKMPLVEIIKGEKTSDEALARVFDYTLAIGKTPIVVNDSRGFFTSRVIGTFVNEALAMLGEGVAPASIEHAGSQAGYPSPPLQLSDELNLELMHKIAVATRKGIEDAGGTYEPHPAEAVVEKMIEIGRPSRLKGAGFYEYVDGKRTRLWPGLQETFNSGSTSIPLQDMIDRMLFAEALETQKCLDEGVLTSTADANIGSIMGIGFPPYTGGSAQFIVGYSGAGGTGKEAFVARAKELAARYGDRFLPPASLTS

SEQ ID NO: 14997 - protein, 346 aa, Rosa odorata
QKWSHGEHSNELLHAQAHIWNHIFSFINSMSLKSAIQLGIPDIINKYGYPMTLSELTSALPIHPTKSHSVYRLMRILVHSSFFAKKKLSKTDEEGYTLTDASQLLLKDHPLSLTPYLTAMLDPVLTNPWNYLSTWFQNDDPTPFDTAHGMTFWDYGNYQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSGYKITPIL

SEQ ID NO: 14998 - protein, 587 aa, Streptococcus pyogenes str. Manfredo
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGRNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 14999 - protein, 84 aa, Dioscorea tokoro
INCTENRSVLHIALRAARDKAIKSDGKNVVPDVWHVLDKIKEFSERIRSGSWVGATGKALTDVVAVGIGGSFLGPLFVHTALQT

SEQ ID NO: 15000 - protein, 635 aa, Streptococcus pyogenes str. Manfredo
MIILQGNKLERSFSGDVLFQNISLQVDERDRIALVGPNGAGKSTLLKLLVGEETPTSGEVNTKKDLTLSYLAQNSRFESDQTIYEEMLKVFEALRQDEKRLRQMEMDMATVSGQDLTRLMTDYDLLTEHFRQQGGFTYESDIKAILNGFKFDESMWQMTIAELSGGQNTRLALAKMLLEKPELLVLDEPTNHLDIETIAWLENYLANYQGALIIVSHDRYFLDKVATVTLDLTPHGLDRYVGNYSRFMTLKAEKLVAEEKQFDKQQKEIAKLEDFVQKNIVRASTTKRAQARRKQLEKIERLDKPTSARKSAHMTFQADKPSGNVVLTVEKAAIGYNQHVLSEPINLDVHKLDAIAIVGPNGIGKSTLIKSVIGQIPFIKGEVKYGANVEIGYYDQTQSHLTSSNTVLEELWQDFSTTPEVDIRNRLGAFLFSGDDVKKSVAMLSGGEKARLLLAKLSMENNNFLVLDEPTNHLDIDSKEVLENALIDFDGTLLFVSHDRYFINRLATKVLEITENGSTLYLGDYDYYLEKKAELEELARLAAGETVEETKEASATDYQLQKANQKERRRLTRRYEEIEARLETIEERIGAIQEDMHVSNDTAQLIAWQKEWDQLDQEQETLMEEWETIAEQIET

SEQ ID NO: 15001 - protein, 426 aa, Coprinopsis cinerea okayama7#130
MAPIPVIIDTDPGVDDIIAILLALASPELEIIAFLVSYGNTDRDSSVLNIFKAYQAVARHLEAYPNDASRFPNYNPAKPPLLLCAAARPLEGELHSAQYFHGRDGLAGISERHPDLNVDDVESFNGQHKCVQLEEMTPDNFPAIVSDLLRQHPPRSVTYIALGPLTNLAHITRHDPAVINERIGRVVCMGGALDVPGNTTPCAEFNFYADPFAVKRLLLDPENPCALPVDRFILLPLDITTPHELRFSLYKSKVDPEFENTAHPSRLANGKSPLTHFTSAFLERTREVMMEFGNDAIELHDIVAVWCAIENPPGEADPEATNPCSLGIGWRARKRIFDIERYGELTRGMLVVDRRVDASAYAPGANRAQVQKELGDLHCSEGLWESTAVPAQVDVEEAPAVTGEQQGWSVIRGVARLQIVGSNIFL

SEQ ID NO: 15002 - protein, 126 aa, Brassica napus
MAAAALRPAILRRIRLSPSPSLALAAAGTGASHPHALGRWLARPMSSHDAHLTRDEVIDRILDVIKSHPKIDPSKVTPEAHFEKDLGLDSLDTVEVVMAIEEEFKLEIPDMEADKIDSLPLAIEYV

SEQ ID NO: 15003 - protein, 345 aa, Pseudomonas fluorescens PfO-1
MSEIDILSFGETMAMFVAEQSGDLAFIDQFHKRIAGADSNVAIGLSRLGFKVAWLSRVGADSLGRFVVETLAREGLDCSHVEVDPAHPTGFQLKSRNDDGNDPTVEYFRRGSAASHLSPQSITPKLLGARHLHATGIPPALSASAREMSRELMTRMRNAGRSVSFDPNLRPSLWAGEREMIREINRLAALAHWVLPGLSEGRLLTGFEDPADIAAFYLDQGAEAVAIKLGPQGAYYRTHLDQGFVAGVPVETVVDTVGAGDGFAVGMISALLEHQSFPEAVRRANWIGSRAVQSRGDMEGLPTRSELAVEFEAAIAGKSNRLSAAPTVSVEYTKPVGAGLPAMRP

SEQ ID NO: 15004 - protein, 540 aa, Triglochin maritima
MELITILPSVLPNIHSTATVLFLLLLTTALSFLFLFKQHLTKLTKSKSKSTTLPPGPRPWPIVGSLVSMYMNRPSFRWILAQMEGRRIGCIRLGGVHVVPVNCPEIAREFLKVHDADFASRPVTVVTRYSSRGFRSIAVVPLGEQWKKMRRVVASEIINAKRLQWQLGLRTEEADNIMRYITYQCNTSGDTNGAIIDVRFALRHYCANVIRRMLFGKRYFGSGGEGGGPGKEEIEHVDATFDVLGLIYAFNAADYVSWLKFLDLHGQEKKVKKAIDVVNKYHDSVIESRRERKVEGREDKDPEDLLDVLLSLKDSNGKPLLDVEEIKAQIADLTYATVDNPSNAVEWALAEMLNNPDILQKATDEVDQVVGRHRLVQESDFPNLPYIRACAREALRLHPVAAFNLPHVSLRDTHVAGFFIPKGSHVLLSRVGLGRNPKVWDNPLRFDPDRHLHGGPTAKVELAEPELRFVSFTTGRRGCMGGPLGTAMTYMLLARFVQGFTWGLRPAVEKVELEEEKCSMFLGKPLRALAKPRQELLQSF

SEQ ID NO: 15005 - protein, 250 aa, Oryza sativa Japonica Group
MDEKTFYVVSVAAWQIADASTNHNDSMSERTIPPPVSSHGEDFAEVVVVRHGETSANALCIIQGQMDIELNEAGRQQAVMVARRLAKEAKPVAVYSSDLKRAAETAQTIATACNVSNLVLSPALRERHMGDLHGLKFDDAVRSKPDAYKAFSSEDRSQEIPGGGESLDQLSERCVSYLNTIAGKHKGERVIVVSHGASIEELCRHADPTSSVRRRIPNTSICVFNISGSTGHWILERFGDVAHLNEDDFP

SEQ ID NO: 15006 - protein, 753 aa, Erythrobacter sp. NAP1
MADAPKGGFTSREALFYHETGRPGKIEIVATKPMTSQRDLSLAYSPGVAVPVEAIAEDPKLAARYTAKANLVAVISNGSAILGLGNLGALASKPVMEGKAVLFKRFADVDSIDIELDTEDPEAFINAVALMEPSFGGINLEDIKAPECFIIEQALRERMNIPIMHDDQHGTAIITAAGLLNACYLTDRKIEDVKVVVNGAGAAAIACTALVKAMGVRHENVIMCDRKGPITPGREGVDQWKSAHAVQTDATTLEEALKGADIFLGLSAAGALKPEWVAEMADKPIIFAMANPVPEIMPDEAKAVRADAIIATGRSDFPNQVNNVLGFPFIFRGALDVQATTINEEMKVAAATAIAELARERVPEEVASAYGKNQKFGTDYIIPAPFDPRLIEVVSSAVAKAAMDSGVAQTTIDDFEAYGISLRSRLNPTTSVLTGVYNEAKANPKRMVFAEAEEEVVLRAAIQFRDFGYGTPILVGRTKAVLDKLHQLSVSDPGGFEIQNSADSEHVPAMVDFLYQRLQRRGYTQRDVRRMVNQERNVFAALLVALGHGDGMISGVTRTYAQTMREVSLVLDKKADALAFGIHMMIGKNHTTFLADTTINERPTSEELAYIAKETAAVARRMGHEPRVAFLSYSTFGNPSGQWLGNIRDAVAILDRDGCDFEYEGEMAPDAALNDKVMGLYPFSRLSGPANVLIMPGLQSANLSAKLLRELGANTTVGPMLIGMEKPVQIVPMTAAAPDLLTLSVLSSAGIVG

SEQ ID NO: 15007 - protein, 98 aa, Zea mays
  misc_feature (59)..(59): Xaa can be any naturally occurring amino acid
  misc_feature (65)..(65): Xaa can be any naturally occurring amino acid
  misc_feature (75)..(75): Xaa can be any naturally occurring amino acid
FDLDDTCQIGEIISRFEKKGFYLMDLKLVNVERSIAEKHYADLASKPFFQGLVDYIISXPVVAMXWEGKRVDTTXPKIVGATNPLRFEPGNLRGALCL

SEQ ID NO: 15008 - protein, 476 aa, Haloarcula marismortui ATCC 43049
MAEQPVDVDPAGENIAGEAPAEEPEAVTDDTVVHDDDVELERTIGLVGGLAIGIGTMIGAGIFVFPGLAAANAGLAATLSFAIGGLIALLVALPTSELATAMPRSGGGYYFISRGMGTAYGAIVGLGLWLGLMFASAFYLVGLGHYASAVFAELGIGLPFSPVIGIGLLFGVALTALSIGGTENTAKLQNVVVGVLLVVLTGFLSYGVLDAVGVFGGGTVPEQFFSRGYFRVLTTAALVFTSYLGFAQVATVAGEIKQPSRNLPLAMVGSVLIVTVFYVVTIFVATSAFGAERLGEFGETAMVEVARDFLGLPGAVAILGAGLLATFSSANASILSASRAVYALSRDALLPRKASEVNLRYGTPHVALLSAGGPILVLVATGRVELLAEVASFLHLIMYGLMCIALLVLRRRNPEWYSPSYRVPGYPLVPVVGALASFGLIVFMQPASIGIGVVVMLASYLWYRYYAGDVTLKGDI

SEQ ID NO: 15009 - protein, 216 aa, Yarrowia lipolytica CLIB122
MNILNNVDGSAKWEQGTSVICSVTGPIETRRRTDEPTLAQVELVIRPAIGQATTRETLIKDRIYSVLAATVVRNLYPRMLLQIVIQILEQGEGTGYNVLKLAACLNAVCLALIDSRTPMTGLFTAVAIAIVDDKLILHPTRKQVSQSTSTHAVSYFVENNKATGLLMCESEGEFTENQLFEVLEQAARACEDVALDMRERIEKGVKEGLRIDAGQE

SEQ ID NO: 15010 - protein, 341 aa, Brassica napus
  misc_feature (78)..(78): Xaa can be any naturally occurring amino acid
  misc_feature (86)..(86): Xaa can be any naturally occurring amino acid
MADKKIKIGINGFGRIGRLVARVILQRNDVELVAVNDPFITTEYMTYMFKYDSVHGQWKHNELKVKDEKTLLFGEKPXVTVFGIRXNPEESPLGVRAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDNRSSIFDAKAGIALSDNFVKLVSWYDNEWGYSTRVVDLIIHMSKA

SEQ ID NO: 15011 - protein, 378 aa, Chlamydomonas reinhardtii
MALVSKQISRATQVAGRRMAAVRPAMASRVSRSARLNTVCKVHKICVLPGDGIGPEIMEVATQALSVAGGKEGETFEYKQCLQSNAVLLAAIGGYKWDTLPSAQRPERGLLAIRAGLNAFANLRPAIVPRQLADSSPLKRELVEGVDILIVRELVGGIYFGQPRGFGTNEKGERIGYNTDVYSEPEVERIARVAFEAARKRGKRLCSVEKSNVLEVSQLWKEVVIRVGAEYPDVELSHMYIDNAAMQLLRNPKYFDVIVTGNIFGDILSDEASMLAGSLGLLPSASISGSGPGIYEPVHGSAPDIAGKDLANPLAMVLSAAMMCRYDLAIPKVADRLEAAVNAVLDAGLRTADIYKAGTPNTRLVKCSEMGAELMKHL

SEQ ID NO: 15012 - protein, 465 aa, Dehalococcoides sp. VS
MAKAGLNRIDMPKQAVNDRIQNFSEVATGYTPADAHTEAARCLQCKKRYCVEGCPVNIDIPEFILALRDGDMPEAARILKKTNSLPGVCGRVCPQETQCEQACILNKKEASIAIGRLERFVADWEREHSAEVNLPKSLKPKSGKKAAVVGAGPAGLTAAAELARLGHDVTLLESLHTAGGVLMYGIPEFRLPKNIVQGEIEYVKSLGVKLELNSVAGRLFSLDDLFKQGFQAVFLATGAGLPLFLNVQGENLSGVYSANEFLTRVNLMKAYNFPSSDTPVKKGKKVAVIGGGNVAMDAARCALRLGAEEVSIVYRRSELELPARKEEVDNAREEGIKFHFLTSPVRFLANEQGQVRAMDCQKMELGEPDASGRRRPIPVDGSEFEMDIDLAIIALGTRPNPLVMQSAPDLQVNANGTVAADTSGQTSHKAVWAGGDIVTGSDTVISAMGAAKRSAVVIDEYLRSL

SEQ ID NO: 15013 - protein, 336 aa, Yarrowia lipolytica CLIB122
MSNHLSSDSDISSTESMLCGGIAGMVSRFCIAPLDVVKIRLQLQKDGSRYYRGIFQTMQQIVRDEGVTALWKGNIPAELLYVFYGATQFVTYHHVNQVINAYNETAEKWKISSGAQSFIAGATAGAGATIATYPFDLFRTLFAAQGAKNCNVKNYTSLFQTFKLIYKTEGPLGFFRGVSSSIISIAPYMGLFFASYGRVKDSLDAFSNKHHDLLVSYNLPTKGWQEATAGLCAGTASKALVFPLDTIRKRLQTQGRMDVSYKELSGKPGVQRLLDSYNPFVMARRIIVAEGCRGLYKGFLVSLIKSAPTSAITMYTFEKSLSILRWWKAQGKSLEA

SEQ ID NO: 15014 - protein, 231 aa, Oryza sativa Indica Group
MEGGRGVTRVLLVDDSPVDRRVVQLLLSSSACAGSFHVIAVDSAKKAMEFLGLKEEGKEQAIDMVLTDYCMPEMTGYELLKAIKALSPLKPIPVIVMSSENEPQRISRCMNAGAEDFIVKPLQSKDVQRLRKCSPANTQCCDAGSDGKPPLLLLPSDHVVVDATAASPPPPPSRRRAHFAGVAMVLHSSSVELSHYFPFLFKFILLVYAILCLGELLHRWSNGCFLNLWCA

SEQ ID NO: 15015 - protein, 400 aa, Chlamydomonas reinhardtii
MALVSKQISRATQVAGRRMAAVRPAMASRVSRSARLNTVCKVHKICVLPGDGIGPEIMEVATQALSVAGGKEGETFEYKQCLIGGAAIDATGKPLPDETLEVAKQSNAVLLAAIGGYKWDTLPSAQRPERGLLAIRAGLNAFANLRPAIVPRQLADSSPLKRELVEGVDILIVRELVGGIYFGQPRGFGTNEKGERIGYNTDVYSEPEVERIARVAFEAARKRGKRLCSVEKSNVLEVSQLWKEVVIRVGAEYPDVELSHMYIDNAAMQLLRNPKYFDVIVTGNIFGDILSDEASMLAGSLGLLPSASISGSGPGIYEPVHGSAPDIAGKDLANPLAMVLSAAMMCRYDLAIPKVADRLEAAVNAVLDAGLRTADIYKAGTPNTRLVKCSEMGAELMKHL

SEQ ID NO: 15016 - protein, 277 aa, Leuconostoc mesenteroides subsp. mesenteroides ATCC 8293
MTFHELSDGQHLPEIGFGTYKLNGFAGTQSILSAVDAGYRLFDTAFNYQNEGTVGQAIQQSHVNRDELIITSKLPGKYYSSYQDSIDLIQESLYRSKLDYFDLYLLHWPNPIDDHYLEAWHTLIQAQKFGLVKSIGVCNFLPEHIERLKKETNILPVVNQVELHPYFNQQELREYNNTQNILTQAWSPLGRASAILKDPVLVELAKKYHKNIGQLVLKWEISLGVLPIPKASSYARQKGNLDLFDFEISSSDMQRINDLTKPDGRTNNQDPAVYQEF

SEQ ID NO: 15017 - protein, 237 aa, Sinorhizobium meliloti
MRSEMEEFHKVRRLPPYVFEQVNRLKASARAAGADIIDLGMGNPDLRTPQSIVDKLCEVVQDPRTHRYSSSKGIPGLRRAQAAYYARRFGVKLNPETQVVATLGSKEGFANMAQAITAPGDVVLCPNPTYPIHAFGFLMAGGVIRSISVEPDESFFPPLERAVRHSIPKPLALILNYPSNPTAQVATLDFYKDVIAFAKKHDIIVLSDLAYSEIYFDDAPPPSVLEVPGATDVTVEF

SEQ ID NO: 15018 - protein, 231 aa, Leuconostoc mesenteroides subsp. mesenteroides ATCC 8293
MNEKNFQKKQAALAALNYIQTDMIIGLGTGSTVSYFLDALAASQYNVIGVTTSTITSQRCAELNIPIVDIDAIDHIDVTVDGADEVDSYLNGIKGGGAALLMEKIVAKNSKKNIWIVDRSKVHNTLGSFPLPVEVIPYGSGQLLRQFANKGLFPKLRRHPGNNQPVITDAGHYIIDCHMTTINNPYALAEYLESQVGVVEHGLFLNICDRIIIGDNTVEIKERQQAHVEIN

SEQ ID NO: 15019 - protein, 677 aa, Aspergillus nidulans FGSC A4
MSQFQLTLATKANQAALLPILLVATSVNEARPAPVITINYEDATVLPRGDKEIVEFTAANGTLVYGSAAFKELLLSFPYLNSKEEKLENEWLAQLEDFASLDFKAIEPKLQQLNNHLILRSFVVGYALSTADIALWGALRGNRVAIGAIRKGTLINLTRWFNFLEELCPWAVAALEALNASAKEKRAAKAEGRGRHPFPSGAFWIPPHRTRQGRASERLLRPREEFQDAILEDLALMGIKPDKTSYSSDYFDELQQYAVQIIKDGNAYADDTDKETMASQRMNGEPSKRRDATVEENLARFEEMTKGTEEGARWCIRAKMSVDNPNKAMRDPVIYRCNPAPHHRTGTKYKAYPTYDFCCPIIDSLEGVTHALRTIEYRDRNPQYQWFLDTLKLRNVQIWDFARMNFVRTLLSKRKLTKLVEQGVVDGWSDPRFPTIRGIRRRGMTIPALREFILKQGPSRNIVNLDWTSFWATNKKYIDPVAPRHTAVLKKDAVKATIKGGPDSPYTQDKPKHNKNPDVGTKKVTYSSSILFDQEDAKSFKQDEEITLMNWGNAFVRKIVTDASGVVTELELDLNEKGDFKKTEKKVTWLSTDQDLVPVDLVDFDYLLNKDSMQEEDSLEDVLNPKTEFHEDAVADSNVALLAEGDIIQFERKGYYRLDKVASPGKPAVFFNIPSDE

SEQ ID NO: 15020 - protein, 313 aa, Leuconostoc mesenteroides subsp. mesenteroides ATCC 8293
MKNKVVVIGSLNIDTIQMIDRLPNQGETITVNNQASTFGGKGANQAVAAARQGADVTMIGAVGDDDRGRAFKQLLSDEGISTDYIFTKSQFTGSATIMLEPDGHNTIMVYGGANMNLTSADVEKARNIIANADVIVAQLEVPTEAIVAGFNIAKENGVLTILNPAPITSHLDSNIISSTDLIIPNETEAAALAHTEPTTKQSSLTPLTSKLNKVGFSNVVVTLGSDGVYYHVNGSADILPVFKVNAVDTTAAGDTFIGTFSANIDDNLSNLPSVIRRSCFASSIAVSRSGAIASIPNKKDVDAGLLANAAMAE

SEQ ID NO: 15021 - protein, 310 aa, Leuconostoc mesenteroides subsp. mesenteroides ATCC 8293
MIPIILDMDPGIDDAVALSIALSNPSIDIKLLTSVAGNVSVDKTTNNLLKLTTFFHQTQIPVAKGAAAPLKKDFSDAAYIHGESGMPGYDFPQVTKEAIKLDAITAMAEELEASIVPMTIVATGSYTNIAMLIQKYPSLLHKIEKFVLMGGSLSGGNVSSVAEFNVFTDPDAADIVFKSGVPIVMVGLDVTLKALLPFETIDAIGSQGEAGEMLQKVMTAYGDTAEGGKPMHDVNTICYLLNPEFYTVKDYWVDIIVSGPAAGATIADTQNRWSEGRLNAQVAVDIDTTAFEKWFVEQVPKMNQYRKEEN

SEQ ID NO: 15022 - protein, 319 aa, Leuconostoc mesenteroides subsp. mesenteroides ATCC 8293
MASTKMILDLDTGVDDALALALAVCDPRVDLIGVIASYGNTLMKTAAQNTLDLLHLLHADEVPVYLGESQASTVNDFEVMPISKAIHGDNGVGNILLEKSPRSIEKESGIQFLINMAHQYQDELVYVPTGPLTNLAKALQIDPKIAQLIGNTTLMGGALTVPGNVTPFTEANINQDPQAADQVFTAQEHLTMVGLDVTLRTLLTKAHTKKWRDLGTKAGQTYADLMDYYIDAYDNLGIDHRGAALHDPLAVAVAIDPSYVMTISLNMRVTHDQKTKDYGRTIGDRERLLEPTTTKVAVGVKSERFVHDFMDFMIAVLKN

SEQ ID NO: 15023 - protein, 84 aa, Dioscorea tokoro
INCTENRSVLHIALRAARDKAIKSDDKNVVPDVWHVLDKIKEFSERIRSGSWVGATGKALTDVVAVGIGGSFLGPLFVHTALQT

SEQ ID NO: 15024 - protein, 445 aa, Malus x domestica
MAIEIKQQQPSVGLSKIAVSDTHGEDSPYFAGWKAYDQNPYHESSNPSGVIQMGLAENQVSFDLLEKYLEENSEASNWGSKGSKGVSGFRENALFQDYHGLLSFRKAMASFMEQIRGGRAKIDPARVVLTAGATAANELLTFIIADPGDALLVPTPYYPGFDRDLRWRTGVNIVPIHCESSNKFQITPEALEAAHKEAEDKNMRVRGVLITNPSNPLGATIQRAVLEQILDFVTKKNIHLVSDEIYSGSAFSSSEFISVAEILEDRQYKDAERVHIVYSLSKDLGLPGFRVGTVYSYNDKVVTTARRMSSFTLISSQTQHLLASMLSDKEFTENYINTNRERLRKRYDMIVEGLKKSGIECLKGNAGLFCWMNLSPFLDEPTREGELTLWDSMLHEVKLNISPGSSCHCSEPGWFRVCFANMSEQTLGIALTRIHNFMEKKERAS

SEQ ID NO: 15025 - protein, 428 aa, Glycine max
MSDQQEIYAAFPNVPQAPPDSIFQLTARYVADKHPNKINLGVGAYRTDEGKPWVLPTVKKASRQLEENPNIDHEYLPITGLPQFTKAAQGLIFGKQNKAVDEGRVISVQTLSGTGANHLAALFFAKFYEFPTDKEIYISNPTWANHNAIISNVGVTPVSYRYYNKETIALDFDGYLEDLQKAPERSVILVHGCAHNPTGVDPTAEQWDKILDVFLQKKHYAFFDSAYQGFATGDLDRDAGSMRKFAEKRVPMLVCQSFAKNAGLYNERVGALHVVAADTKEAERVKSQLSVLQRSEISNPPAYGAHIVSMILTNPELFDSWKNDITTMSGRIIEMRDALFDLLNDKFKTPPPPGRKDWGHIKEQIGMFSFTGLNPDQTKKLVEEHSVYLTGNGRISMAGLNTHNVETFAKAVDEVVRSTSGTVPGSAL

SEQ ID NO: 15026 - protein, 533 aa, Triglochin maritima
LITILPSVLPNIHSSATLFLLLLMTTALSFLFLFKQHLAKLTKPKSTTLPPGPRPWPIVGSLVSMYMNRPSFRWILAQMEGRRIGCIRLGGVHVVPVNCPEIAREFLKVHDSDFASRPVTVVTRYSSRGFRSIAVVPLGEQWKKMRRVVASEIINAKRLQWQLGLRTEEADNIVRYITYQCNTSGDTSGAIIDVRFALRHYCANVIRRMLFGKRYFGSGGVGGGPGKEEIEHVDATFDVLGLIYAFNAADYVSWLKFLDLHGQEKKVKKAIDVVNKYHDSVIDARTERKVEDKDPEDLLDVLFSLKDSNGKPLLDVEEIKAQIADLTYATVDNPSNAVEWALAEMLNNPAILQKATDELDQVVGRHRLVQESDFPNLPYIRACAREALRLHPVAAFNLPHVSLRDTHVAGFFIPKGSHVLLSRVGLGRNPKVWDNPLQFNPDRHLHGGPTAKVELAEPELRFVSFTTGRRGCMGGLLGTAMTYMLLARFVQGFTWGLHPAVEKVELQEEKCSMFLGEPLRAFAKPRLELLQSF

SEQ ID NO: 15027 - protein, 183 aa, Glycine max
MISSNNNNSNINLRWTRNTRSGSPLFLSPTTGSPTTTSSGPLSLAGGALSPKFEGHKAAVLCVQWSPDKSSVFGSSAEDGLLNIWDYEKVGKKIERSGKSISSPPGLFFQHAGHRDKVVDFHWNAYDPWTIVSVSDDCESTGGGGTLQIWRMSDLIYRPEDEVLAELEKFKSHVVACASKTEK

SEQ ID NO: 15028 - protein, 395 aa, Pseudomonas fluorescens PfO-1
MRYSALTQRIAGEGAAAWRIHDRALELRAEGIDVLLLSVGDPDFDTPLPIIHGAIDSLLAGDTHYSEVRGRLELRKRIAERHRRSSGQDVDAEHVIVLPGAQCAVYSVAQCLLDPDDEVIVAEPMYVTYEGVFGACGATVVPVPVRPENGFRVDPVDVAARITSKTRAMLLNSPNNPSGASLSLLIWQELAALCIRHDLWLISDEVYSELLYEGEHVSPASLPGMAERTATINSLSKSHAMTGWRIGWMIGPKPLAEHLVNLSLSMLFGLPDFVQKAAQVALEKDLPEVTQMREEYRLRRDLVCERLRGCPGLYPIKPDGGMFVMVDVRQTGLGAQDFAERLLEGYGVSVLAGEAFGPSAAGHIRIGLVVDRVKLADACSRIALCAAQLLQVRSA

SEQ ID NO: 15029 - protein, 803 aa, Arabidopsis thaliana
MGSLGTMLRYPDDIYPLLKMKRAIEKAEKQIPPEPHWGFCYSMLHKVSRSFSLVIQQLNTELRNAVCVFYLVLRALDTVGGTKEYKILMDQFHHVSAAFLELEKGYQEAIEEITRRMGAGMAKFICQEVETVDDYDEYCHYVAGLVGLGLSKLFLAAGSEVLTPDWEAISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFHAASNLNAKIEHSWTSNMYHRGKLKSKANSDSVEVQAHGLPFCSPTNPPLFQTSSVFSPLFLKMGSLSTILRHPDELYPLLKLKLAITKAQKQIPLEPHLAFCYSILHKVSKSFSLVIQQLGTELRNAVCVFYLILRALDTVEDDTSVPVEIKVPILIAFHRHIYDGDWHFSCGTKEYKLLMDQFHHVSAAFLKLEKGYQEAIEDITKRMGAGMAKFICKEVETIDDYDEYCHYAAGLVGLGLSKIFIASELEILTPDWKQISNSTGLFLQKTNIIKDYLEDINERPKSRMFWPREIWGKYVDKLEDFKNEEKATKAVQCLNEMVTNALNHVEDCLKSLASLRDPAIFQSCAIPQIVAIGTLALCYNNVQVFRGVVRLRRGLIAKVIDRTKTMDDVYGAFYDFSCMLQTKVDNNDPNAMKTLNRLETIKKFCKENGGLHKR

SEQ ID NO: 15030 - protein, 93 aa, Oryza sativa
LKVNQIGTITEAIQAAKDAFGAGWGVMVSHRSGETEDVTIADIVVGLRSGQIKTGAPARSERLAKLNQILRIEEELGDNAIYAGKNFRTAVNL

SEQ ID NO: 15031 - protein, 69 aa, Zea mays
MATHRLVMVRHGESSWNQENRFCGWFDAELSEKGAEEAKRGATAIKDAKIEFDICYTSVLKRAIRTLWT

SEQ ID NO: 15032 - protein, 278 aa, Parvularcula bermudensis HTCC2503
MLHLTVQDHPIPRLGFGTWQLEGEDARTSTRTAIETGYRHIDGAAIYKNEKKVGEGIKDSGIPRDELFVTTKIWNEDIQKGRHSEAVDESLDRLGLDYVNLILLHWPINDMPIADQVGPLAEIKRSGRAKLIGISNYNQAQFLEAVSASEEPLAAIQCEYHPMLDQDPILKTARGFDMMFTSYSPLGRGEAMSNPAIERLAEQHGKTPAQIILRWHLQQANVAAIPKATSKAHIEQNFDIFDFELSATDMKTIYGLMKPDGRMVDPDWAPDWDTGVAA

SEQ ID NO: 15033 - protein, 278 aa, Mycobacterium sp. JLS
MAGRTIVITGASDGVGAAAAKRLSRSGENVVVVGRSPQKTAAVADALEADSFVADFSDLAQVRDLAQRLLDAYPRIDVLANNAGGMVNTRETTVDGFEKTFQVNHLAPVLLTTLLLDRLVQCRASVLNTSSMANKFVRTGFDDLDAVQKQSGSVAYSSSKLANILFTKELHRRYHGAGISTAAFHPGPVASNFSAEVDNPMFGVIYRSPLRHLALIGTEQGSDELVWLASATPGVDWRSGEYYHKHKVAKANKLADDAGMAERLWENSLELLGERAVS

SEQ ID NO: 15034 - protein, 441 aa, Parvularcula bermudensis HTCC2503
MTAAGSNDYPSTELLVARRNDACPMGLPSKSGLYAERAEGAEIWDVDGKRYIDFIAGIGVLNVGHRHPKVQEAIKSQLDKVVHTAFGVAQYEPYIALAERLNELVAKAGNGASAYKTMFVNTGSEATEQVCKFARRITGRPGLIAFEGAFHGRTLLATALTGKAEPYKAGFGPFPPDIYHAPYPNPYMGMSVEGALNCLHHIVGTSIRAEDVAAVIIEPVQGEGGFIPAPIDYLRGLKEFCETHGILLIADEVQTGFARTGRMFAIEHAGVEPDFLICAKSIAGGLPLGAITGKASLFDKIAPGGMGSTFGGNPVACAAALAVLDVIEQEGLIERAEVIGQRIEARWRDLAEGPARGIFGDIRRAGAMAAIECVRDADAREPNPDFAAALQSMARDKGLIFLTAGRKAHVIRTHVPLTIADDLLEEGLDLFAEATLATLKG

SEQ ID NO: 15035 - protein, 309 aa, Haloarcula marismortui ATCC 43049
MAKRPAERAGVADIDCTGMQVLVTGSTSGIGREAALSLGRLGADVIVHGRDADAGAAVVSELSGLGVDAAFVQADFAAVDEVRSLAATVRDETDGLDILVNNAGGLFRQGRLTDIGVEYTFHVNHLAPYLLTTELLDHLNAGARVVTTASSAHRGTSLDLDRVTTVDSYTGTWAYSHSKLANVLFATELARRLETTGRDVVSNCLHPGAIPGSGFSRFLPGPIPQFVKLFDAVPGITSVEDGAAEILHLAVSSRIGDVSGRYFAGQRPATPSHAARDRAAASRLWRRSADLLGIDVPLGDVQSSAPTEN

SEQ ID NO: 15036 - protein, 403 aa, Anabaena variabilis ATCC 29413
MSFDWITPADRIQQLPPYVFARLDELKAKAREQGIDLIDLGMGNPDGATPQPVVDAAIQALQNPANHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALGRIKQAGIRYRPEALVSTPE

SEQ ID NO: 15037 - protein, 365 aa, Physcomitrella patens subsp. patens
GFTAPVAAARGEYLATVRLGTPERVFSVIVDTGSDLTWVQCSPCGKCYSQNDALFLPNTSTSFTKLACGSALCNGLPFPMCNQTTCVYWYSYGDGSLTTGDFVYDTITMDGINGQKQQVPNFAFGCGHDNEGSFAGADGILGLGQGPLSFHSQLKSVYNGKFSYCLVDWLAPPTQTSPLLFGDAAVPILPDVKYLPILANPKVPTYYYVKLNGISVGDNLLNISSTVFDIDSVGGAGTIFDSGTTVTQLAEAAYKEVLAAMNASTMAYSRKIDDISRLDLCLSGFPKDQLPTVPAMTFHFEGGDMVLPPSNYFIYLESSQSYCFAMTSSPDVNIIGSVQQQNFQVYYDTAGRKLGFVPKDCVGRR

SEQ ID NO: 15038 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 15039 - protein, 818 aa, Debaryomyces hansenii CBS767
MSVHESQVPEIQEFQPEAQEHDFDYANDEYEIKNSNVLVPLYNEREVTVVDWGQEVFGSPLQKATNYFISLFPIAQWILHYNRKWLYGDLIAGITVGVVLVPQSMSYAQLAGLSAEYGLYSSFVGVFIYSFFATSKDVSIGPVAVMSMQVGKVIQNVQAKVGEDKYDPAEIATFLSLICGGIATGIGILRLGFILEFISIPAVMGFMSGSAFSIIVGQVPGLMGYNSLVNTRSASYMVVIDTLKNLPNTTVDAAFGLVCLFILFVWKFLTEIAMKRWPRYKLWFFYSQNLRNAIVLIVATAISWGIVHPQKVAFDGPASDFKPPIKTIGEVPSGLQHVGVMTIPDNIISLMASEIPVSTIILLLEHIAISKSFGRVNDYKVVPDQELIAIGVNNLIGTFFNAYPATGSFSRSALKAKCGVRTPLAGIFTGAVVLLALYCLTSAFYYIPKAVLSAVIIHAVSDLIANYKVTWNFWRISPLDCGIFLIAVIITVFSSIENGVYFAICASVAVLLFRVSKPQGFFLGRIQVAEVINPIIDNSNSDSSSTISGDANYNNSSSDVSKDIEIHQVLSNTSNYQATSSNKFKSKEAITTLPSTHKLLDNNPNIRFHTRWVPLTKENINSDLQVRPPPPGVIVYKPIEAFTYPNASTQIERVTDEVKRITRRGKPYNSNDVGSRPWNDPGPLQWSIPFFKNKNAKVETPQEDNRPILKIVHFDFSTVASVDVTSIQALVDLRKALNIYADREVEFHFSGILSPWIRRGLMNAGFGSYSEDGLVSDTTYVNIATSSKTQDIESGINDQYFAAVSTNTPYFHLDIPNF

SEQ ID NO: 15040 - protein, 712 aa, Aspergillus nidulans FGSC A4
MNPAEHDEAVSQFCAMTRARPDEAQEYLATNGWDLEAAVTEFFAEQDETAGSSEPTGQPSAKSSSSTPRESSSSRKQPPKKFATLGDLASGAADSSDDDDDENQDFFAGGEKSGLAVQNPDDLKKKIIEKARRTQLPASDDSEPRRNYFTGPARTLGGEDTPSRVIDTPSGPAQPQIPRRVRRTLHFWADGFSVDDGELYRSDDPQNAEILNSIRQGRAPLSIMNAQHGQDVDVEIKQHDEKYVRPKPKYQPFAGKGQRLGSPTPGIRAPAPSEPAPAPQSSSGPPKPNVDESQPVVTLQIRLGDGTRLTSRFNTTHTIGDVYDFVSAASPQSQARPWVLLTTFPSKELTDKAAVLGDLPEFKRGGVVIVAIYPNNGKHAVTCGAPVSVILSGKGGVGKSSVTLQLALALTLQGKSVGVLDIDLTGPSIPRLVGLEGAKITQSSNGWVPVPVHEAEAQTASGNDAAVALSDDGGDENKDVERAKPRGSLRCMSLGFLLRDRGDAVIWRGPKKTAMIRQFLTDVYWGDTDYLLVDTPPGTSDEHIALAEELLKLSTTSPSSTGVGALPRLTGAVLVTTPQAIATSDVRKEVNFCVKTNIPTLGVIENMSGYTCPCCGEVSNLFSSGGGEVMAREMGVRFLGKVPVDVQFGALVEGKSQEESDDEDEDRERNKVEEEKGQDFVDERPLVERYKECWSYGQFEGFAKTLIGEIEG

SEQ ID NO: 15041 - protein, 232 aa, Triticum aestivum
MAGRAATFPPASPPPGEQFAEVVVVRHGETSWNASRTIQGQMDPELNETGRRQALVVARRLSREAKPAAVYSSDLKRAAETAQTIATACGVSSLVLDPALRERHMGDLHGVVFDDAVRRSPEIFSSYSRTHEIPGGGESLDQLSKRCVSYLNTVAEKHKGERVIVVTHGASTEELCIHADPTSPVRGKLYNTSICVFRIGGGEWILEKAGDVGHLDQGEFLEDAFGGDGVSA

SEQ ID NO: 15042 - protein, 299 aa, Vitis vinifera
  misc_feature (77)..(77): Xaa can be any naturally occurring amino acid
MGPSETQNSINLKLILICSLCLLFFPLVCKSNFTPFRENHPSPILETHVSSSTCPATEEQLPSPACPSLLLTPTCTXTPPSLAQALVHYATLNVTPQQTFDEISVTSRVLQKKAPCNFLVFGLGHDSLMWTALNHGGRTVFLEEDKSWMERIKQKFPSVESYYVVYDTKVHQADELLEVGMGEDCKVVVDPRFSKCKLSLKGFPNEVYDVEWDLIMVDAPTGYHDEAPGRMGAIYTAGLMGRNREDGETDVFVHNVNRVVEDKFSKAFLCEGYFREQEGRIGRFTIPSHRTRSGRSFCP

SEQ ID NO: 15043 - protein, 517 aa, Campylobacter upsaliensis RM3195
MMNSLILVLDFGSQYTQLIARRLREYGVYTEIVPYFEKLDFIKAKNPKGIILSGGPASVYEEGAYKPDSRVFELGIPVFGICYGMQYIAHFFGGSVVRAEAQEFGKAVLEIADLNLALFKGVKQDSIVWMSHADKVESLPSGFVELAKSGNTHYCAIADFKRNVYALQFHPEVVHSECGGEILRNFAVGICGADTSWNMRNFAESEIAKLREKVLGGDKVLCAVSGGVDSSVVAILLYRAIGENLIPVFVDTGLLRKGEREAVEAMFKENLKVPLIVADARELFLRRLKGVTEPEQKRKIIGETFIEVFEAEAKKHNTKGEIKFLAQGTLYPDVIESVSVKGPSKTIKSHHNVGGLPEWMKFELIEPLRELFKDEVRALGRELGMPESMLMRHPFPGPGLAIRIMGEVNSADLELLKEADSIFIEELHKWGLYDSVWQAFCVLLNVRSVGVMGDNRTYDNTICVRAVEAQDGMTASFSHLPHAFLESVSNRIINEVVGINRVVYDITSKPPGTIEWE

SEQ ID NO: 15044 - protein, 316 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLEAKLKVKAKLVNSLMGQWQGWRYVRAHSFCGFAHNVKLCHFIFNILPQKFKTYFYLHFKFVCFIVFFCIYFLLCDDNYLCT

SEQ ID NO: 15045 - protein, 443 aa, Leuconostoc mesenteroides subsp. mesenteroides ATCC 8293
MTQQYDYDVLYLGSGHGTFDGAVPLAQSGVKVGIIEKDLIGGTCPNYGCNAKITLDAPVTLLRESERFSGVVAGNLKINWKESVAHKQEVIDELPGMIGGLIKSSGIDIIQGSGVFQDNHTILVDGQPKTADKIVISTGLRPHRLDIPGSELAHDSREFMDLTELPDKIVIIGSGYISMEFVTIANAAGSDVTVLMHGDKALKEFYQPYVNKVIDDLKERGVKFVKNAKVSSFEKSGDQVIVNYGDDQSLSVGWVLDATGRIPNTDNLGLSEIGVNYNEKGVIVNEYLQTNVDNIYASGDVIDKTQPKLTPTAIFESTYLFKRFSGQSREPITYPVIPSVVFTSPRIAKVGVAVEEAKENNYQIEENNLVGDWYRKVNKETISENTLIFDDEHRLLGATEVSEQAENVINTLLPAVEFKFNKEEIARLIHLFPSISASTWDLL

SEQ ID NO: 15046 - protein, 722 aa, Mycobacterium avium 104
MTGSGSARQLTLTARLNTSAVDSRRGVVRLHPSAVAALGIREWDAVSLIGSRTTAAVAGLAGPEIPSGTVLLDDVTLSNAGLRDGTAVVVSPVTVYGARSVTLSGSPLTTRSVSPVTLRQALLGKVLTVGDAVSLLPRDLGPGTSTSEATRALAAAVGISWTSELLTVTGVDPDGPVSVQPNSLVGWGARAAPAAASRVSVEVARPQTVVEELKGCQPQAAKLVEWLKLALDEPHLLKTLGAATFLGVLVTGPAGVGKVTLVRAVCGDRRLVTLDGPEVGALGADDRLKAVASAVQTVRDGGGVLLITDVDALLPATAEPVASLILAELRGAVASEGVALIATSARPDQLDARLRAPDLCDRELSLPLPDAATRKALLESLLRNVPTDGLDLDEIASCTPGFVVADLAALIREAALRAASRASSDGRPPALHQEDLTGALSVIRPLSRSAAEEVSVGDITLDDVGDMAQARQALTEAVLWPLQHPDTFARLGVQPPRGVLLYGPPGCGKTFVVRALASTGQLSVHAVKGSELMDKWVGSSEKAVRELFRRARDSAPALIFLDEVDALAPRRGQSFDSGVTDRVVAALLTELDGVDPLRDVVVLGATNRPDLIDPALLRPGRLERLVFVEPPDAAARREILRTAGKSIPLSADVDLDELAAGLDGYSAADCVALLREAALTAMRRSIDATDVTAADLAAARENVRPSLDPAQVASLRAFAEAP

SEQ ID NO: 15047 - protein, 1005 aa, Cryptococcus neoformans var. neoformans B-3501A
MTSFNPAPAQIQAAQDHTYGSMPTPTYMGMVDTGAQWDYVGRRGSSRSREPSASPQRAATESGIPRTSTHAASASASSSYAPVAGASGQASSAPHEPTIREEATAVVDRSMRAHQQTTGPSNGNGNSQPKKSKVRMVGDWQLNKTLGAGSMGKVKLATNIVTKEKCAVKIIPRYTDANRKEETTRTPEEVEKQRLKDESKEIRTIREAHISLLLHHPYICGMREFISHQNHHYMVFEFIDGGQMLDYIISHGRLRERAARKFARQIGSALNYCHQNSIVHRDLKIENILISKNGNIKLIDFGLSNLYSPSRHLSTFCGSLYFAAPELLNARPYTGPEVDVWSFGIVIYVLVCGKVPFDDQSMPALHAKIKRGVVEYPSWLSAEVKSLLSRMLVTNPAERATLAEVLSHPFMTKGYDGPPDSFLIRRELLRAEEIDMNVVEAMEGFTFGDANTIYRNLHSILTSEDYLHCVATFEAHREKLRTSSPGVSTNDPSDSPKKKRFSGFDLKKRLFKEDKKVEEAPFKEKVRDPTKGYDPLISIYFLAREKIERERVFGPGFFASSQLSLDTFNTSQGYGMAVPNLPPPASTHVMGHDSSRGPDFASEPRPRSDDVPNPVLAHPSADREQSKLADIPSAVHRRQPSLSQPPLPSSMPAAVERSADEGLTKKFSMLGRGPRPPSAGPSGPSRSASTKRESMTASPSMPIQEHRRATTVVHSDKSKQERRVSVGSFTNSVSKASGLARRASQRDRPPATPPDSRWLNAPAEAEEYHQVETSVRPSSTPREPEPDTANEPRSYDDVKPSYLKGIFSVSTTSTKPANVLIRDIAMVLDRIGIKHRPIKGGFECVHMPSIDLASVVNGDEASTSLSNVPSHASGARRKQSLRRKGSKVNMNGISSNGAGSRATSPGPHRVLTGNSSGTVSGGDVAHLSVPSGKNRHHVGTVEEDEVDAWALAQSGGAGSSLIVRFEIFVVKVPVLPLHGIQFRRVGGDGWQYQMLAKAILREMRL

SEQ ID NO: 15048 - protein, 196 aa, Oryza sativa Japonica Group
MKHVFESLSSYGDKVIATGLPASPGAAVGQIVFTADDAEAWHAQGKSVILVRTGIGLSVPPGFTVSTEACQQWTHVDHTSSSLTSSLYPLSPSSLSPADGAGWAAAGAGDGGAEPRSEAARRPAGEKSRRGGGRRGVGRRPLGAEEPPVARGRLRVRAGVHLDVGVAVGDQGLEVGLLVAGDEAERAQARAPLRPP

SEQ ID NO: 15049 - protein, 479 aa, Prochlorococcus marinus str. MIT 9301
MAERFSQKNLRVRPSSDEEKIVTNAKKHFEKTLVEISGELVGSVAALEHPTKNKKLNYGEIFLRDNVPVMIYLITQKRYEIVKKFLSLCLELQSTNYQTRGVFPTSFVEENGKLIGDYGQRSIGRITSADASLWWPILCWYYVNKSGDYAFGKSQSVQRGIQLLLDLVLHPTFEGTPVLFVPDCAFMIDRPMDVWGAPLEVEVLLHGCLKSCINLMELSRADHVSRLLDQRLILTNQWVKDLGGFLLKHYWVTSQTMQILRRRPTEQYGDDQHFNEFNVQPQVVPSWLQDWLENRGGYLIGNIRTGRPDFRFYSLGNSLACMFGVLPPEEQRALFRLVLHNRQHLMAQMPMRICHPHMDVEEWQNKTGSDPKNWPWSYHNGGHWPSLLWFFGAAVLLHQKNYGSDDVILMEEMKSLIEESYWCQLNQLPKQEWAEYFDGPTGTWVGQQSRTYQTWTIVGFLLMNHFLRNDYNDLDMFKI

SEQ ID NO: 15050 - protein, 212 aa, Sulfolobus solfataricus P2
MYRAIFLDFGNTLVGFKPAFYEKLQIILKEHGYDVEIRKVFRAYVKAMAINNYAQPTDIKEFLYNLSIPPDEKLINSIMSSDIRDGEAFVYDEVIEFLETIRSANLKLILVSNSSPRTKKLLEELGLVKYFDNLVLSHEIGIVKPNPKIFAIAISKGGYPALHIGDIYEIDYIGARRSYLDAVLLDRYDFYPEIKEKVRDLREIIPTIMKNL

SEQ ID NO: 15051 - protein, 124 aa, Brassica napus
  misc_feature (8)..(8): Xaa can be any naturally occurring amino acid
  misc_feature (18)..(18): Xaa can be any naturally occurring amino acid
  misc_feature (27)..(27): Xaa can be any naturally occurring amino acid
  misc_feature (30)..(30): Xaa can be any naturally occurring amino acid
  misc_feature (35)..(35): Xaa can be any naturally occurring amino acid
  misc_feature (38)..(38): Xaa can be any naturally occurring amino acid
  misc_feature (41)..(41): Xaa can be any naturally occurring amino acid
  misc_feature (45)..(45): Xaa can be any naturally occurring amino acid
  misc_feature (48)..(48): Xaa can be any naturally occurring amino acid
  misc_feature (52)..(52): Xaa can be any naturally occurring amino acid
  misc_feature (56)..(56): Xaa can be any naturally occurring amino acid
  misc_feature (65)..(67): Xaa can be any naturally occurring amino acid
  misc_feature (72)..(72): Xaa can be any naturally occurring amino acid
  misc_feature (74)..(75): Xaa can be any naturally occurring amino acid
  misc_feature (77)..(77): Xaa can be any naturally occurring amino acid
  misc_feature (83)..(83): Xaa can be any naturally occurring amino acid
  misc_feature (96)..(96): Xaa can be any naturally occurring amino acid
  misc_feature (98)..(99): Xaa can be any naturally occurring amino acid
  misc_feature (102)..(102): Xaa can be any naturally occurring amino acid
PHLPFKQXISDANGFGSXHVRKETEVXSPXGVVRXLGXVAXIMLXIFXVISXLYAXGYGPEIRKXXXSLKFXPXXVXGGKRTXNQCPPGKVLVIEXGXXRCXVKERVEIPFHSVLPKRDVTYGY

SEQ ID NO: 15052 - protein, 335 aa, Hypocrea koningii
VPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 15053 - protein, 463 aa, Prochlorococcus marinus str. MIT 9301
MKISDKFHLEDIYQLKKTVLTGKTEDIKWRIKHINIVSKLLDENKKEIIKSLFVDLGKSEIEGLSEILLVKEEISLIKKKLNSWMRPKKIDTPFYLFPSSSKVIYEPLGCVLILGPYNYPLLYVLKPLVNIFSAGNTAVIKPSEKCPATSKLIKRLTIKYFRKDVLMTVEGDYKQSIKLIEQNFDHIFFTGSTETGKSIMKLASKNLTPLTLELSGTNPVIIFKNANLEVAAKRIVWGKFFNSGQSCMAPNHIFVDKEIENIFIEKLKKCIVSFYGDNPIISENLSKLEKKQFTSTVEILKQYKKEKRILFGGTFSKKNLKISPTILRTKLNETDILQKELFSSLLPVIGINDRELVLKQISQTSKPLAIYLFGGNKKIHNHISKVTSSGTICINDVMLPVLIPNLPFGGVGQSGIGKFHGEEGFRNFSNQKSITFKGFLFDSNLRYPPYKRVKKFLKFIFQI

SEQ ID NO: 15054 - protein, 667 aa, Haemophilus somnus 129PT
MSYQVLARKWRPKTFSEVVGQEHILTALSNGLCENRLHHAYLFSGTRGVGKTSIARLFAKGLNCIRGVTAEPCGECEHCKAIEEGRFIDLIEIDAASRTKVEDTRELLDNVQYKPTQGRYKVYLIDEVHMLSRHSFNALLKTLEEPPEYVKFLLATTDPQKLPITILSRCMQFHLKALSEKQIAQHLEFILQQENIPFEYPALEKLATAAQGSIRDSLSLTDQAIAMGNANVSLDTVSIMLGLLDDNQPIDILYALQQGNGEMLMKAIQTVAEKGADWDKLLVTLAEKLHQIAMLQLLPQQINEENSLGFLAKHITPEDVQFFYQVIVSGRKELASAPNHRIGAEMILLRSLAFHPKFISPSSAAPIEQSAVQKSQNIVQPPLVEMPVVSVAEQLPSQNLIRKPTIADKVDTKLSTTALSALEALEQLSQPSDHSDSEKKNSPIDNIHDISLRENTENISALPVLNVVPKDVDNALKTVTVIDKSDHRSDEIQEDSAENYRWEWRNPEMAVEEKAIRPSEIKQAILEQASPELIQRIIATAQERDDWTRIIEQLPLRGMTKDMVLNTVLLNQSEDQIVLSLMSDKQHLLDRCHKELKQALSDFYQRDIQLLITPTDDKNLATPLYYQNLVYQEFNEQAKKALQEDNSLKLLEKEFAATLDLDSVRPI

SEQ ID NO: 15055 - protein, 337 aa, Hypocrea koningii
APIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 15056 - protein, 351 aa, Legionella pneumophila
MICQMLSTILQKSKNLTMKNQMNNLLVTGAAGFIGSNFVKFMNDKYPEIKIISLDKLTYAGNKANLSEMAECKNHLFVQGDILDKSLVLSLLREYEIDTLVHFAAESHVDNSIDNPQIFLETNVIGTFTLLEAARIYWLNERQWDKSKCRFHHVSTDEVYGSLEREEPAFTEKNSYQPNSPYSASKASSDHIVRAYYHTYGLPVTTSNCSNNYGPNQHKEKLIPKVVYACVNQLPITVYGNGSNIRDWLYVMDHCEAIDTIIQKGALGEVYNIGGNNELDNLSLIKMICQMMDDLKPMEIVEDRKGHDKRYAIDNSKIQKELGWVPQGDFVHKLSNTVHHYLTRYEREINI

SEQ ID NO: 15057 - protein, 174 aa, Haemophilus somnus 129PT
MIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 15058 - protein, 139 aa, Vitis vinifera
MIRTTKAREKQLPPTMANSVGLLAICAAAFLIAASAVTAVDSTADNLSWIPTRSVCKGTVAECLALAGGEDEFGLTSEFAMDSEINRRILATSKYISYGALQRNSVPCSRRGASYYNCQPGAQANPYNRGCSTITRCRS

SEQ ID NO: 15059 - protein, 451 aa, Mycobacterium sp. JLS
MSPETSSEATEQVQDEPATGGKLKRKITGSLLFLFILGDVLGAGIYALMGVLAQDVGGVLWAPLLVALLLALLTAGSYAELVTKYPKAGGAAVFAERAFKRPVVSFLVGFSMLAAGVTSAAGLALAFAGDYLSTFIDVPAIPAAMVFLGLVAALNARGINESVKSNVVMTVIELSGLLIVIVAVAMMVGGGRGEVGRVVEFPDGATPALAILAGAIVAYYSFVGFETSANVAEEIRNPSKVYPTALFGALIAAGVVYALVGVASAVALPADQLSESSGPLLDVVSAAGVGVPDWLFSAIALVAVANGALLTMIMSSRLTYGMAEHGLLPSVLSRVLPQRRTPWVAIVATTVVAMCLTLVGELSTLAETVVLLLLFVFISTNVAVLVLRRDHVGHDHFRVWTAVPVLGVASCVLLMTQQTAKVWAFAAIMLAVGAVLYGLARIATKREGTAV

SEQ ID NO: 15060 - protein, 322 aa, Vitis vinifera
MAASLQLPMASSIPSSSSPSTTRPIFKTHCSMKPTCSAKIPMSPINPKDPFLSKLASVAATSPERLLQRPSGSDSLPFLDLFDSPKLMATPAQVERSVSYNEHRPRRPPPDLPSLLLHGRIVYIGMPLVPAVTELVIAELMYLQWMDPKEPVYVYINCTGTTRDDGERVGMETEGFAIYDAMMQLKNEIHTVAVGAAIGQACLLLAAGTKGKRFMMPHAKAMIQQPRVPSSGLMPASDVLIRAKEVITNRDTLVKLLAKHTGNSEETVSTVMRRPYYMDSTKAKEFGVIDKILWRGQEKIMADVLSPEEWDKNAGIQVVDGI

SEQ ID NO: 15061 - protein, 551 aa, Synechococcus sp. WH 8102
MGKPGRSSIPSVGVHHQGPMSFPDFSASDAQIQWQRFCDLLWYHEDLGIWLDISRMHVNPSHLEQLQPGFDKAFAAMAELEAGAIANPDEQRQVGHYWLRTPQLAPNEAVRDQIATEIDQIDQFGRDVISGVIKAPGGQPFTDVLWIGIGGSGLGPLLMIRALQGHGSGLPFHFFDNVDPNGMSAVLAELDDRLATTLVVTVSKSGGTPEPHLGMEQARHRVESRGGRWADQAVAITMVDSKLDREAQQDGWLKSFSMFDWVGGRTSITSAVGLLPGALIGADIRDFLAGAAQMDDATRLADLRRNPAALMAASWFVAGDGKGRRDMVVLPYRDRLEVFSRYLQQLVMESLGKRLDRDGNEVNQGIAVYGNKGSTDQHAYVQQLRDGVDNFFATFIEVLEDVSDIPVIKDECPGDFLDGFLQGTRSALTEGGRQSLSISMRRFDARRLGALIALFERAVGFYGDLVNINAYHQPGVEAGKKAAAAILDLQSRVEAVLKDGAPRTVSEIRQAVGDGSDEAIFWIMRHLAGNDRGYRAEGDWANPASIRFSCS

SEQ ID NO: 15062 - protein, 716 aa, Shewanella sp. ANA-3
MIYQSPTIQVELLEDNIAKLCFNAPGSVNKFDRETLASLDAALDSIKQQSNIQALVLTSGKDTFIVGADITEFLGLFAQDDAVLLSWIEQANAVFNKLEDLPFPTASAIKGFALGGGCETILATDFRIADTTAKIGLPETKLGIIPGFGGTVRLPRVIGADNALEWITTGKDQRPEDALKVGAVDAVVAPEALEAAAIQMLKDAVAEKLDWQARRQRKMSPLTLPKLEAMMSFTTAKGMVFAVAGKHYPAPMAAVSVVEQAATKGRSDALQIEHQAFIKLAKTDVAKALIGIFLNDQLVKGKAKKAGKLAKDVKSAAVLGAGIMGGGIAYQSASKGTPIVMKDIAQPALDLGLGEAAKLLSAQVARGRSTPEKMAKVLNNITPALDYAPVKHADVVVEAVVEHPKVKAQVLAEVEQYVSEDAIIASNTSTISINLLAKSMKKPERFCGMHFFNPVHKMPLVEVIRGEHSSEETIASVVAYASKMGKTPIVVNDCPGFFVNRVLFPYFAGFNGLLAEGGDFAAIDKVMEKQFGWPMGPAYLLDVVGLDTGHHAQAVMAEGFPDRMGKSGNDAIDVMFENKRLGQKNGKGFYAYSVDSRGKPKKDVDPTSYELLKAAFGEQKAFDADEIIARTMIPMIIETVRCLEEGIVASPAEADMGLVYGLGFPPFRGGVFRYLDTMGVANFVALADKYAHLGGLYQVTDAMRALAANNGSYYQA

SEQ ID NO: 15063 - protein, 314 aa, Zea mays
MGGGVMRTAAKVSIAGGAAAAKSGRFRNAAPVFATAPAAAGSEAAPLVSVSSGEVPPAAAQWAASWELDDWEFADWRDDAAAAAAVVEREATAAAAKPRLVFAPPSREEAEEATTELRDAVERAYFNESPVEVVKEQDKEFNKLATDAMIPSMPGHVVQAFTLLKSSTEAQSVVASLASDRNVWDAVLKNEKVMEFYKTHQTTLVQTSPNEAVTVELPGKLEDAASENTSSGELPAGSGPSFSDFVDNAKKTVMDVVHNITDFFKDLFDDSAKTQTGAGPSAAEKGPSTADMAVGGSFMALAIAVILVVMFKRA

SEQ ID NO: 15064 - protein, 567 aa, Synechococcus sp. WH 8102
MATSNQQLIVQRLIMMELQYGRLLNSSSQHQQDDPIRFDDIAEALAAIRNGACVVVVDDEQRENEGDLICAAQFATPEAINFMATEARGLICLAMEGKRLDELDLPLMVDRNTDANETAFTVSIDAGAEHGVSTGISAEDRARTIQVALNPKTRPAELRRPGHIFPLRAKPGGVLKRAGHTEAAVDLAQLAGLTPSGVICEIQNSDGSMARLPELRAYADTWGLKLISIAELIRYRLDNERFVRRQAHAELPSQFGSFQAIGYCNELDGSEHVALVKGDPASLREPVLVRMHSECLTGDAFGSLRCDCRPQLEAALRQIEREGEGVVVYLRQEGRGIGLINKLRAYSLQDGGLDTVEANERLGFPADLRNYGVGAQILSDLGIHRLRLLTNNPRKIAGLGGYGLQVEERVPLVMDAGDHNADYLAAKRDKLGHLMDSDGPCTVLAVAVNDRTESLPSIRSRVEDLAETHGQTLEALHEPRLLALWDRPQFVWKLTPEVDAPLALLQSIAQLESTQRIGLLRVSTERSALHPSQTLEREERSLVELIQTNGDERLTQRPSLLHWSARD

SEQ ID NO: 15065 - protein, 143 aa, Citrus junos
MGSKTSASLALFLAVNILFFALVTACGSCPSPKPKPKPKPTPSPSGASCPRDALKLGVCANVLNGLLNVTIGTPPVQPCCTLIQGLADLEAAVCLCTAIKANILGINLNIPLSLSLLLNVCSKGCPVVSSVLNDDHIFLYLRL

SEQ ID NO: 15066 - protein, 487 aa, Arabidopsis thaliana
MGIFDNVNSPGGWETPVSSARNSFEPHPMVAEAWDALRRSLVYFRGQPVGTIAAYDHATEEVLNYDQVFVRDFVPSALAFLMNGEPDIVKNFLLKTIQIQGREKRIDRFKLGEGAMPASFKVIHDPIKETDSINADFGESAIGRVAPVDSGFWWIILLRAYTKSTGDTSLAETSECQKGMRLILSLCLSEGFDTFPTLLCADGCSMIDRRMGVYGYPIEIQALFFMALRSAMSMLKHDAEGKEFMERIVKRLHALSFHMRSYFWLDFQQLNDIYRYKTEEYSHTAVNKFNVIPDSIPEWVFDFMPLRGGYFIGNVSPARMDFRWFALGNCVAILASLATPEQSASIMDLIEERWEELVGEMPVKICHPAIESHEWRIVTGCDPKNTRWSYHNGGSWPAACIKTGRPQIARRAIDLAEARLLKDGWPEYYDGKSGRFIGKQARKFQTWSIAGYLVAKMLLEDPSHLGMISLEEDKQTKPVIKRSYSWT

SEQ ID NO: 15067 - protein, 80 aa, Oryza sativa
  misc_feature (10)..(10): Xaa can be any naturally occurring amino acid
DRASCFNPPXDERILREALKEPIAFMGGVFAGLLRLDLNEDPLKEWITRTVEASGVAEDSRTDESSEGSQNDAPQQIEIE

SEQ ID NO: 15068 - protein, 484 aa, Leuconostoc mesenteroides subsp. mesenteroides ATCC 8293
MADPFGFLKYERVDNPYRKITERIKDFNYMAEPLAFDQRVEQAARCMNCGVPYCHIGALYGNKSKQMSGCPNDNLIPEWNDLLYRKELHQAWLRLAKTNPIPEFTGKVCPAPCEVSCNEFLNGAGVTIKDNEDFIVEYAFAHGWVVPEGLPEQRTGKKIAVIGSGPAGITAAWRLNQLGHEVTIFEKDERLGGLLMYGIPNMKLEKWVVDRRFKVMSEVGIKFKVNTTIGEDITKEQLDADFDKVIVATGASVARDVDVPGRDLKGIDFALPFLSQTTKNVLKNGTTTFEKTLSNQQVIVIGSGDTATDCIATAIRLGAENVTQFDYHTEKPTDRTTPWPEYPWQKQISYGQAEAMDTVNQELIPYQTQTVEFLGNSFGEVTGVRTVLIDANKQVISNSEKDYSADLVLVAVGFTGLNTKILNDLDITRLNVMGTTNQENYMVAGDANTGANLVITAIHDARLVAELVDAKLQSFADRFSVKVN

SEQ ID NO: 15069 - protein, 214 aa, Candida glabrata CBS 138
MSGNSKRRIETDVMKLLMSDHEVELVEDSMQEFHVKFYGPKDTPYEGGVWRLHVELPDNYPYKSPSIGFVNKIFHPNIDIASGSICLDVINSTWSPLYDLLNIVEWMLPGLLKEPNGSDPLNNEAANLQLKDKKVYEEKVREYIDKYATKERYESQFGTPEDDEDDGDDAEMKDEDGDDDIDEPVSDLEDISDDNADPSEELSDISDIELSDED

SEQ ID NO: 15070 - protein, 398 aa, Triticum aestivum
MASSPPAIIGTEPTWVPYEPTRDCSQGLCSLYCPQWCYFIFPPPPPFDLAGPGPDDSSGHVFSPLVIAIIGVLATAFLLVSYYTFISKYCGTFGSLRRRLFGSGSGSRGGGGGGPGSGHGQSRSQESWNVSPASGLDEALINKITVCKYRRGDGPVLHTTDCSVCLGEFHDGESLRLLPKCSHAFHQQCIDTWLKSHSNCPLCRSNISFVAVEVAPPEPEGRAPGPGETDRSTHQVVVEMDELESMCEEQRDAVSSGGVRAGRDDQETERSREGAEEEEEEEAIGTAEIREEGAPPPKAGSNLHRDSRMSIADVLQSTMEDELIAARESGLLAGGAGTSRRCRGENSGNGRGRNRRALQDDSVPPMKRLPPGGRSCFSSKSGRAVVVDSDNPVRGGQS

SEQ ID NO: 15071 - protein, 187 aa, Pseudomonas fluorescens PfO-1
MPIINSQVKPFKATAFKNGDFVQVSDADLKGKWSVVFFYPADFTFVCPTELEDLADNYAAFQKLGVEIYSVSTDTHFAHAAWHNTSPAIGKIQYTMIGDPTQVISRNFDVLIEEAGLADRGTFVINPEGQIKIVELNDGGVGRDASELLRKIKAAQYVAAHPGEVCPAKWKEGEATLAPSLDLVGKI

SEQ ID NO: 15072 - protein, 347 aa, Nicotiana benthamiana
MSIFGAAAAANTNPNKSTEVQQPPSDSVSSLCFSPKANFLIATSWDNQVRCWEVMGSGTNVGTAPKASISHDQPVLCSAWKDDGTTVFSGGCDKQVKMWPLGGQAVTVGMHDAPVKDLAWIPEMSLLVTGSWDKTLRYWDLRQPNPAHVQQLPERCYALTVKHPLMVAAMADRNLVVFNLQNPQTEFKRITSPLKYQTRCLAAFPDQQGFLVGSIEGRVGVHHLDDSQQSKNFTFKCHREGNEIYSVNSLNFHPVHGTFATAGSDGAFNFWDKDSKQRLKAMSRCSQPIPCSAFNHDGSIYAYAVCYDWSKGAENHNPSTAKTYIYLHFPQESEVKGKPRIGTSGRK

SEQ ID NO: 15073 - protein, 448 aa, Vitis vinifera
MEDLWKSRARSLQLRLRDRFRIAVDRHRRLPMFSTDGYFSSTLQRWLRRVRDFRRDSLPSSSAFYRKRVGKDIGAEEDSVFVRMLQALAVPVIGNVCYVFMHGLNRVQVYGAEKLHEVLLHRPENKPLITVSNHVASMDDPLVIASLLPPSVLLDARSLRWTMCATDRCFKNPVTSAFFQCVKVLPVSRGEGIYQKGMDMAVSKLNSGGWVHIFPEGSRSRDGGKTMGSAKRGVGRLVLDADNTPIVVPFVHTGMQEVMPIGANFPRIGQAVTVLIGDPIHFDDLLNEEQTQHMSRGKLYDAVSSRVSRRLQELKVQVDKLALEHSIQLQNHDMQTTEWAAGILHQVDWESFGMGSYITSEDDSSSRLEIQSPMKLNRYFGMGFSYEGGIVSRIRGYMDPTELMGFAARGLFLNRRAEEKLASIQEIRPLKAWKQFLEANILPQWNAC

SEQ ID NO: 15074 - protein, 452 aa, Pseudomonas fluorescens PfO-1
MAYDFDLYVIGAGSGGVRAARFAAGFGAKVAVAESRYLGGTCVNVGCVPKKLLVYGAHFAEDFEQSSGFGWNLGEADFDWATLIANKDREINRLNGIYRNLLVNSGVTLHEAHAKIVGPHEVEVNGERYTAKNILIATGGWPQIPEIPGHEHAISSNQAFFLKELPKRVLVVGGGYIAVEFAGIFHGLGANTTLLYRGDLFLRGFDGSVRNHLKEELTKRGMDLQFNADIARIDKQSDGSLKATLKDGRVLEADCVFYATGRRPMLDNLGLENIDVQLDDKGFIKVDEQYQTTEPSILALGDVIGRVQLTPVALAEGMAVARRLFKPEQYRPVDYKMIPTAVFSLPNIGTVGLTEEEAREAGHDVVIYESRFRPMKLTLTDCQERTLMKLVVDGKSDKVLGCHMVGPDAGEIVQGLAIALKAGATKRDFDDTIGVHPTAAEEFVTMRTPVGA

SEQ ID NO: 15075 - protein, 168 aa, Nostoc sp. PCC 7120
MNKILVKLFSLIIIVMLAWFWVIMNPQTAFAQINTINYNNANLENRDFANADLVGVNFVAAEMRGTNFQGANLTNAILTKGVLLKANLSEANLTGALVDRATLDNANLKNAIFTEATLTRSRFYDADITGADFTDALIDRYQVSLLCERANGVNRVTGIATRDSLGCK

SEQ ID NO: 15076 - protein, 279 aa, Pseudomonas fluorescens PfO-1
MIKKCLFPAAGYGTRFLPATKAMPKEMLPVVNKPLIQYGVEEALDAGLNEISIVTGRGKRALEDHFDISYELENQIKGTDKEKYLVGIRKLLDECSFSYTRQTEMKGLGHAILTGRPLIGDEPFAVVLADDLCVNLEGDGVLTQMVKLYKQFRCSIIAIQEVDPQETSKYGVIAGEMIRDDIYRVHSMVEKPKPEDAPSNLAIIGRYILTPDIFDLIEQTEPGKGGEIQITDALMKQAQNGCVMAYKFKGKRFDCGGAEGYIEATNFCFENFYKTGKAY

SEQ ID NO: 15077 - protein, 463 aa, Vitis vinifera
  misc_feature (40)..(40): Xaa can be any naturally occurring amino acid
MSCSSSSASEEEDEGTDSYRKGGYHAVRVGDPFSGGRYIXQRKLGWGEFSTVWLAYDTRSSKYVALKIQKSAVQFAQAALHEIEVLSAIANGDPSNSKCVCVVRLIDHFKHTGPNGQHVCMVLEFLGDSILRLIKYNRYKGLEFNKVREICKCILTGLDYMHRELGIIHTDLKPENILLFSTIDPAKDPIRSGLTPILERPEGNPTGGVTINSIEKKLKARARRAVAKISGKRASMGGETPKAERSLDGIDVRCKIVDFGNACWADRQFTGEIQTRQYRAPEVVLQAGYSTSVDMWSFACTAFELATGDMLFAPKNGQGYSEDEDHLALMMELLGKIPRKVAIGGARSKDLFDRHGDLKRIRRLKFWPLDRILVDRYKFSESDAREFADFLVPLLDFAPEKRPTAQQCLQHPWLNLTNLAANETKSKSNMEKLDVGMSKLQIEAPALTAPEPGPLLSPSPPPA

SEQ ID NO: 15078 - protein, 539 aa, Arachis hypogaea
SRLFGGFIADVVAAIDQAVYDGVDILSLSVGPNSPPAATKTTFLNPFDATLLGAVKAGVFVAQAAGNGGPFPKTMVSYSPWIASVAAAIDDRRYKNHLTLGNGKVLAGIGLSPATHLNESYTLVAANDVLLDSSVMKFSPTDCQRPELLNKRLIEGKILLCGYSFNFISGSASIKKVSETAKALGAVGFVLCVENVSPETRFDPVPVGLPGIVIVDVRNSKELVDYYNISTPRDWTGRVKSFTGKGKIGDGLMPILHKSAPQVALFSARGPNIKDFSFQEADLLKPDILAPGSLIWAAWSPNGTDEPNYVGEGFAMISGTSMSAPHIAGIAALIKQKHPHWSPAAIKSALMTTTSTLDRAGNPLLAQQASETGTTKLVKATPFDYGSGHVDPRAALDPGLIFDAGYEDYLGFLCTTPGIDVHEIRNYTHTPCNKTMGKPSNLNTPSITISHLVRTQTVTRTVTNVAEEETYMITARMDPAVAIDVNPPAMTVRAGASRKFSVTLTVRRVTGTYSFGEVLMKGSRGHKVRIPVLANGYPR

SEQ ID NO: 15079 - protein, 358 aa, Nostoc sp. PCC 7120
MYDNMSSPLFPVILAGGKGERFWPLSRQDRPKQFLSLDGSSRSLLQSTAERLVKFAGEWNDLWVITSSQLGQGVQQQLPELPSQNLLTEPQGRDTAAAVAWASLEIQKRYGDDAIIGFFPSDHWIADPEAFKRTLDAASQLATSTEAIVTLGIKPTFPSTGYGYIEQGEKIGTFNELPAYHVNRFTEKPIREKAESFLSTGRYSWNSGMFVFRAGVVLKELYTYAPEIIEPLVKHGVDVYPQLPKQSIDYALMEKTNLVYVLPADFGWDDLGDWNAIERLLKKPDNPNVELATHVGLDTQGAIVYATNPEDVIVTIGLEDVVIVRDRNVTLIVNKERTQEIKQILKTLQSDPRFTDLL

SEQ ID NO: 15080 - protein, 93 aa, Arabidopsis thaliana
GPWAPSRLSSVPRVAFPVKAIMAAPLNGLKSSVAFPATRRVTTDITSITGNGGGVNCMQVGPPMGRKKLGTFFYLPDLTDSEWVKEVASLIRT

SEQ ID NO: 15081 - protein, 331 aa, Parvularcula bermudensis HTCC2503
MTGPAEPRGHPTPAAQTNRLSSFGHIDWQQTLDDICTDILPHLGKGQVADYIPALASANPKAFGIAFSTIEGTTYTAGDWNTAFSIQSISKVFMLSVALAEEGEKLWRRVGREPSGSSFNSIVQLEREHGRPRNPFINAGALVVTDTVISHCGDEAGIDRLLAFLRESSGDQAIVVDEKIARSEAAYGDRNRALAYFMKSFGILREDVPITLETYFRQCAIEMSVANLSKAGLYLAAEGLCPISNRAVANDAHTNRVNAIMMLCGHYDRSGDFAYRVGLAGKSGVGGGIIAIIPGVGCVAVWSPPLNDAGNSYAGTLALEWFSHRTGVNLF

SEQ ID NO: 15082 - protein, 426 aa, Mycobacterium sp. JLS
MLAPFPLRTGGAMSTGSGHIRLTSHSGAVGTPTIHWGAPTAAERGPVIGTTANRSHRNVIGTHSGSYSVYRALAVAAGALKREHRADLTDTSPTDTIGPYPQWGEPATIVSMDPWGASVADVFTAELAAGLDIRPTIAITKAHVILPEITDAIAKGRLVPDGRVLLASGAALVTKAAVEPVWWLPGVAQRFGCSETDLRRVLFEETGGMYPELVTRSDLEVFLPPIGGQTVYIFGSATDLADPSVELTARVHDECNGSDVFGSDICTCRPYLTHAIEECIRGAQNGGVGLVAYSRKEGRALGEVTKFLVYNARKRQVGGDTADQYFARTECVAGVQDMRFQELMPDVLHWFGIRKIHRLVSMSNMKYDAITGSGIEVGERVNIPEELIPPDARVEIDAKMAAGYFTPGPVPDAEELKQVKGRGLSQ

SEQ ID NO: 15083 - protein, 548 aa, Vibrio sp. Ex25
MIRNQPLSGLCKYEYVSGLTHCKENLKTNMFEFPQFSKHSVKNDVLSGLTVALALVPEAVAFAFVAGVDPMVGLYAAFIVGLITSIFGGRPGMISGATGAMAVVMVSLVATHGVQYLFAAIMLAGILQIAAGMFKLGKFIRIVPHPVMIGFVNGLAIVIFLAQLGQFKAPDINGMLTWLPQDQMLLMLGLVALTMAIIHFLPKITTAVPSSLVAIVTVTALVVGLDLETRTVVDFLRTMSGDEAATLAGSLPTFSIPAVPFTLETLQIILPYAIILAAIGLIESLLTLTVLDEMTNTRGQSNRECIGQGMANMTCSVFGAMGGCAMIGQSMINVNSGGRGRLSGIVAAIALLMFILFASSLIEMIPLAALVGVMFMVVIGTFEWATFKLARRVPKQDFFVIVLVTVVTVLTDLAVAVAVGVIVSALMFAWQHAKHIYADTCLNEEGSKEYKIHGPIFFGSAANFLELFNAPEDPKDVIVDFADSRVTDHSAIEAIETLAERYNSQGKTLHLRHLSPDCRKLLDKAGSLVEINVKEDPSYKVATDILAG

SEQ ID NO: 15084 - protein, 816 aa, Haemophilus somnus 129PT
MRVLKFGGTSLANPQRFLQAAALIEKAHLEEQAAGVLSAPAKITNHLVALSEKAALNQPTDGHFDEALEIFYNIINGLYAENTHFDLVGTKALIESEFAQIKGLLENIRQAGKVDDAVKATIDCRGEKLSIAMMNAWFEAKGYTVTVINPVEKLLAYGSYLESSVDIAESTKRVDAKSIPAKNIVLMAGFTAGNDKGELVLLGRNGSDYSAACLAACLGASVCEIWTDVDGVYTCDPRLVPDARLLSSLSYREAMELSYFGAKVIHPRTIGPLVEPQIPCLIKNTGNPEGAGSIIDNRENISEGLQVKGITNLDNVAMFNVSGPGMQGMVGMAARVFSAMSKASVSVILITQSSSEYSISFCVPTKAIEKAKAALNAEFEQELVAKDLDPVEVIHDLSIISVVGDGMAQSKGIAASFFSALASANISIVAIAQGSSERSISAVVPLNKAIEAVKATHQALFNNRKVVDMFLVGVGGVGGELIEQIKRQSEYLAKKDIEIRVCALANSNKMLLNENGLNLDNWREDLANATQPSDFDVLLSFIKLHHVVNPVFVDCTTAESVAGLYERALKEGFHVITPNKKANTRELDYYNQVRENARKNHRKFLYDTNVGAGLPVIDNLQNLLAAGDDVVSFNGILSGSLSFIFGKLEEGLSLSEATALAREKGFTEPDPRDDLSGQDVARKLLILAREIGLELELSDIEVEGVLPQGFSEGKSADEFMAMLPSLDEEFAERVAKAKSEGKVLRYVGQIEEGKCKVSIVAVDGDAPLYKVKNGENALAFYTRYYQPIPLLLRGYGAGNAVTAAGIFADILRTLKH

SEQ ID NO: 15085 - protein, 314 aa, Magnetospirillum magnetotacticum MS-1
MRALVWHGTQDIRCDTVPDPQIEDDRDAIIRVTACAICGSDLHLYDHFIPAMKKGDIMGHEFMGEVVETGRGVNGALKKGERVVIPFTIICGECDQCKRGFFSVCERSNRNRSMAAKVFGHGTAGLFGYSHLTGGYPGGQAEYVRVPFADRTHIKVPDSLTDEQVLFLGDIFPTGWQAAVQADIQPHDTVAVWGAGPVGQMAVRSAILLGARQVICIDSVPERLDMARAGGAITIDNSVESPVERLNELTGGKGPEKCIDAVGMEAHSPRALEQVYDRVKQAMMLESDRASVLREMIYVCAPPASSRFPASMAA

SEQ ID NO: 15086 - protein, 231 aa, Haemophilus somnus 129PT
MMQIKNNLAKINRQISQYCEQAKRNSSTVSLLAVSKTKPVEDILIAYQAGQTAFGENYVQEGVEKIQYFIEQHIQLEWHFIGPLQSNKTKLVAENFDWMQTLDREKIATRLNEQRPHYKQPLNVLIQINISAENSKSGIQPQEMLSLAKHIQNLPHLRLRGLMAIPEPTDNITAQEQAFNQMKYLFTQLQLAFPDEKIDTLSMGMSDDMASAIKCGSTMVRIGTAIFGKRN

SEQ ID NO: 15087 - protein, 282 aa, Brassica napus
MAERGGERGAERGGDRGGFGRGFGGRAGGRGGPRGRGGRRGGRPTEEEKWTPVTKLGRLVQSGKIQKLEQIYLHSLPVKEYQIIDLLVGPTLKDEVMKIMPVQKQTRAGQRTRFKAFVVVGDTNGHVGLGVKCSKEVATAIRGGIILAKLSVIPVRRGYWGNKIGKPHTVPCKVTGKCGSVTVRMVPAPRGAGIVAARVPKKVLQFAGIDDVFTSSRGSTKTLGNFVKATFDCLQKTYGFLTPEFWKETSFKKSPYQEYTDLLAEKGTATSKAITEAEDQAS

SEQ ID NO: 15088 - protein, 667 aa, Haloarcula marismortui ATCC 43049
MIYMRGRPRSSVHCLFVGAGSIAAEYAAELADSPLSLAGVCDLEEDRATALAAAHDCPAFTDLDTALSAVDAPLVVNLTNHAAHAPVTRTALEAGRHVYSQKPLALDEAAAAELLALAQDRNLALGCAPGTPDAPSQRRAGQMLADGRMGPVQLGYAHAHVGRVTDWHDRPGSFLSIGPLYDGGVYPLALLVSWFGPVKSVQTATTLDSWPEREPERPSAPSHVEAMLSFDGGLTVRLTASFYAPHRSREFYGLELHGDDGSLYLRGTGAMADSTTAVQYGRIGREYIDAPAQHPTQPYRYLDPVESLAASVTRGTPSRMTGRRGAHIVAVCNAIETAAETGESETVSDYGTAADSTPPPTVTPDRDWDGSREQAIRLPAIGFGCSRYRDGTYIDRADSIAAALDAGYRLLDSAELYGNEHRIGRILAAPGAPDRRRVFILGKVWRTNHRRKHMLTACRSSLDELGIDAFDCYALHWPEALAHRGSLTRLAEKSVARQEALTFPKNDRGDIETDSVSLQRAWENLEALHERGWTRTLGLCNVSQTQLETVIETGTVRPALVQVERHPYQPQTDLIEYCHERGIRVVAHSPLSAPGLLDEPVLAAIAEEYGLSPAGVVLAWNVTQGVVPIPSSTTPSHIVENLAAAGQRLDAEACARIEALRQPDFER

SEQ ID NO: 15089 - protein, 397 aa, Leuconostoc mesenteroides subsp. mesenteroides ATCC 8293
MTSTTEKVKTAVKELKKGKLIILSDDKKREHEGDLVGLASFVTAATVNEALSIARGVLAVPITKSRADELGLDQMTTHNSEKFGTKFTVSVDHIDSTTGVSAYERAATIKNLANLSTTSVDFETPGHIFPLVAEDGGVLTRQGHTEGAVELAKIAGVPPVAYIIEILAQDGKMAREKELKELAKKHDIFQLSMQDLINYREDQKQAGIDEGPTVYLPTQYGDFHLTEFSVNDEEKSDLLIQSSRSFDQIPLVRLHSECLTGEIFGSQRCECGPQLREALKTINKQGGALVYLRQEGRGIGLHEKLKSYVLQENKFDTYDANVHLGHLPDERDYKKAAKILKISGLTKIRLLTNNPDKVQSLIDEGIEVIEQVPLITGINDKNEQYMQTKKEKFNHKL

SEQ ID NO: 15090 - protein, 156 aa, Leuconostoc mesenteroides subsp. mesenteroides ATCC 8293
MIYKAKLIDQTNKKIAIVASKFNDLIVKQLISGAQESLEMHGIDESNIDIIWVPGALEIPMVAKRIAQVQKYDGIVTLGAVIKGDTDHYDLVINGVANGISQISLSTDVPIVFGVLTTDTLEQAQQRSGAKSGNKGAEVALSLLELINIFEQIKSI

SEQ ID NO: 15091 - protein, 318 aa, Listeria monocytogenes str. 1/2a F6854
MNKISNRQVMCEVLMKEATRNDSNLVVLTSDSRGSASLGAFAEKFPERLIETGIAEQNIVGIAAGLAHSGKRAFVASPACFLSMRSIEQVKVDVAYSDTNVKLIGISGGVSYGALGMSHHSLQDIAVTRAIPNLEVILPADRLETEAIFDYLLQSNRPAYVRLGRNAVEDCYAEKPVFQIGKAGTLREGNDVSILATGEMVRVALDASEELKLKGISARVLNFSTIKPFDQEVVKAALTETKLLISIEEHSIYGGLGAAVSEVVSSSPTSIRHLILGIPDEPAIAGTSQEIFDYYGLSATGIVATIMKNLPIIGDERR

SEQ ID NO: 15092 - protein, 312 aa, Mycobacterium avium 104
MARLTVIATGGTISTGTGADGVHRPCYRGADLTAPFRADHDVEVVDLLAVDSSELTLADWDRMRGAVTAALDGGADGVVILHGTDTMEETALWLDLTYDGPAPVVLTGAMRSADAPDADGPGNVRDALAVAAHPAARGLGVLLCFAGRVLQPLGLSKVATEDLSGFAGRLVGTVAGDVALTGPKTRPYLGDLGAAAAPRVDIVAAYLGSDAVALDACVAAGARAVVLEALGSGNAGPAVVDAVRRHCGTGVVIAVSTRVPGGRVGASYGPGHEMAAAGAVPVPTLRPPQARVLLIAALAAGLPAADVLGRWG

SEQ ID NO: 15093 - protein, 189 aa, Pyrococcus furiosus DSM 3638
MIRVGEVVPDFEADAYFPEKDEIGKLRISDYRGKWVVLAFYPADFTFVCPTELEELAEYYEEFKKEGAEIISVSTDTAYVHKAWHDTSPAIKKVRFPMLADPAGKICRLFGTYIEDEGISWRATFIIDPDGKVVHMEMHDNSIGRSAKEILRRLRAAKFVRENPGVVCPASWEPGKEALKVSLDLVGKI

SEQ ID NO: 15094 - protein, 154 aa, Photorhabdus luminescens subsp. laumondii TTO1
MASRGVNKVILIGRLGQEPEVRYRPEGDTVAVLSLATSETWRDRQTGEQKERTEWHRVVIFGKLAEIAGEYLKKGSQVYIEGQLRTRKWFDKASGQDRYSTEVVLNQQGTMQMLGGRSQSEPSRSSGREQSQSSSSVPPRGSEPPIDFDELIPF

SEQ ID NO: 15095 - protein, 493 aa, Zea mays
  misc_feature (462)..(462): Xaa can be any naturally occurring amino acid
MADTATVPLLTSHKADPAKVPPTSIDDMIEKYIGDTGGAVQLLKAVFVAFAWAFDAQQVFISVFTDAEPQWHCVDVAGGNNSSCTPAAASPCALPPGTWAWDRPAKTSVVSEWALQCAGPALASLPASSFFAGCLVGGFVLTTLADSVLGRKKTLLLSLVSMSVAGLLTALAPNVWAYAALRFVSGFARSTVGTCTLVLSTELVGKRWRHTVSVAAFFCYTIGFLSLPLLAYALREDSWRSMYFWMVVPCLFYAALIHLLAQESPRWLLVRGHKRDAIESLRQIATLDDSGGHTTTNLSMLELELEACVSMHNEDGASSSGSGVFATLQVMWERPWAIRRLAAIMVAGFGVGMVYFGMPLTVGSLGSNLYLSTAYNALAEVPSSILSWLLIARANRRTSVVVLAASAGVLSLACAAMPQRAEAARMAGELLSFFATCTAYDVILVYSIELFPTSVRNSAVGXLVRQAMVLGGMAAPVLVALGRERSIWSFGVF

SEQ ID NO: 15096 - protein, 1017 aa, Coprinopsis cinerea okayama7#130
MKEVQAAPEGKREKSSEESSGLASATIAAGMEIEDDKERAVAKAALTISEISTLLDGPSGQSEASDASSGISLRSITAVAAFEGFIEDARSQINDEMEQMVISGLKNLNPTLLASSLQTAFNLGVLPQLVSNLLIDLSSAVEDRIKAAFDLSKISKDAVAKEPSTSPLSQSPAIYKSRVRTEPTNVTAPQWSSALWTRLEGMFDEMAECCIKVYSLEKVLKIKKDPTTQVNFLEDVVKVLENKPSAIFWMSLSRSLDKHFKDCTKASAFLQQALVTGYPKLLRLFHQFFSRIAVHTDTVYTDSHQSPETVLVLRSLANLDAQYLTRSANKVNEAVTQAFAGGVRAPPTINDAANVARNVTNELDSAKFDPLLVKAVAKNASACLDSMLSKVEGMIIKDRPAVSLLGPSATPQHILNAQLATFLYQVAQRLEKLEGEHADGVYKLIQPSIKKTKSLYQETVEPMQNSIQREISAILAKVHRIDFGQTGIMPGGASLCMRELTDKLAFIKSEILDEVTSIAKFTIRNFLLHISIAKPLSESGKLQMTSDMAELEFALNSFMAEKGQKRGDENLQTIDEYRALRAMRPMLFLENKQLTKPESTLCLPPIVVLHHILVRSPIPLPHKLHGWQESEYVRWLDEHTEEESWTLIDGGLSHWEKISETEGKDTSEATEIASLTTVQGFVQTSSTMALSSIYRNGARSLGLQRSSAARLFSSSAVARKPDNTKPPRPIDDSTSALEYKKFQRHRPPPLPSVEIPSRSAEEAVTNILYNTPPPNQQPFKKHILNCLVQNEPGVLSRVSGILAGRGFNIDSLVVCRTEIRDLSRMCIVLSGQDAVIEQARRQLEDLVPVWAVLDYTDNSLVSRELLLAKVSILGPEYLDQQYAGGPFHEPQAADPKLERETQIAQNFERGAQGELEPALTPSQALRLKHQHLHSINVLATQFGAKIVDVSEHSVIVEYTAKTSRVEAFLNLLKPFGILEAARTGTMAMPRTPIRSDEDDGPAEDEGGAVDASLLPPG

SEQ ID NO: 15097 - protein, 273 aa, Vitis vinifera
  misc_feature (265)..(265): Xaa can be any naturally occurring amino acid
MFSATSLLHSHATSFGFKEVQEEEKSQMVGNVFTSVASSYDLMNDLMSAGLHRLWKDRLVSKLHPFPGMKHLDVAGGTGDVAFKILETINKMKLRTMHNVPEDELQEETQIYICDINPRMLDVGKKRAMEQGLGKDPTLLWLEGDAEALSFDDDSMDGYTIAFGIRNVTHIEKVLSEAYRVLKRGGRFLCLELSHVEIPVFKELYDYYSFSVIPAMGELVAGDRASYQYLVESIRRFPPQEKFASMIANAGFQKVEYENLVGGVXAIHSGLKF

SEQ ID NO: 15098 - protein, 469 aa, Thermococcus sp. Rt3
MSAKKLLALLFVLAVLVGVAVIPARVGIAPVSAGATSRPSLEEGGVIMQAFYWDVPAGGIWWDTIRSKIPDWASAGISAIWIPPASKGMSGAYSMGYDPYDFFDLGEYYQKGTVETRFGSKQELINMINTAHSYGIKVIADIVINHRAGGDLEWNPFTNSYTWTDFSKVASGKYTANYLDFHPNEVKCCDEGTFGGFPDIAHEKSWDQYWLWASQKSYAAYLRSIGIDAWRFDYVKGYGAWVVKDWLKWWALAVGEYWDTNVDALLNWAYSSGAKVFDFPLYYKMDEAFDNKNIPALVSALQNGQTVVSRDPFKAVTFVANHDTDIIWNKYPAYAFILTYEGQPVIFYRDYEEWLNKDRLKNLIWIHNNLAGGSTSIVYYDNDELIFVRNGYGNKPGLITYINLGSSKVGRWVYVPKFAGSCIHEYTGNLGGWVDKYVGSNGWVYLEAPAHDPAKGQYGYSVWSYCGVG

SEQ ID NO: 15099 - protein, 481 aa, Mycobacterium sp. JLS
MTNLSLDGRFARELPEMAVRWKAEEAPDPRLLVLNDELASGLGLDADWLRSPDGVRLLVGNSVPDGATPVAQAYAGHQFGGFAPRLGDGRALLLGELVDGDGRMRDVHLKGSGHTPFARAGDGLAAVGPMLREYLVSEAMHALGIPTTRSLAVVATGRPVRRESVLDGAVLTRVASSHLRVGSFQYAAVTGDTDLVRRLAEHAIARHHPEVAGAADPYLGLFEAVCSAQAQLIARWMLVGFVHGVMNTDNMTISGETIDYGPCAFMDAYDPETVFSSIDSWGRYAYGNQPSIAAWNLARFAETLLPLFDDDIDRAITLAQNALGAFGRHYEGALTAGMQAKLGLTGVDGPAVAPLLDELLKLLQDNHIDFTSFFRALGLAARGDNEPVRGLFVDLAGFDAWLDSWRALGRDGAAMDRVNPVYTPRNHLVEEALTAAAAGDMEPFETLLDAVTGPFVERPGLQRYAEPAPEAFGRYRTFCGT

SEQ ID NO: 15100 - protein, 178 aa, Debaryomyces hansenii CBS767
MLFNNSGESFNIGEFLESTSPYMWANLGIASCIGFSVVGAAWGIFITGSSIIGAGVKAPRITTKNLISIIFCEVVAIYGLIMAIVFSSKLTNVPQTELFTKENLYTGYSLFWAGLTVGISNLICGLAVGVTGSTAAISDAADSSLFVKILVIEIFGSVLGLFGLIVGLLMAGKALEFQ

SEQ ID NO: 15101 - protein, 183 aa, Oryza sativa Japonica Group
MSSPSKRREMDLMKLMMSDYKVEMVNDGMQEFFVEFRGPTESIYQGGVWKVRVELPDAYPYKSPSIGFVNKIYHPNVDEMSGSVCLDVINQTWSPMFDLVNVFEVFLPQLLLYPNPSDPLNGEAAALMMRDRPAYEQKVKEYCEKYAKPEDAGVTPEDKSSDEELSEDEDDSGDDAILGNPDP

SEQ ID NO: 15102 - protein, 244 aa, Brassica napus
  misc_feature (217)..(217): Xaa can be any naturally occurring amino acid
  misc_feature (227)..(228): Xaa can be any naturally occurring amino acid
  misc_feature (236)..(236): Xaa can be any naturally occurring amino acid
MAAAACGQLNLEEPTPIRGSRSVDCFEKLEQIGEGTYGQVYMAKDIKTGEIVALKKIRMDNEREGFPITAIREIKILKKLHHENVIHLKEIVTSPGRDRDDQGKPDNNKYKGGIYMVFEYMDHDLTGLADRPGLRFTVPQIKCYMKQLLTGLHYCHVNQVLHRDIKGSNLLIDNEGNLKLADFGLARSYSHDHSGNLTNRVITLWYRPPELLSGATXYGPAIDMWSXXCIFAELLXGKPICLAN

SEQ ID NO: 15103 - protein, 80 aa, Oryza sativa
  misc_feature (34)..(34): Xaa can be any naturally occurring amino acid
MSEEAGRPLPKFGEWDVNDPASADGFTVIFNKAXDEKKGGNGQDTDSPCKETRTERVESYAPKTNSKKWFCCVTSSPTQS

SEQ ID NO: 15104 - protein, 130 aa, Physcomitrella patens subsp. patens
MQAVRSSLWAVHGSVLQHMRVRAVVAPSTTGLWGNGNARTMSGEAHGTYLDRRDVIDRVLAVVKSNQKVDASKVSETASFKDMGLDSLDEVEVVMALEEEFALEIPDAEADKIRSASDAIDFIASHPSAK

SEQ ID NO: 15105 - protein, 139 aa, Oryza sativa Japonica Group
MASEGAVSPAFAYTVVYVKDVAKSAAFYSAAFGYTVRRLDQSHKWAELESGTTTIAFTPLHQRETDALTGAVQLPDSAGERGPVEICFDYADVDAAYRRAVDSGAVPVSPPEQKSWGQKVGYVRDIDGIIVRMGSHVRA

SEQ ID NO: 15106 - protein, 439 aa, Magnetospirillum magnetotacticum MS-1
MRITMIGAGYVGLVSGACLADFGHEVVCIDKDPAKIAALHAGRMPIYEPGLDALVAENVRQKRLTFSTDLKPAVADAQAVFIAVGTPSRRGDGFADLSYVYAAAKEIAEALTGYTVVVTKSTVPVGTGDEVERILREARPDIDVGVASNPEFLREGAAIGDFKRPDRIVIGAEDARTAAVMQEVYRPLYLNQAPILLTGRRTAELTKYAANAFLATKITFINEIADLCEQVGANVQEVARGIGLDNRIGAKFLHAGPGYGGSCFPKDTLALVKTAQDYGTPVRIVETVVAVNDSRKRAMARKVMGACGGSVRGKRVALLGLTFKPNTDDMRDAPSLSIIAGLQDAGARVVAYDPEGMEQARPLLDGVEYAADAYACAEAADALVIVTEWNAFRALDLARLRSLMKAPVLIDLRNVYSPDDARRQGLRYIGVGALARFDD

SEQ ID NO: 15107 - protein, 285 aa, Kokia drynarioides
DSAVADGIDVISLSVGGAVVPYYLDAIAIGAYGAAGKGIFVSASAGNGGPAGLTVTNVAPWVATVGAGTIDRDFPADVKLGNGKVVTGAGVYNGRGLSPGRMYPLVYAGSGGGDGYSSSLCLEGSLDPDFVKGKIVLCDRGINSRAAKGEVVKKAGGVGMILANGVFDGEGLVVDCHVLPATAVGASNADEIRQYTDSATKSKSSATATILFKGTRLGVRPAPVVASFSARGPNPETPEILKPDMIAPGLNILAAWPDKVGPAGIPSDNRRTEFNILSGTSMACP

SEQ ID NO: 15108 - protein, 520 aa, Brassica napus
MATMAAIGSLKVPSSSSNHTRRLSSSSQRKTLSFSSSSLTGEKLNPTQEIIISNLPRGNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 15109 - protein, 107 aa, Zea mays
NSLCWGRVQVVGPDGVRVLETRVEGGFLFIVPRFHVVSKIADASGMEWFSIITTPNPIFSHLAGKTSVWKAISAEVLQASFNTTPEMEKLFRSKRLDSEIFFAPPSN

SEQ ID NO: 15110 - protein, 445 aa, Leuconostoc mesenteroides subsp. mesenteroides ATCC 8293
MIEAFEKSQEPWADVEKYVGRYAGMDFSPDIVDHAKGTYLFTESGEKILDFTSGQMSSTLGHSNPEIVTTLQQTVQRLDHLYSGMLSRPNINLSKNIASKTGENLKKVIPLSTGSEVNEAALRMAKLVTGKFEVVSFNKSWHGVTQASAGATYASARKSGAPTSPGQLSIPTPYTYRPNFFNSEGEYDWHKELDYGFEMVDAQSVGSLAACIVEPIVSGGGILVPPKGYLAALKEKCRERGMLLIFDEAQTSLGRTGEWFAYQYDDVEPDILTLSKTLGSGLPLAALVTTDKIEKKAHEKGFLFYTSHVNDPLVAAVGCTVMNIIERDNLCQVTKEKGNYLHDGLQKLVDEYDIVGDARGRGLLQGLEIIKSKSNKERSEFIGDEITKRCYKLGLHMNIVNLPGMGGVFRIAPPLTVSYEELDSGLAILEQSIKSVQNDINLGNL

SEQ ID NO: 15111 - protein, 567 aa, Triticum aestivum
MASPALISDTDQWKALQAHVGAIHKTHLRDLMTDADRCKAMTAEFEGVFLDYSRQQATTETVDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAESAKGRQLRFLANVDPVDVARSIKDLDPATTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLHSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 15112 - protein, 287 aa, Wolbachia endosymbiont of Drosophila ananassae
MGAVRADQGQLEQVILNLAVNASAAMEKGGELTIRTFNQKIDSLNSTPQDMFSPDKEAIEHGNYVVIEVIDTGCGMTSDTTEKIFDPFFSTKDITSGTGLGLSTVYGIIKQTEGYIYVASKVNHGTKFSIFLPMVYISDENDREEDSEETERPVVSEIKGNGIILLIEDEDSVREFISKALKRKGFDVIEASIGSEALEIISKKSQHIDLIITDVIMPEVSGPEIVKEALIHRPNINVIFISGYAEDAFLKSDDINIEDFHFLPKPFTLNELGNKVQSVLHKAKKTV

SEQ ID NO: 15113 - protein, 405 aa, Daucus carota
MSSVFANVVRAPEDPILGVTVAYHKDQSPNKLNLGVGAYRTEEGKPLVLNVVKKAEQMLVNDQSRVKEYLPIVGLADFNKLSAKLIFGADSPAIQENRVATVQCLSGTGSLRVGGEFLARHYHEHTVYIPQPTWGNHPKIFTLAGLSVKTYRYYNPETRGLDFEGMLEDLGSAPLGAIVLLHACAHNPTGVDPTIEQWEQIRQLMRSKSLLPFFDSAYQGFASGSLDADAQSVRIFVADGGECLAAQSYAKNMGLYGERVGALSIVCKTADVASKVESQLKLVIRPMYSSPPLHGASIVAAILKDGDLYNEWTLELKAMADRIISMRQELFNALQAKGTPGDWSHIVKQIGMFTFTGLNSEQVTFMTNEYHIYLTSDGRISMAGLSSRTVPHLADAIHAAVTGKA

SEQ ID NO: 15114 - protein, 284 aa, Debaryomyces hansenii CBS767
MIRKQARERREYLYRKSLELQESSLTEKRQQLKAALASGKPLSKELAEDKELQKDFIYDESEQTEIDDEYLALSGISEPKVLITTSRNPSVKLLQFSKEIKLMFPNSIKLNRGNYVITDLVATCQRVQISDLIILHEHRGIPTSLTISHFPHGPSIIFTLHNVKLRHDLPEIGNSSESYPHLVFENFTSELGKRVVKIMKHLFPPGVKKDSSRVITFINNDDFISVRHHMYVKTKDTVELSEVGPRFEMRLYELRLGLLDNKDSEVEWQLRRFIRTGNRKNYLG

SEQ ID NO: 15115 - protein, 202 aa, Frankia sp. CcI3
MPGQQRRGGGSGGSDRRERRDRSGSGPAQEKNAYVERVVAINRVAKVVKGGRRFSFTALVVVGDADGTVGVGYGKAKEVPAAIAKGVEEAKKHFFKVPRIGSTIPHPVQGEEAAGVVLLKPASPGTGVIAGGPVRAVLECAGVHDVLSKSLGSSNPINIVHATVAALRGLMRPEEIAARRGLPLEDVAPPAMLRARAAGASV

SEQ ID NO: 15116 - protein, 199 aa, Oryza sativa
MGEEANCNVAMESAAPKENGHTTDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESRE

SEQ ID NO: 15117 - protein, 278 aa, Frankia sp. CcI3
MARREHVQIKTAAEIAKMRVAGLLVAKTLARLREAVVPGVTTAELDALAEKTIRDDGGIPSFKGYAQPPYPASICSSVNNEVVHAIPTRKRVLREGDIISIDCGAIVDGWHGDAAITVPVGEVAPEVLAMIDTCEGALWAGLAAAQLGGKLTDISAAVERHVRPHGYGIVDHYGGHGIGSEMHQPPHVLNHGRPGRGIRLIEGLALAIEPMITMGSPDTAVLPDDWTVVTRDGSLAAHTEHSVAITPRGPWVLTAPDGGAAKLAELGVVCGQPADAPS

SEQ ID NO: 15118 - protein, 598 aa, Aspergillus oryzae
MHSSLTFLTLALCLFAWANGSNHHVRTTGNTVRFNLTLTWEEWAPAGIPRKMILGNGQLPSPLLELRQGDDVEFLVINNLPTNTSVHFHGIEQHGTPWSDGTPGFSQEPIAPGDHFLYKWRATQYGSYFYHAHNRGQIDDGLYGAIYIHPDESVEKPFGLITNKSSERQAMRAAEEKTQPIMISDWRQLTSEEIWQAEEKSGLDAYCVNAILINGKGSISCPGQEKVNQLASAEQRQILGNLSLTDIGCTSPLVVAMQGTFRHNYSAVPPSMFSGCVPGNGGTARVLVDPSHRYVSYDLISAAGVSMTTFSIDEHQMYVYAIDGRYIHPTLVDAITIANGNRYSVLVRLDKPAGDYTIRVANAGVNQVLYTAGVLSYNTLEKTQQHASVASINIHGAVVSSNYTLLDETKIIPFPVEVPSQEVAQTHILRISHYDASYTWTLGNTTLPLVLEEVSPLLFYPSTAKPDLTLKTLNGTWIDLIFDIHGQIQPPHPIHKHANKFYVIGQGTGAWNYSSVAEAMQHIPESFNLEAPQIRDTYITPPSATEDTWLAIRHHVVNPGAWLLHCHIQVHLSGGMAIGILDGVDEWPEIPEEYSIQV

SEQ ID NO: 15119 - protein, 243 aa, Brassica napus
  misc_feature (233)..(233): Xaa can be any naturally occurring amino acid
TPACSDSRRAIMSLFSFSLGLTILVIIISGLVFTFTRWNSKTKKRLNLPPGPPGWPVVGNLFQFARSGKQFFEYAEELKKTYGPIFTVRMGTRTMIILSDAALVHEALIQRGSLFATRPAENPTRTIFSCDKFTVNAAKYGPVWRSLRRNMVQNMLSSTRLREFGSVRRSAMDKLIERIKSEGKEHDGLIWVLRNARFAAFCILLEMCFGIAMDEESIEKMDEMMKTVLMTVXPRIDDYLPIL

SEQ ID NO: 15120 - protein, 454 aa, Lupinus angustifolius
SSLLSIPSLSLQYNDKLKVGGNSLRFSKEQSNTFSNAKSSCRISMVAAVNVSRFEGIPMAPPDPILGVSEAFRADTSDAKLNLGVGAYRTEELQPYVLKVVNKAENLMLERGQNKEYLAIEGLAAFNKATAELLLGADNPAIKQQRVATVQGLSGTGSLRLGAALIERYFPGAKVLISAPTWGNHKNIFNDARVPWSEYRYYDPKTVGLDFEGMIEDIKAAPEGTFVLLHGCAHNPTGIDPTPEQWEKIADVIQEKNHIPFFDVAYQGFASGSLDEDAASVRLFVARGLEVLVAQSYSKNLGLYAERIGAINVISSSPESAARVKSQLKRIARPMYSNPPVHGARIVADIVGNPALFDEWKVEMEMMAGRIKNVRQQLYDSISSKDKSGKDWSFILKQIGMFSYTGLNKNQSDNMTNKWHVYMTKDGRISLAGLSLAKCEYLADAIIDSFHYVS

SEQ ID NO: 15121 - protein, 353 aa, Microcystis aeruginosa PCC 7806
MNQSLVPVILAGGKGERFWPLSRLARPKQFLCLDGSGRSLLQATADRLLSLGAGWENLWVITASAIADGVREQLPNLPESNLLVEPVGKDTAPAVTWATLEVIKRYGKEVAIGFFPADHYIGDQEAYINTLKAAVEVAVSQKAIVTLGIKPDYPSTGYGYIEQGENQGEFNGLPVYKVSRFTEKPDRSTAEKFLETGLFSWNSGMFIFQGQVVLEELKTHANNILQPLSDRGIAAYEDLEKKSIDYALMEKTQLAYVLPANFGWDDLGDWNSLERLLEAKGKNIELANHVGLDTEGSIIYASDEEEAIVTIGLKDLVIVRDGKATLVVHKDRTQDIKQVLKQLQTDPKLRKLL

SEQ ID NO: 15122 - protein, 398 aa, Streptococcus pyogenes MGAS8232
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSKGFLGLDIGPKSIAEFDQALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 15123 - protein, 526 aa, Aspergillus oryzae
MAASSSLDHLSNRMKLEWHSKLNTEMVPAKNFRRTSIIGTIGPKTNSVEKINALRRSGLNVVRMNFSHGSYEYHQSVIDNAREAARVQTGRPLAIALDTKGPEIRTGNTTDDKDIPIKEGHELNITTDEKYANASDDQNMYLDYKNITNVIAPGKLIYVDDGILSFQVLEVVDDKTLRVKCLNNGNISSRKGVNLPGTDVDLPALSEKDISDLKFGVKNGVDMIFASFIRRGSDIRHIRDVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGSYPCEAVKMMSETCLLAEVAIPHFNVFDELRNLAPRPTDTVESIAMAAVSASLELNAGAIVVLTTSGNTARLLSKYRPVCPILMVTRNPRASRYSHLYRGVWPFLFPENKPDFNVKIWQEDVDRRLKWAISHGIKLGIINKGDNIVCVQGWRGGQGHTNTVRVVPAEENLGLIE

SEQ ID NO: 15124 - protein, 520 aa, Aspergillus oryzae
MAKVDQKVVLVVIDGWGVAGPDSRKDGDAILAAETPFMSGFAEADSKTAQGYSELDASSLAVGLPEGLMGNSEVGHLNIGAGRVVWQDSVRIDQTLKKGELNKVDNVVASFKRAKEGNGRLHLLGLVSDGGVHSNITHLIGLLKVAKEMEIPKVFIHFFGDGRDTEPKSATKYMQQLLDQTKEIGIGEIATVVGRYWAMDRDKRWDRVEIAMKGIVSGEGEESSDPVKTINERYEKDETDEFLKPIIVGGEERRVKDDDTLFFFNYRSDRVREITQLLGDYDRSPKPDFPYPKNIHITTMTQYKTDYTFPVAFPPQHMGNVLAEWLSKKDVQQCHVAETEKYAHVTFFFNGGIEKQFAGEVRDMIPSPKVATYDLDPKMSAEAVGQKMADRIAEGKFEFVMNNFAPPDMVGHTGKYEAAIQGVAATDKAIGVIYEACKKQGYVLFITADHGNAEEMLTEKGTPKTSHTTNKVPFIMANAPEGWSLKKEGGVLGDVAPTVLAAMGIEQPEEMSGQNLLVKA

SEQ ID NO: 15125 - protein, 141 aa, Brassica napus
IYFGIRATITAVKVGQIFDGRGNPTVEVDVHTSTGVKVPAAVLRGASTGFYKVFNLRDGGFDYLGRGVFKVVGNVNNIIGPVLMGRDPTKQTVMDNLMVHELDGPQNKWGWCKQKLEAKAILAGSFAACKAGAVVSGILFT

SEQ ID NO: 15126 - protein, 167 aa, Leuconostoc mesenteroides subsp. mesenteroides ATCC 8293
MIRNYDPAISSNLQIILTYSGLHAVWFYRISHQLWQLNLKLLAHLCSQWGRLITGVEIHPGAQIGRRLLIDHGSGTVIGETAIIGDDVILYHGVTLGSTHHALGDTSRRHPKIGNHTLIGAHATILGNITIGNHVKIGAATVVLHDVPSHVTIVGNPAHILHKNPNI

SEQ ID NO: 15127 - protein, 403 aa, Trichodesmium erythraeum IMS101
MNKQKQSKSHFIAPKLLKTIEHETPMSKFYRTATYMSRINEAGNINLILGDSHEMPLPGFVEALQKNAIASKIGYYGYKMNLPETRKIVSQALKKHRGISILPDDIFMTNGTVIGLAICLKLLVQEGDEVIINLPPWLGYRGMINAVGAKSVGIPVMAKTFDLDLEKIANSITERTRAILINSPHNPTGKILSEKTLENLGNLLTEASKNYGKPIYLISDETFSRVVFNHQNCPSPTQFYPLSFLVYSYSKTWIAPGQRIGYIALPETMPEREQIRNLIGRLQTLYFGWCFPSALMQYALEDLENLKLNIKHLQDKRDWIIQELQKIGYEVNVPQGTFFLLVKSPYKDDCAFAELLTNYGVFVLPGTPQEIPGYFRISLTANKDMLTQALPKFKLAREQAIMT

SEQ ID NO: 15128 - protein, 696 aa, Streptomyces avermitilis MA-4680
MTRSVYVTGIDRGDGRQVVELGVMELLTRQVDRVGVFRPLVHDGPDRLFELLRARYRLAQDPATVYGMDYHEASALQAEQGTDELMSTLVDRFHLVARDYDVVLVLGTDFADTQFPDELALNARLANEFGAAVIPVVGGRGQTAESVRAETRNAYRAYEGLGCDVLAMVVNRVAREDREELAARLDSLLAVPCYVLPDEPALSAPTVAQITHALGGKVLLGDDSGLARDALDFVFGGAMLPNFLNALTPGCLVVTPGDRADLVVGALAAHSAGTPPIAGVLLTLDERPSDEVLTLAARLAPGTPVVSVAGTSFPTAAELFSLEGKLNAATPRKAETALGLFERYVDTGDLLKRVSAPSSDRLTPMMFEHKLLEQARSDKRRVVLPEGTETRVLHAAEVLLRRGVCDLTLLGPVDQIRKKAADLGIDLGGSQLIDPVTSQLRDSFAEKYAQLRAHKGVSVELAYDVVADVNYFGTLMVQEGLADGMVSGSVHSTAATIRPAFEIIKTKPDTKIVSSVFFMCLADKVLVYGDCAVNPDPNAEQLCDIAVQSAATARQFGVEPRIAMLSYSTGTSGSGADVDKVREATELVRLRRDDLKIEGPIQYDAAVEPSVAATKLPGSDVAGQASVLIFPDLNTGNNTYKAVQRSAGAIAVGPVMQGLRKPVNDLSRGALVQDIVNTVAITAIQAQSPHEKATAQ

SEQ ID NO: 15129 - protein, 476 aa, Streptomyces avermitilis MA-4680
MRRSKIVCTLGPAVDSHEQLVTLIEAGMNVARFNFSHGTHAEHQGRYDRVRAAAAETGKAIGVLADLQGPKIRLETFAEGPVELVRGDEFIITTEDVPGDKHICGTTYKGLPGDVSKGDQILINDGNVELRVVEVDGPRVKTVVIEGGVISDHKGINLPGAAVNVPALSDKDIEDLRFALKMGCDLVALSFVRDASDVKDVHKVMDEEGRRVPVIAKVEKPQAVENMEAVVAAFDGVMVARGDLAVEYPLEKVPMVQKRLVELCRRNAKPVIVATQMMESMITNSRPTRAEASDVANAILDGADAVMLSAESSVGAYPIETVKTMSKIVTAAEEELLSKGLQPLVPGKKPRTQGGSVARAACEIADFLGGKGLVAFTKSGDTARRLSRYRAAQPILAFTTDEGTRNQLALSWGVESHVVPFVNSTDEMVDLVDSELQNLKRFNDGDVVVMTAGSPPGVPGTTNMVRVHHLGEGKRA

SEQ ID NO: 15130 - protein, 513 aa, Candida glabrata CBS 138
MSSDEEDFNDIYGDEHQDQQQTVSNESKPVDSTTAPSTESASVPMDPLAALQALSSNLNNSNNTDNNNDKDTSSGSQTTADGNAVSSEQNGSNVSSEPQVSNQTQNSEQRESIEEANRRQVKADLSRENCKMFIGGLNWETTEDGLREYFSKYGNVVELKIMKDPNTGRSRGFGFLSFDAPSSVDEVVKTQHILDGKVIDPKRAIPREEQDKTGKIFVGGLGTDVRPKEFEEYFSQWGTIIDAQLMLDKDTGRSRGFGFVTYDSPDAAEKVCESRYREFKGKQIEIKRAEPRHQQKQAGQQAVSPPVAGMGMNPMSNPMANPMAGMYQNPMMGGFNPMFNPQAMQDYYQKMQEYYQQLQQQTGMDYSQMFQQQMSMMMPGFQMPPMNADGSGSPLNNAGSENTPSGDDHNGSDNSSSSNVQTIGGDSNDSNSASNERNEDGSNRMKKNSLPKNIPRGPRGPSERNDRGSYHRDRSGGSRHGGYHGSSNGSYRRERGGYNGGRRSNGYHPYNRS

SEQ ID NO: 15131 - protein, 411 aa, Aspergillus fumigatus
MAAELTSTKLNAENHLLLDQPLLRLPHELARRNFKSVQRLVEREREYVIPALKEAANASLSNAQTPDQTLAALDSMLARMQNLKRKMESIQQEEKKVQNQSRKRIQHLEHLHQIPSLADVKYDQWSRIRLDRLVVDHMLRSGYTESAQQLAQEKGIEDLVDLDVFVQCQRIAQSLRRGETKDALQWCNENKAALKKSQFNLEFELRLQQYIEMLRTGDRGKLMDAMAHAKRYLTPYTETQSKEIHRAAGLLAFPQDTKAEPYKLTDLQSMYSFDRWNYLSDLFIRTHHELLSLPSSPLLHIALSAGLSALKTPSCHSAYTSSSSNFLSTTTSVCPICSTELNELARNMPYAHHAKSYVESDPIVLPNGRIYGQQRLLDMSKKLGCVETGKVKDPTTGEIFDKSEMKKVYIM

SEQ ID NO: 15132 - protein, 142 aa, Opitutaceae bacterium TAV2
MAGFMEKTFIICKPDCMAQKHVGEVISRFEKEGFEIVAAKLTRLDARVLREHYAHVADQPFYPNLEAFMSQRPVLIAVLAGENVVARVRDLLGPTNSTKAPKGTIRGDFGESSMYNVVHASDSVENGKIEIARFFKPEEVLG

SEQ ID NO: 15133 - protein, 392 aa, Bacillus sp. YM-2
MKELLANRVKTLTPSTTLAITAKAKEMKAQGIDVIGLGAGEPDFNTPQNIMDAAIDSMQQGYTKYTPSGGLPALKQAIIEKFKRDNQLEYKPNEIIVGVGAKHVLYTLFQVILNEGDEVIIPIPYWVSYPEQVKLAGGVPVYIEATSEQNYKITAEQLKNAITDKTKAVIINSPSNPTGMVYTREELEDIAKIALENNILIVSDEIYEKLLYNGAEHFSIAQISEEVKAQTIVINGVSKSHSMTGWRIGYAAGNADIINAMTDLASHSTSNPTTASQYAAIEAYNGPQDSVEEMRKAFESRLETIYPKLSAIPGFKVVKPQGAFYLLPDVSEAAQKTGFASVDEFASALLTEANVAVIPGSGFGAPSTIRISYATSLNLIEEAIERIDRFVK

SEQ ID NO: 15134 - protein, 201 aa, Brassica rapa subsp. pekinensis
PGTDTAAAVVVWAMTYLIKYPEAMKKAQDEVRNVVGDKGYVSEEDIPNLPYLKAVIKESLRLEPVIPILLHRETIADAKIGGYDIPAKTIIQVNAWAVSRDTAAWGDNPNEFIPERFMNEQKGVDFKGQDFELLPFGSGRRMCPAMHLGVAMVEIPFANLLYRFDWSLPKGIKPEDIKMDVMTGLAMHKKDHLVLAPRTHI

SEQ ID NO: 15135 - protein, 461 aa, Microcystis aeruginosa PCC 7806
MRVCVIGTGYVGLVTGVCLAHIGHHVICIDNNEEKVKLMKSGQSPIYEPGLSELMQSSAASGNLEFSTDLEAGVKHGEILFIAVGTPALPTGESDTRYVEAVARGIGAHLNGGYKVIVNKSTVPIGSGDWVRMIVLDGVAERQKNLVAAGGGISTLERIEAEFDVVSNPEFLREGSAVYDTFNPDRIVLGSNNPKAIEMMKELYAPLVERQFSEDPSLPPVPVVVTDLSSAEMIKYAANAFLATKISFINEVANICDRVGADVTQVAKGIGLDSRIGSKFLSAGIGWGGSCFPKDVSALVHTAEDYGYETELLNAAINVNKRQRTIAIEKLQQELKILKGKTVGLLGLTFKPDTDDMRDAPALTMIEQLNRLGAKVKAYDPIVSQSGLSHGLSGVIIESDPERLADGCDALVVVTEWQEFLRLDYGKMVKTMREPVLIDGRNFLDPAVVTAAGFRYLGIGR

SEQ ID NO: 15136 - protein, 562 aa, Microcystis aeruginosa PCC 7806
MSKNSRRVDFPDLPGPKDLRSYQWQWLGRDLLAGVTVAAYAIPQCMAYGDLAGVDPVVGLWTLVPAALVYALFGSSSQLSLGPESTTAVMTAAAIAPLVSLQGENYGSLAAFLALMVGLICLVGYIARLGFLANLLSKPILIGYMAGVAVIMIAGQLGKISGLSIRENTVFKEIFAFFWGINQWHWPTLSLALLLLLFLFVIQKYFPKAPGPLLAVLLGTLAVATLHLDQEGVAVVGKISNTLPNFGLPTLDFSQLLPLGTAAVGIALVGYSDNVLTARAFAARHNQEIDANQEFLALGLGNLAAGFCQGFPISSSASRTAVGDSVGSKSQLYSLVVAVVVVAVIFLLGPVLALFPKAALGALVIYAACKLLDIAGAKRLKSFRNSEFNLAVLTMVGVLTTGILSGVAIAIGLSVIDLLARITRPDDAVLGTVPGVMGLHALQDWPEAQTIPGLVIYRYDAPLFFANAADFKRRALSAIARETKPVEWFVLNTEALGELDSTAVEVLEELARELSRQGIVFALARVKHDLYLQLQRSRLLDKISEERIYYTLPTAIEAFKNR

SEQ ID NO: 15137 - protein, 326 aa, Candida albicans
MTGSSSQFQQLEKLGEGTYATVYKGRNRATGALVALKEISLDSEEGTPSTAIREISLMKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQHPHQPIIDQQY

SEQ ID NO: 15138 - protein, 641 aa, Oryza sativa
MRALRSRFLPLARRWQWQWQWQWEFQGRRAARCGLCGEAREEEEEEGKMESTMKGIRGDNAPCVLDLDDAATVGGGVGDTYGEDCATEEQLVTPWTVSVASGYNLLRDPRYNKGLAFNERERETHYLRGLLPPAIVSQELQERKIMHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSACLPITLDVGTNNEALLNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGAGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 15139 - protein, 613 aa, Anabaena variabilis ATCC 29413
MSDLFKGFEQLIELVKTLEEKAEKGEIKTDFQINSRSMSSIPRTGNIPRPNNMANDIGTSRIRTQPSPNSDSGNGDTSDVVVPPDAPSGNSLKDVGGLGEVVKELKELIAIPLKRPDLLAKLGLEPTRGVLLVGPPGTGKTLTARGLAEELGVNYIALVGPEVISKYYGEAEQRLRGIFEKAAKNAPCIIFIDEIDSLAPDRSAVEGEVEKRLVAQLLSLMDGFSHSQGVIVLAATNRPDHLDPALRRPGRFDREVQFRVPDVKGRRDILQILTRAMPLEDTVDLDAIAERSVGFVGSDLKALCQKAAYTALRRQMPSVESAVPENMTVSQVDFLQALKEIKPAVLRSVEVEVPHIAWDDIGGLDTIKQTLRESVEGALLYPELYLQTKALAPKGILLWGPPGTGKTLLAKAVASQARANFIGVNGPELLSRWVGASEQAVRELFAKARQAEPCVVFIDEIDTLAPARGSFSGDSGVSDRVVGQLLTELDGIEVGSTILVIGATNRPDALDPALLRAGRLDLQMKVDLPDLASRLAILQVHSQGRPLEGVDFNYWAEMTKNWNGADLTLLCNQAAVEAIRRFRSQGLTDPSEIKITTDDFNYAYKVLTEQRPD

SEQ ID NO: 15140 - protein, 544 aa, Listeria monocytogenes str. 1/2a F6854
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEDAALANNDATSAPATGGNGTPSSKKDPNGLVIAMPSVRKYAREKGVNIAEVAGSGKNNRVVKADIDAFLNGEQPAAATTTAQTEEKAAAPKAEKAAAKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 15141 - protein, 472 aa, Triticum aestivum
  misc_feature (214)..(214): Xaa can be any naturally occurring amino acid
  misc_feature (228)..(228): Xaa can be any naturally occurring amino acid
MATAAAAAVASLRYFPSSVRNRSYPGTIGGGAVVTFSPRRGRCATAAVAAPSREAEPASSLGDLTRVDFPILDQEFDGNKLVYFDNGATSQKPSHVMKALDDYYRFYNSNVHRGIHALSAKATDAYESARRKVANFVNAADSREIIFTRNATEAINLVAYSWGLSNLKQGDEIILTVAEHHSAIVPWQFVSQKTGAVLKYVGLTKERGPDLGAXLKGFLSSKTKIVVXHHVSNVLGSMLPIEEVVSCANKVGAKVLVDACQSVPHMPVDVQKLGADFLVASSHKMCGPTGVGFLHGKFEILSSMEPFLGGGEMIADVFEDKSTYAEPPSRFEAGTPAIGEAIGLGVAIDYLSHFGMQTIHEYEKELGSYLYESLLSVPNVRIYGPAPSASDHRAPLCSFNVENVHPTDIAEILDLQHGIAIRSGHHCAQILHRTLGINASARASLHFYNTKEEVDAFIHGLKATIDFLTSHH

SEQ ID NO: 15142 - protein, 297 aa, Magnaporthe grisea 70-15
MNLLKTTADADTSPDKVDLGVGIYRNEKGNYQELASVREAKVQLLQNDPGHDYECTTGNVDFIKHAAGVMFGRDSALLAAGKIASVQTISGTGAVHLAAQFISRFVHPSPTVYVGTPTWGNYKPLCELVGLQIVEFQQYDSEKRTLDFPAILAAVRSAPRASVFIFQACCHNPTGMDPTRAQWDELRAAVRDMGHFPVFDNAYQGLGDGLDEDAYVVRSWAAEGIEMFVCQSFSKNFALYGERCGVLHAFCPAGAGAARNVHDQLRCLIRWEFSSSPAYGSRLVTRILSSEELRSKW

SEQ ID NO: 15143 - protein, 459 aa, Leuconostoc mesenteroides subsp. mesenteroides ATCC 8293
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLAAVPAIILFVGVLRLPESPRFLVKTHKLAEARQVLTYIRTASEVDPELEDIQNTVAIESGAQKNITLSTLFSSKYRYLVTAGIGVAAFQQFMGANAIFYYIPLIVEKASGQAASSALLWPIVQGVILVLGALLYMVIADKFKRRTLLMVGGTVMALSFLMPSALNALVGADKFPPMLIVVFLSIFVAFYSFTWAPLTWVLVGEVFPLAIRGRASGLASSFNWLGSFAVGLLFPIMTAAMPQATVFAIFGVISIIAVLFIKFAVPETHGRTLEEIEAQGTNH

SEQ ID NO: 15144 - protein, 595 aa, Propionibacterium acnes KPA171202
MSAETMTSDTTDPNGYVIRENQDITARPDLARTTGRVTPTRTRRPVYLDMLPPCNAGCPAGENIQEWLRLIKAHEEEKAWRQLTADNPFPAIHGRVCYHPCEVACNRADLDGAVSIHSVERYLGDLAIEKGWTFTRPTEPSGHRVLVIGAGPAGLSAAYHLAMLGHDVEIHDAGDKVGGMMRYGIPEYRLPREILDAEVARLTDLGIKIVLNHPVNDLMEEKAKGRFDAVFVAIGAHLSKRVDIPTVDASRMVDAVSFLHNVAAGEKPLIGRRVAVYGGGNTAMDAARVAKRLGAEESIVVYRRTAEQMPAHAEEREEAEREGVQMNWLRTITDVGDDLTVEVMELDEDGKPHGTGRYEKLEADTVILAVGQDADTSFLHKMPGMRFRNDVVDVNPSTLMTDVPGIFAGGDTVPSERTVTIGVGHGKRAARQIDLWLNRESGYPTAKNTTVGFNDLNLWYFGDHLRRHQPELDPTQRVGFDEVVGGLTDDQAHFEAGRCLSCGNCFECDGCYGSCPEDAIIKLGKGHRYEFNYDKCTGCATCFDQCPVHAIEMIPEGTDPATVQGSGNPTPGWAVRPEPNPQRSASLKFTVDSEN

SEQ ID NO: 15145 - protein, 375 aa, Arabidopsis thaliana
MAAAMASHVSTARSPALSFSSSSSSFFPGTTLRRFSAVSLPSPALPRLRVSCQASSVTSPSSPSDVKGKSDLKDFLAIDDFDTATIKTILDKASEVKALLKSGERNYLPFKGKSMSMIFAKPSMRTRVSFETGFFLLGGHALYLGPNDIQMGKREETPDVARVLSRYNDIIMARVFAHQDILDLANYSSVPVVNGLTDHNHPCQIMADALTMIKHIGQFERKKVVYVGDGNNMVHSWLELASVIPFHFVCACPKGYEPDKERVSKAKQAGLSKIEITNDPKEAVIGADVVYSDVWASMGQKDEAEARRKAFQGFQVDEALMKLAGQKAYFMHCLPAERGVEVTNGVVEAPYSIVFPQAENRMHAQYAIMLHLLGF

SEQ ID NO: 15146 - protein, 196 aa, Brassica napus
MLRSSLASLIVDVNLRRTLRPRASFSHPAHISRSSRRVLPSLYSSHTPLRFRIQTCNHRRLSSFSSPSEKHGPSSSTRSSLAGQDDAFTAAQNSFNGHNQDDGNENSSPPQPSSKVLTLPTVLTIARVAAVPLLVATFYADSSWGTTATTSIFIAAAITDWLDGYLARKMKLGSAFGAFLDPVADKLMVAATLILL

SEQ ID NO: 15147 - protein, 508 aa, Coffea canephora
MALLLILLPVAFIFLAYSLYERLRFKLPPGPRPKPVVGNIYDIKPVRFKCYAEWSKLYGPIFSVYFGSQLNTVVNTAELAKEVLKDNDQQLADRYRSRPSARMSRNGQDLIWADYGPHYVKVRKLCNLELFTPKRLEGLRPLREDEVTAMVDSIFKDCTKPENKGKSLLMRNYLGSVAFNNITRLTFGKRFMNSEGVVDEQGQEFKGIVSNGIRIGAKLSVADHIPWLRWMFVGENEDLDKHNARRDKLTRMIMEEHTLARQKSGNTKQHFVDALLTLQKQYELSDDTVIGLLWDMITAGMDTTTISVEWAMAELVKNPRVQQKAQEELDRVIGSDRIMTEADFAKLPYLQCVAKEALRLHPPTPLMLPHRANANVKIGGYDIPKGSIVHVNVWAIARDPAAWKNPLEFRPERFLEEDVDIKGHDYRLLPFGAGRRICPGAQLALNLVTSMLGHLLHHFTWSPPPGVRPEEIDLEESPGTVTYMRTPLQAVATPRLPAHLYNRVPVEL

SEQ ID NO: 15148 - protein, 291 aa, Arabidopsis thaliana
  misc_feature (105)..(105): Xaa can be any naturally occurring amino acid
MATNAGYLRCKEERKNESFFKVVQSINVSSENKRALPHDFSRSFTDKELSRKMKIRAQWGNSWEVGISKNPRFYFMEKSGWEKFVRDNALGNSELLTFTHKGKMXFTVNIFKLDGKEMMQPPQSRSFFASSSRIKTEQEENDIKEEVVVSSNRGQTTAAESKGRKLNLGKRAAKESQSSKRTEKVVRARSDYAGASSSTAAAFTILFKQGYLVFLRIPNSVSKDQVPDEKTVFKIHHPNGKKSWNVVYLERFGAFSGGWRRVVKEYPLAVGDTCKFTFIKPKELLLVVSKP

SEQ ID NO: 15149 - protein, 561 aa, Dehalococcoides sp. CBDB1
MSFESFNFDPAVMAGVRACGYKEPTPIQAQAIPPIMAGHDVIGLAQTGTGKTAAYALPIIQKMLSTPRGRVRTLVIAPTRELACQISDSFRSLGQRARIRECSIYGGVNMDQQIRRLRSGVDVVVACPGRLLDHIWRGTIDVCGVETLIIDEADRMFDMGFQPDIQSILKCLVQPHQTLLFSATMPPEVRKLTLETQTNPVTVQVGTQSPVSSVSHSVYPVKSHQKTPLLLEILKTVETKSVLIFARTKYGAENLADEISKAGFTTASLQGNLSQNRRHAVMEGFRRGNFKILVATDIAARGLDIDHISHVINYDMPDSPEDYTHRIGRTGRFDRTGQAFSLVTGRDGDMVRDIQRLLSSPIQRLRVDGFDYATTRNDGQNQSQRRDFAPRRGYSHGGYNRPEMAVNETSQTDTPSEMPVSPARPFNPGFRPSRPANSAPRFHREGNFAPRMQSHSSFEGTSAPAARPAARYNDRPAFRKENSFQTTEASRPSFRKETGFTPREHTQADFENSEQPSGRRPARFNGKASFADRPARSGNKVGKPPFFRRSKPAVSEKNETY

SEQ ID NO: 15150 - protein, 215 aa, Triticum aestivum
  misc_feature (12)..(12): Xaa can be any naturally occurring amino acid
  misc_feature (23)..(23): Xaa can be any naturally occurring amino acid
  misc_feature (70)..(70): Xaa can be any naturally occurring amino acid
  misc_feature (108)..(108): Xaa can be any naturally occurring amino acid
  misc_feature (119)..(119): Xaa can be any naturally occurring amino acid
  misc_feature (123)..(123): Xaa can be any naturally occurring amino acid
  misc_feature (128)..(128): Xaa can be any naturally occurring amino acid
  misc_feature (133)..(133): Xaa can be any naturally occurring amino acid
  misc_feature (147)..(147): Xaa can be any naturally occurring amino acid
SRPESGVHPKGXCSGILRIRDPXPAGPAFLQGRTVCTGPKREEPANLARRKYAGIVQKLGFPRYLSKDFXVQTIVASGDREISPSSSRPLLTPHGASSSYEPELCPGXIYGMKQQKIVXLLVXVSGKXVLPGXLKVPDEIYAAVESXYPVLPEYRKSQPLRGGIHHPQVGVALLLLVHRTTKTGLHWRLFSSFLTGQEFRVAKYSLEKGLYSLSY

SEQ ID NO: 15151 - protein, 293 aa, Meiothermus ruber
MNMAYKDYYKILGVPKNASEDEIKKAFKKLARKYHPDVNKEPGAEEKFKEINEAYTVLSDPEKRRYYDTYGAAAGSAGWQGPPPGPGGFGGFTGNVGDFSDFFQQLFGGRGGFGGLGDLFEQTPGRGARRVAGDLEAELPLSLEEAYRGGEKTISVGAERLTVRIPPGVREGQKIRLAGKGRAGGDLYLHVKLQSRPEMRLEGDDIYTVVEVPAPIAVVGGKVRVQTLDGPVEITIPRRTQAGRKLRLAGKGWPRKDKSRGDQYAEVRVTIPTNPSPEEERLYAQLAELIKVQ

SEQ ID NO: 15152 - protein, 616 aa, Coprinopsis cinerea okayama7#130
MESLGDCSESNLTCQYITPDALTQKLGYSIYSELTDGAFYLTASTVHPQSLPNGSATINVRTLKGLLAAVGDLASFTFIRDELENKKTFHVSFYDVIAADNAYRDLHNQVAFGMKLAVHGRQLAEPVENSPETIYSSRQNGCQFPNPLPCNPYDPHQAPQWENEMKQQVSSCATPDQNCNYCPSRRHIVGQLAYPMPPTPPTLANCGPPIASPPPMMPHIMMSPPPVAQSPVDYAYQQVYNYQWQVEPNMITNRAMAPPHPHSPMLPFTPPQFWVPDESRVIPPPMYAIPHQTENGAAPPGTHYIAHFQSPPASPPTHDVYAPSTHSSTSPTLLTDALSQLSLQSAQPGPAAPPGLTASSIQVVNGLQIYPPGSVSAAAQCENATKNQLNIQKIEEGQDTRTTVMIKNIPNKMSDKDLIAYIAKVVPRRIDFLYLRMDFQNGCNVGYAFVNFITVEDLLKFAKARLGEKWNMFSSEKVLQMSYANYQGKEALVEKFKNSCIMDERESWRPKIFYSYGPNQGLPEPFPAPTHIRRKERSSFNRGALFVPGVHHRHHHNRGGAEHHGESNGRLHGNGSGNGNGTLLASPMSSNSESEGRGGGLFTRKGLKKRQMEVRG

SEQ ID NO: 15153 - protein, 434 aa, Arabidopsis thaliana
MYVGFTSATGRLRSSHYILGWTFKLNGTASNIDISRLPKLPRDSRSTSVKKILAISLSLTSLAILVFLTISYMLFLKRKKLMEVLEDWEVQFGPHRFAYKDLYIATKGFRNSELLGKGGFGKVYKGTLSTSNMDIAVKKVSHDSRQGMREFVAEIATIGRLRHPNLVRLLGYCRRKGELYLVYDCMPKGSLDKFLYHQPEQSLDWSQRFKIIKDVASGLCYLHHQWVQVIIHRDIKPANVLLDDSMNGKLGDFGLAKLCEHGFDPQTSNVAGTFGYISPELSRTGKASTSSDVFAFGILMLEITCGRRPVLPRASSPSEMVLTDWVLDCWEDDILQVVDERVKQDDKYLEEQVALVLKLGLFCSHPVAAVRPSMSSVIQFLDGVAQLPNNLFDIVKARENVGAIEGFGEAAESLAEPCSVATLTFTEPFVSHGR

SEQ ID NO: 15154 - protein, 285 aa, Zea mays
MSSPTHARLAQQGKAGVALRLLLAAALAGFLLVFAARTLVTSPVPASPSYSSHPHPHPLPLPVAEALVHYATSNATPQQTAEEIGVALRVLQRRAPCNFLVFGLGLDSPLWAALNHGGRTVFLEEDAAWITSVRGRHPALESHHVAYDTALADADALLGLRAHPACVAQPDLAAAAAASCRLALRGLPPVFAGLDWDLVMVDAPTGWTPRAPGRMGAIYTAGMAARARRPGAGPTHVFVHDVDRSIEDAFSRAFLCEGYLAEQVGRIRHFVIPSHRDKDGTPFCP

SEQ ID NO: 15155 - protein, 403 aa, Oryza sativa Japonica Group
MEAGRKLAARHPHGRSRTAHNMSSSSLRKKSDAALVRKVWVFALSLLGLIPLAERVSFLTEQIALYTGPTVGGLLNATCGNATELIIALFALLKGKIEVVKCSLLGSVLSNLLLVLGTSLFCGGVVNLGARQPYDRNQSDVSTALLFLAVLCHSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGTIEPTSQSWGLSVSFISIILLPIVGNAAEHAGAIIFALKNKLDITLGVALGSATQISMFVVPLSVLVAWIMGVQMDLDFKLLETGSLFMAVLVTAFTLQDGTSHYLKGILLLLCYIVIGACFFVARQPAGHANSNGALLDVPTGSMSVQAA

SEQ ID NO: 15156 - protein, 167 aa, Prochlorococcus marinus str. NATL2A
MKHTLSVLVEDESGALSRIAGLFARRGFNIDSLAVGPAEAKGISRLTMVVQGDESTLQQMTKQLNKLINVLEVLDLTTLPAVERELMLLKVSASSENRGKILDLVQVFRAKVVDVSDSALTLEVVGDPGKLVALENLLKPYGILEIARTGKVALKRASGVNTEMLKT

SEQ ID NO: 15157 - protein, 255 aa, Haemophilus somnus 129PT
MTERIDNYEQRFGGIGRLYGIDVLERLKQTHICVIGIGGVGSWVVEAIARCGIGQITMIDMDDICVTNINRQLPALTGNIGKLKTEVMKERVQLINPDCHVNIIDDFLLAENLAEYIHTGYDYVIDAIDNVRVKAALIAHCKRNKIQIITIGGAGGQTDPSQIRVADLSRSIQDPLLAKVRSVLRKEYHFPQNPKRKFAVDCVFSTQPLIFPKMADNCTISATMNCANGFGAATMITATFGFFAVAKIINKLAKG

SEQ ID NO: 15158 - protein, 386 aa, Triticum aestivum
  misc_feature (231)..(231): Xaa can be any naturally occurring amino acid
  misc_feature (239)..(239): Xaa can be any naturally occurring amino acid
  misc_feature (256)..(256): Xaa can be any naturally occurring amino acid
MGGHALLILLSVASLALLPGATPLQPSQAWSLFKLRQLLGDPPVLGTWHNYTDFCYGGDYKTASAFVECYEDSVTQLHIMGDPGAGARPLPATFSIDAFFTTLSRLPDLKVLTLTNLGLWGPLPGKISRLQKLEIVNVSSNYLYGELPRGLSQLGSLQTLVADHNMLGGKLPGWLKDMPLLAGLSLRNHMLQGTLPESLKDMLSLRSLVLASNNLSGNLPDLKNLQVIDMXNNALGPKXPRLGRKGGSVVLAGNKXSDGLPADMLASCYLLERLDVSGNRFVGPFPAALLSLPSMEYLSIAGNRFTGRLSGNASCGENLRFVDLSSNLLTGSLPGCLLAAPGKTVLFSGNCLSTGDDSQSQHPSPFCRNQALAVGIVPEQGRKKSG

SEQ ID NO: 15159 - protein, 902 aa, Trichodesmium erythraeum IMS101
MIIPSQISTPKEAKPSKLEGIKENSNLLREPLASQLLEDTNHFTEEAVQILKFHGSYQQHNRDNRIKGQEKDYQMMLRTRNPGGFIPPQLFLTLNKLSNEYGNGTLRVTTRQGFQLHGVLKKNLKKVISSIIKSMGSTLGACGDINRNVMSPPAPYKNRPEYEYAKDYANKIADLLTPQTGAYYEIWLDGEKVISAQEASEVKVARLRNGNGTIFPNSEEPIYGTHYMPRKFKCAVTVPGDNSIDLYTQDVSLVVITNEVGELEGFNVLAGGGLGRTHRKEETFPCLAQEIGYVTKEDIFDFMKAIVATQRDYGDRSNRRHARMKYLLHDWGVEKFKAKLIEYFGKSIAPFKPLPEWKYLDFLGWHEQGDGRLFLGISVENGRVKDEDSFQLKTALRKIVDLFKLPMLLTANHNIILYEIKPQQQQAVEQILNKHGISTEKNIDPLVRYSMACPALPTCGLAITESERTLPGILGQIRLLLDKVGLGQEHFVVRMTGCPNGCARPYMAELGFVGSAADSYQIWLGGSPNQTRLAKPYIDKLHINNLEAELERIFIYFKQQRQPDESFGDFCNRVGIEAIRKFVTNYQSSFSMNTDINNSSLTSINSEKNIPIVTDVTETTPDTKSQEESTSKNLENNQEVIPMNSPVTQSTNMTQTTTTSTTISEAQPLSTHQTPKTPTFSSDTNTTISTPSTLGKQEGQPTVETTPSTSVQQEDKLTVETTSGQQEGQTTVEPTIPSTSGQQEGQTTVEPTIPSTSGQQEGQPTGEPTIPSTLGKQEGQPTVETTIPNLDKQEAQPNRESTISDNLDKQEAQPTSESTISANLDQQEAQPIGQLESSPDKPKDTSKMRHRVSVRDEIYTKLKEESKRQGKPVVQLATEAIAEYLEKIRKNESLTTTNETNF

SEQ ID NO: 15160 - protein, 518 aa, Oryza sativa Indica Group
MAAAAATSPARAAAWAFAAATCVKLLLVPTYRSTDFDVHRYWLALTHALPARRWYTDASSQWTLDYPPFFAYFSRLLALPAPLVDASLVSLPVPDAPPSFAYLLYLRLTVAFSDLLLLLSSVLLLATDALTRRRRRPFLSLALVLWSPALLAVDHVHFQYNGFLMGLLLLSLHFLEQGRDLAGGVVFAALLCSKHLFLVAAPVYFVYLFRHYCCGRGVVRGLGRLVLMGAGVAAVFAAAFVPFLYYGQMQQLFNRLFPFGRGLCHAYWAPNFWVFYILLDKILAFLLRRLGFNIQIPEASFTGGLVGNSSPFAVLPKVTPITTFLLVILAMSPCLMKAFSKPQPRHIIRWVSYATTCGFMFGWHVHEKASLHFTIPLALIAMDSLEDAKHYFVLSIVSCYSLFPLLFENQEYPIKVMLLLTYATLMWVGFSSHFAAKSPQEGKKVNESGSVVRKNSFIGWISFSYLLGIVAIELWSQVFHRYVFGSRFPFLPLIMVSLYCGVGMMYSWMWQLTWIVRH

SEQ ID NO: 15161 - protein, 257 aa, Listeria monocytogenes str. 1/2a F6854
MDSEKIDYLARLWIMEAAAKIKQSFKETLDIDVKSGRNDLVTNMDKETEAFFVQQIKDHFPDHRLFGEEGMASDVTDLDGVVWILDPIDGTLNFVEQQRDFAISLAVYEDGIGRLAYIYDVTRDELYFGEKGKGATVNGRTIPKLDPAIDLKDTLLIANLSVTRKFPTMWEAVKVSRGLRLHGAASLEYMDVATGRAGAYLSANLAPWDIAAGKIIVEELGGKVTRINGEKINMLEKGSSIVASPKIHQTLLDNYLP

SEQ ID NO: 15162 - protein, 211 aa, Dehalococcoides sp. VS
MLSDSSKKIKKEVEAINSDFKTIVGCGESKCPKLKRLKLASTPDITLTVMIEIPKGSRNKYEYDKERKIIKFDRMLFSAVHYPSDYGFIVDTLAEDGDPLDALVLVWEPTFPGCMIETKPVGLFKMYDEKGPDAKLLCVPIGDPHFNFIRDLSDVPPHLLKEIFHFFNIYKELESKKTGVEGWEDRESAIKTYWESHQRYLDALKDKKKEK

SEQ ID NO: 15163 - protein, 277 aa, Triticum aestivum
MDNEVISNGSAKDYLDPPPAPLVDAGDLGKWSLYRAVIAEFTATLLFVYVAVATVVGHKRQTDAQACSGAGVLGIAWAFGGMIAVLVYCTAGISGGHINPAVTFGLLLARKVSLPRAFLYMVAQCVGAICGAALVRAVHGGHQYVLYGGGANELAPGYSRTAGLIAEIAGTFVLVYTVFSATDPKRIARDPHVPVLAPLLIGFAVLMAHLATIPVTGTGINPARSFGAAVVYNGGKAWDDQWIFWVGPFIGAAVATVYHQYILRNSAIFRSNYDASV

SEQ ID NO: 15164 - protein, 331 aa, Streptomyces avermitilis MA-4680
MQLRELVFGAACAAAVRAAAKLGVADALGEKPATAEELAAVLGTEPRPLLRLLRALSCYGIFAQNDDGRFVHTSMSRLLREDDPHSLRYISLWCTEPWTWDAWPRLDEAVRSGGSVFHELYGKGFFDYLHEDAHDSAQVFNQAMTTSSEQSARDVAELLDLTGVSTVADIGGGQGHVLASLLEKHPDIRGTLLDLPRVVEKADPRLRDGGPLAARARIVGADCREEIPVEADLYIIKNILEWDDDSTRRTLRNVMTKARPGARVVIIENLVDDTPSMKFTTSMDLMLLLNVGGAKHTKESLVTRMTEAGLTVGEIRPVNAYLHAFECTVPA

SEQ ID NO: 15165 - protein, 280 aa, Leuconostoc mesenteroides subsp. mesenteroides ATCC 8293
MSLNELYELNDGHQLPKIGLGTFQIRGYQGVDQILNAIQIGYRLLDTSTNYDSEGAVGEAIRRSGIPRSQFYVTTKLPGKYHHFDDALKIIEESLLRLGLDYLDLYLIHWPLPKRDNYVEAWQALIEAQRRGLVRSIGVSNFEKEHLDKIISATGVTPAVNQNEIHPYWPQESLVATNQEYGIVTEAWSPLGRGSSELTEPLILKLAEKYDKNAGQIILRWHIQRGILPVAKSTTPQHQRRNLDIFDFTLTETEVSQISDLERKDGRVDDQDPKEYEEFV

SEQ ID NO: 15166 - protein, 482 aa, Desulfotalea psychrophila LSv54
MMNFSNSYRQLGSDFYEESLPTPVLAPRLLLWNAPLAEQLMIPEELGQAALAQIFSGNQLLPGSEPIAMAYAGHQFGSFVPQLGDGRAHLLGEVFDKSGQRWDIQLKGSGPTQFSRGGDGRCAVGPALREFIMSEAMYALGVPTSRCLAVVTSGEDVYRRSILPGAIVTRIASSHLRVGTFEFFAARGEHEALKRLCDYTIDRHFPELQGATDQYIRFLDRVIGRQIQLITEWMRVGFIHGVMNTDNTSLAGETIDYGPCAMLGAYDPHTVYSSIDIKKRYAFGNQSAISQWNMTRLAECLLPLINADRNRAIDQLNPLLIAYTDRFNRVYIKMMGKKLGLTSLQAKDEKLIISLLDQLKIGKMDYTLTFDLLTKSLSSEPIASQMRGQLGNYFDLWQRRLKEQGTDLQEVQTLMRQQNPLLIPRNHHIEAAIAECEQTGRVNLAEKLLHVLRAPYEELTETHLYQDPPSDGDKNYQTFCGT

SEQ ID NO: 15167 - protein, 608 aa, Vibrio angustum S14
MHEEMIGLTIAGLGVLGLSCQWLAWRMKLPAILLLLMAGLIIGPVTGVFNPNILFGDLLFPLISLSVAVILFEGSLTLNFDEIKNVRRNVKSIVTVGAIITWMITSVATHYLLDFSWPLALLFGSMTVVTGPTVIVPLLRTVRPQAKLANILRWEGILIDPIGAIFVVIVYEFIVSSSTIHSVEVFGLMLLVGLVLGGVAGWLLAHVLRRHLLPEYLQPFAVLALVLGVFSGANALEPEAGLLAVTVMGMWLANAKDVNIQHILHFKENLTILLISGLFLILASRIQMSDFHALGWGSIAVFVVIQLVSRPVSIFVSTMFSQLAFKEKLFLAWVAPRGIVAAAISALFALKLSNDGVAGAELLVPLTFMVIIGTVVLQSLTARPMAKLLGVAEPSPKGFLVVGANDVARTIALALKKYDCRVVVTDSNWDYIRAARMAGLETYYGNAVSSHADEYLDVIGIGHLLALTPDKHFNAVAAMHFESDFGSRNVFRLNGRRHNSGLEKHSASQAHNGAALFGEDISYKKLASLINQGGEIKHTKLSDNFTLEDYYTQYKASQLIPMFAIDPKGYIYTYTISDEFAVKAGWTIVSLIKELKVSEEVKDIKTEA

SEQ ID NO: 15168 - protein, 267 aa, Dehalococcoides sp. CBDB1
MNIAFIGGGNMGEAILGALIQKNICPPQNITVSEIKAERRTYLETSYGIKTTASNPDAIKSAEVVLLAIKPQNLPELSAELKGKLADKQLVISIIAGATLSKLSGGLAHKAVVRVMPNTPAMIGMGMSVWTALPSVSPAQKDQAKAILSAMGKEIYTGKETMLDAATAISGSGPAYFFLFMEGLEKAALEMGFTPEEASILVSQTAAGSAIYAGKSGLALTQLRKNVTSPGGTTAEAIKAFEEAGLEATIIKAAKAAFNRSVELGKG

SEQ ID NO: 15169 - protein, 656 aa, Oryza sativa Japonica Group
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKALSKTAASILESILKKDPHEAEFIQSIQEVVHSLEPVLVKNSQHVQILERLLEPERCFIFRVPWVDDRGEAHVNRGFRVQFSQALGPCRGGLRFHPSMTLSVAKFLAFEQTLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPELVFFLCSEDVFLCFRLVSTQKLIDLSMQVVGAWCKHMCVS

SEQ ID NO: 15170 - protein, 461 aa, Vibrio angustum S14
MSQTAFSSLNLNPDLLSNLTSLGYDAMTPIQAQSLPLILEGKDVIAQGKTGSGKTAAFGLGLLQNLKVKRFRVQTLVLCPTRELADQVAKEIRRLARAIHNIKVLTLCGGTPFGPQIGSLEHGAHIIVGTPGRVEEHVRKGFLCLDELNTLVLDEADRMLEMGFQDSLDAITDVAPSDRQTLLFSATYPTQIASIAKRIMRNPVEVKVESNHDNSSISQHFYKVESNDDRLRAVRLLLSQHRPESCVIFCNTKREAQEISDDLEDYGFSSIALHGDLEQRERDRTLVLFANKSRSILVATDVAARGLDIDNLDAVINYHLARDTEVHVHRIGRTGRAGSKGIACSLFSDKEHYKVALLEDYLDRPISGEALPAEHLLDQPTFRPEMVTLMIDGGKKQKVRPGDILGALTGENGIAGSDVGKINVFDFCAYVAVKREVARAALKKLENGRIKGRNFRSRQLR

SEQ ID NO: 15171 - protein, 417 aa, Shigella flexneri 2a str. 301
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 15172 - protein, 146 aa, Glycine max
MKPIDDKQETVTIRTVSHDEEGKKRVEKTELSTHNIDTIRYVEKKLINKGVQRQDRHPADGIGISRPPPKSGHGGKFTWEGPATVENSELMAAPAAMDEGDPNYVDWEENGEEASELVVGEVEVSKVAQEHDGLARVDVDPRLQVN

SEQ ID NO: 15173 - protein, 398 aa, Dehalococcoides ethenogenes 195
MTSQVETDKGFISDRAKELKPSGIRKFFDLAAKMGSGAISLGVGEPDFTTPWHIRESAIYALEKGYTMYTSNAGLLELRQEIAKYLYQTYKLEYNPETEILITVGSSEALDLVMRATLNPGDEVLMTDPAYVAYPSCVFMAYGNPVQIPTFEANNFEISAADIAPRITPKTRSILLGYPSNPTGAVMPKAKLAEIAKLACEKNLLVVSDEIYDKIIYSGFEHTCFATLPGMRERSVIINGFSKTYAMTGWRIGYAAGPADIIQAMTKIHQHTMLCAPIAAQKAALEALKNGHDDVRLMVEEYDRRRRFIVKSFNDMGLSCFEPKGAFYTFPSVKKTGLSSAEFAEKLLLEETVAAVPGTAFGDSGEGYLRCCYATSMKDLEEAMKRFRHFLKHNCPGM

SEQ ID NO: 15174 - protein, 375 aa, Physcomitrella patens subsp. patens
MGQGDCTGVDDLGCRNKTLALDLKGGAIALIMGYSALGVALPLIGRRTQWLKPDGNLFFVAKSFAAGVILATGFVHMLPSAMESLTSQCLPRFPWHKFPFPGFIAMLASLVTLVIDFVATEFYETQHNHGDPDASAKGASNPEPAQDLVQSIEQSKEPLPEGDRKVHIIGMREHAESHRHSHAEGTCKDQTDDKVLKHVGYSHNEIGASTNEVLEHVRHVVVAQVLELGIVAHSVIIGVTLGVSESPCTIRPLLAALSFHQFFEGFALGGCIAQAGFSYSSAVIMACCFAITTPAGIGIGIGISSSYNEKSSRSLIVEGVFDSISAGILVYMSLVDLIAADFLSKRMRCNRKLQFYSYASLITGCFAMSALAIWT

SEQ ID NO: 15175 - protein, 149 aa, Oryza sativa Indica Group
PLKICYPALEYEEWRIITGSDPKNTPWSYHNGGSWPTLLWQFTLACIKMGRRDLAQRAIEVAEKRLSEDKWPEYYDTRTGRFIGKQSRLYQTWTIAGYLSSKMLLDCPELASILICEEDLELLEGCACSVNKSARTKCSRRAARSQVLV

SEQ ID NO: 15176 - protein, 438 aa, Bordetella petrii
MATPATCKQAGPPRAQLRRALGLRGAVALGVGGTIGGGIFVLVGHTAALAGPAALLAFGLAFIASLLIALPYAELACRYPEAGGGYVFVREVLGRGWGFLMGWVFWGAYIFVSGYVTLGFGGYLASLTGLPATWSAVGLVLVCAAVNLAGVKLSGQLQVLVIGLALAGLLGFAVLGMPSVDADRFTPLMPNGFAGILSAALIAFLAFGGFDMVAAAGEEIEKPERNLPLAILLTLGIVLVVYLLVACAALGTLDWRELGASAAPLADAAQAFLGPVGARVVAMVAVLTTAATANAVLVATSRISFAMARDGLLPAALARVGPASGAPWVAVLVSAAMLALVALVGTLHISTAIGGFLYVLHFIPPLLVLLKLRRGGSPRPAFQMPWPKVLLPLAFVMALVLLVSSGAAGLAGGAAWLALGLLMGGARLASRRAGRQAL

SEQ ID NO: 15177 - protein, 431 aa, Arabidopsis thaliana
MVRGLMKFPGISTKLLNISVNSLCKFRNLERAETLLIDGIRLGVLPDVITYNTLIKGYTRFIGIDEAYAVTRRMREAGIEPDVTTYNSLISGAAKNLMLNRVLQLFDEMLHSGLSPDMWSYNTLMSCYFKLGRHGEAFKILHEDIHLAGGHTDNAIELFKHLKSRVKPELMTYNILINGLCKSRRVGSVDWMMRELKKSGYTPNAVTYTTMLKMYFKTKRIEKGLQLFLKMKKEGYTFDGFANCAVVSALIKTGRAEEAYECMHELVRSDGNLDAVDDLLEEIEMKGLKPDDYTHTIIVNGLLNIGNTGGAEKHLACIGEMGMQPSVVTCNCLIDGLCKAGHVDRAMRLFASMEVRDEFTYTSVVHNLCKDGRLVCASKLLLSCYNKGMKIPSSARRAVLSGIRETVSYQAARKTHIKIKAAIECNTLMYP

SEQ ID NO: 15178 - protein, 275 aa, Coccidioides immitis RS
MDQRKILASKGPKHDDSKNLDPKALLGQDQRPVLLLLSANISEIRSIQDLKPTNILLELENPNHAISQYLSEVPARADCQRGITVPLREVITTPLVSEMIDPRIRIIDFGVATWGEDRLSNLIQSPALRAPEVTIGAPWDTGVDIWSLGCLVMEFVQGIVLFSGEASENGTWTAEDDHLARIIEILGPFPLDFIKKGNRAAEFFDKQGNLLRIPNLKPTRLERLINGTTKPFLKTSDMPDSEVHIFIDFIKGMLEIDPETRKSAAELLHHKWICL

SEQ ID NO: 15179 - protein, 710 aa, Coccidioides immitis RS
MATRPPNRFLKTFFYTVAAFAGAGGVLYITYRPRNIPGSDPAAVPPPRYGEGGKLLPPQFPYIKTRDEQIRDLKRSSAGSLQGTIKGKQLFDGKGGNGATAAHDEEPFDLLVIGAGATGAGIALDAATRGLKVAVVERDDFSAGTSSKSTKLVHGGVRYLEKAVWELDYNQYSLVKEALRERKYFLHTAPHLSTWLPIMVPVQRWWQVPYFWAGTKFYDFLAGSEGIESSYFLPKSKALDAFPMLKKDNLFGALVYYDGAHNDSRMNVSLAMTAAIYGCTVVNHMEVTGLTKDANGRLTGARVKDLIAERNGQEAQEFTVRAKGVINATGPFTDSIRRMDDPNIAEIVAPSSGAHVILPGYYSPAKMGLIDPATSDGRVIFFLPWQGNTIAGTTDSPTTITPQPIPSEDDINWILSEIRGYLAPDINVRRDDVLAAWSGIRPLVRDPKAKNTESLVRSHLVSVSKSGLLTCAGGKWTTYRQMAEEAVDEAIKQFNLQPRALRIVPDISGTGYHVDKAILDGSCQTHQVRLIGAHGYSKTLFINLIQHFGLATDVAKHLTESYGDRAWEVAAMSSPTNIRFPLCGVRISPLYPFIDGEIRYAVRREYAQTAVDVLARRTRLAFLNARAALEALPTVVDIMAEELHWDEKRKDVEWTETVKFLVSMGLPKSRAGATRKDVEKGRLTGISSTQTKRPLVDCMFLLFFKSIPGF

SEQ ID NO: 15180 - protein, 164 aa, Triticum aestivum
MATRLLHLRRLLPAARPSCAAAFSTAVTPTPRVSGLVDEICGLNLIEASSLADALRGRLGVDQLPPLAILMGGAAPLAGDGAGAAEEAKPKEEKMAFDVKLEGFDAAAKLKIIKELRAITSLGLKEAKELVEKAPAVLKAGVPKEEAESIAEKMRALGAKIVLE

SEQ ID NO: 15181 - protein, 432 aa, Glycine max
RVSYVGPPRRNRKALGDIGNLANIRSAVEVKPNRPITRSFGAQLLANAQAAAAAGNNKKQACANVAGPPAVANGGVAVAKRVAPKPGPKKVTVTVKPKPEEVIDIEASPDKKEVLKDKKNEGDANSKKKSQHTLTSVLTARSKAACGITNKPKEQIIAIDASGPTRPLAAVEYIDDIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLSEGSASQHS

SEQ ID NO: 15182 - protein, 198 aa, Streptococcus gordonii
GIEDILVVTGKSKRSIEDHFDSNFELEYNLKEKGKDDLLKLVDETTGIGLHFIRQSHPRGLGDAVLQAKAFVGNEPFVVMLGDDLMDITNDKAMPLTKQLMNDYEATHASTIAVMQVPHEEVSSYGVIAPQGEGLNGLYSVEKFVEKPSPEEAPSDLAIIGRYLLTPEIFKILENQAPGAGNEIQLTDAIDTLNKTQR

SEQ ID NO: 15183 - protein, 331 aa, Zea mays
MSWAAIENDPGVFTELLQQMQLKGLQVDELYSLDLDALNDLQPIYGLILLYKWRPPEKDEGPVIKDAIPNLFFANQIINKACATQAIVSVLLNSPGITLSDELKKLKEFAKDLPPELKGLAIVNCASIRMINNSLARSEVSEEQKRPSNGDDVYHFISYVPVDGVLYELDGLKEGPICLEKCPGGVGDAGWLRLAQPVIKGHIDLFSQNDVRCSVMAILKNRKEMCTVELKELKRKRESLLQQTGYPSAIRHVPSVEQSLAEVSAQIEAVTEKMIMEEEKVKTWKTENLRRKHNYVPFLFNFLKILEEKQQLNPLIEKAKAKQKSHCPSPR

SEQ ID NO: 15184 - protein, 330 aa, Arabidopsis thaliana
MTMRSSSPSSSSSYSLAFTSLSNRLETIFKKASELCTLCDIEACVIYYGPDGELKTWPKEKEKVRDIALRYSLLNEALRRKKSVNLHGFLNKKKNKGLKNPNKKMKTSLKNVNILKYPLADHYPPDQVSPLIQSLELHVSKFQERLRFLESQKQNQTKPDHQSLTPSSLNHYTQSLNPSQFSLFMYNHGDNTLSQIPVSASNFNQDYFSALLEESELKNQLMKPEICGYDQNQNMSMGDITNNKFQDPCVSNKEAVQESVNNFGLNQLMYKEFYGCDQNMSMGNINSNSFQNPCVSNTQHYSAVEESVKNPWLNQLMQNELYGYGYAGFC

SEQ ID NO: 15185 - protein, 326 aa, Desulfotalea psychrophila LSv54
MSILERCKDVCRKAPKTIVFPDCLDKRVFEAAGRLQAEGLAHPVFMGSPFAVRAKMREAKCSSRGVTVVDHTSPSLLEKNANEFIAIREAKGKKLSMDDAVKAMRCPLAGAAMMVRREEVNLGVSGNISSTGNVIRAGLQFLPKQQGMKTISSFFFMIAPEGGKDYIFADCGVVPVPNENTLADIAISSADKARKLLGEEPRVAMLSFSTKGSANHERAIFVRDTVEQIRKRAPDMLVDGELQLDAAIVPSVAAQKAPGSVVEGMANVLIFPSLEAGNIGYKLAQRLGGYTALGPLLQGFAAGWHDLSRGCTADDIYKVAVVGQCL

SEQ ID NO: 15186 - protein, 461 aa, Vibrio angustum S14
MSTGKIVKVIGAVVDVEFDQDSVPRVYDALTLSDSEHAELVLEVQQQIGSGVVRCIAMGSSDGLRRGLDVVNTKAPITVPVGEETLGRIMNVLGTPIDECGEIGEKTKYAIHREAPSYEEQSNSSELLETGVKVIDLICPFAKGGKIGLFGGAGVGKTVNMMELINNIAKAHSGLSVFTGVGERTREGNDFYYEMKEAGVLDKVAMVYGQMNEPPGNRLRVALTGLTIAESFRDEGRDVLLFIDNIYRYTLAGTEVSALLGRMPSAVGYQPTLAEEMGVLQERITSTKTGSITSIQAVYVPADDLTDPSPATTFAHLDATVVLSRNIAALGLYPAIDPLDSTSRQLDPLVVGQDHYDVARGVQTVLQRYKELKDIIAILGMDELSEEDKQTVSRARKIERFLTQPYHVAEVFTGQPGVFVSLKETIAGFKGLLSGEYDDVPEQAFLYCGAIEEVLEKAKNL

SEQ ID NO: 15187 - protein, 118 aa, Glycine max
  misc_feature (57)..(57): Xaa can be any naturally occurring amino acid
GGGKVSFKVTLTSDPKLPFKVFSVPEAAPFTAVLKFAAEEFKVPPQTSAIITNGSFXPLGSQKLGHTRNVFGLRKYFLSSIYRWFHGVGINPQQSAGNVFLKHGSELRLIPRDRVGAF

SEQ ID NO: 15188 - protein, 442 aa, Oryza sativa Japonica Group
MRMSGGGGGGGEMLAPLMEGPDPESGDGEGGGGGGGGGGGGGGGGRGARGRRGEGWGQWVRGQLSRTPSSVAAAAAGAGAARNDLRLLLGVMGAPLAPVHVSAAEPLPHLSIKDTPIETSSAQYILQQYLAASGGQKLLASVRNAYTMGKVRMVATEFETAGRLVKNRNAARCAEPGRFVLWQMAPEMWYIELAVGGSKVHAGCNGKLVWRHTPWLGAHAAKGPVRPLRRALQGLDPLTTASMFAGARCIGERKVNGEDCFILKLCTEPETLKARSEGLAEIIRHVMFGYFSQRTGLLVHIEDSHLTRIQSTTGGDAVYWETTINSFIEDYRPVEGIMIAHSGRSAVTLFRFGEVAMSHTKTRMEEAWSIEEVAFNVPGLSMDCFIPPTDIKSGSISETVELSHGEKSKVGPPPGHRAKVAALEKAVDGKVAWSGTILEDHN

SEQ ID NO: 15189 - protein, 77 aa, Glycine max
  misc_feature (30)..(30): Xaa can be any naturally occurring amino acid
  misc_feature (52)..(52): Xaa can be any naturally occurring amino acid
TTVNRAGAGMVAPFTGLKSMAGLLTKKTNXDITCIATNRGRVQCMHVWPRVXQEELETLSYLTTMDDTQYQTEAEYL

SEQ ID NO: 15190 - protein, 56 aa, Oryza sativa
CKAGHGERKIDPRGHGGIRGGPVENGHRHANRRGPPRGLKEMEISASTSDGKPSKR

SEQ ID NO: 15191 - protein, 145 aa, Oryza sativa Japonica Group
MAVELELFQKDSKGRFPWGPTKIWPTWRRGEAHLHAAAPLPNPKRDAITTTTIRFFPLRIEKKAKGPLDPPTTPRPPRRRRKRRRSRMFFSRFDPWPVFFRREWKRCWPFLTGFAVTGAIITKMTAGFTEEDLKNSKFVQAHKKH

SEQ ID NO: 15192 - protein, 72 aa, Zea mays
TPDDSVNPKFIFRTYFCQFAFEVVEQGVFEGVPRVLRVMHNPYSDPPGMEKFARLPPAWASSPGVGMLSCPS

SEQ ID NO: 15193 - protein, 163 aa, Pseudomonas syringae pv. tomato str. DC3000
MRHIISLLLENEPGALSRVVGLFSQRNYNIESLTVAPTEDPTLSRLTLTTVGHDEVIEQITKNLNKLIEVVKLVDLSESAHIERELMLVKVKATGAQRAEIKRTTDIFRGQIVDVTASVYTVQLSGTSDKLDSFIQAIGTAAILETVRSGVTGIARGDKVLSI

SEQ ID NO: 15194 - protein, 140 aa, Oryza sativa Indica Group
MEDDEWRIITGSDPKNTPWSYHNGGSWPTLLWQFTLACIKMGRPELARRAIAVAEEKLAADKWPEYYDTRSGRFIGKQSRSYQTWTIAGFLTSKMLLENPELASILTCDEDLELLEGCACCLSKKRTRCSRRAAKSHVVE

SEQ ID NO: 15195 - protein, 556 aa, Frankia sp. CcI3
MQRSSAGRGAEPTDTGAVRDVPRSPADGPSGPSAVGPAGYDTVLVIDFGAQYAQLIARRIRECHVYSEIVPWDMSVDEILARRPSALILSGGPKSVYSPGAPRVDPALFATGVPILGICYGHQVMAQALDGAVARTGTAEYGATRLSVSDPGVLFDGLPVVQQVWMSHGDSVTAAPPGFRVTASTPSAPVAAFEDPARRLYGVQFHPEVVHSERGMDVLRHFLLVGAGCRPTWTMINIVDEAVAAVRAQVGTGRLICGLSGGVDSAVAAALVHRAVGDALTCVFVDHGLLRAGEAEQVERDFVATTGVDLVHVKAADRFSAALSGVTDPERKRKIIGREFIRVFEESARELEVRAEAEGATIDFLVQGTLYPDVIESGSPTAAKIKSHHNVGGLPEDLRFDLVEPLRTLFKDEVRRLGEELGLPEEIVWRQPFPGPGLAVRIIGEVTPERLDVVRAADAVIREEIRKAGLDREIWQVFAVLLADVRSVGVQGDERTYGFPIVLRAVTSEDAMTADWARLPYGLLERISNRVVNEVPQVNRVVYDITSKPPGTIEWE

SEQ ID NO: 15196 - protein, 143 aa, Oryza sativa Indica Group
PLKICYPALENQEWKIITGSDPKNTPWSYHNGGSWPTLLWQLTVASIKMNRPEIAAKAVEVAERRIAIDKWPEYYDTKRARFIGKQSRLYQTWSIAGYLVAKQLLDKPDAARILSNDEDAEILNALSTNRKRGKKVLKKTFIV

SEQ ID NO: 15197 - protein, 384 aa, Frankia sp. CcI3
MTAAAADDRSVAPDAELWASDIRAAARVLAGVARRTRVVRDLGLSAAVGAPVWLKCEHEQHTGSFKLRGAYHRVATADPATRARGVVAASAGNHAQGVAFAAAAFGVEATIFVPVGANPVKVARTRRWGARVEKIPGGVEAALAAAATFAARGDRLLVHPFDDPTVVAGQGTIGLELLDQVPDLGTVLVGVGGGGLIGGLAAAVRSRRPDVRVVGVQSVLSSAFAASLRAGRRLTVPPGGAATPGAGTTPGAGTLRGVGTIPGSRTSEQPTAPRSSRVVPASTTIADGMAVNAPGVLTFALAARLVDEIVTVDEAAFWEAMVLLHRAGHQVEPAGAAGVAALLRRSDLAQGPTVAILSGGNIDPGVASRVKALAAIPPSASSTA

SEQ ID NO: 15198 - protein, 247 aa, Dehalococcoides ethenogenes 195
MLSLDGKTALITGSGRGIGKAIALRFAEAGAKVVVNSLSPAGEEVAAHIRSNGGQAVFVQADVSQSSGVDALFKAAQEAFGGVDILVNNAGITRDQLTMRLSEEDWDSVIQTNLKSVFLCSKAALRQMLKNRWGRIINLSSIVGLKGNPGQANYAAAKAGILGFSCSLAKEVASRNITVNSIAPGFIETDMTAALSEEQRQAITERIPMQKLGTVEDVAACALYLAKEDAKYITGQVISLDGGMSII

SEQ ID NO: 15199 - protein, 351 aa, Physcomitrella patens subsp. patens
VSAGSGEYVLQISLGTPPQQFSAIVDTGSDLCWVQCAPCARCFEQPDPLFIPLASSSYSNASCTDSLCDALPRPTCSMRNTCTYSYSYGDGSNTRGDFAFETVTLNGSTLARIGFGCGHNQEGTFAGADGLIGLGQGPLSLPSQLNSSFTHIFSYCLVDQSTTGTFSPITFGNAAENSRASFTPLLQNEDNPSYYYVGVESISVGNRRVPTPPSAFRIDANGVGGVILDSGTTITYWRLAAFIPILAELRRQISYPEADPTPYGLNLCYDISSVSASSLTLPSMTVHLTNVDFEIPVSNLWVLVDNFGETVCTAMSTSDQFSIIGNVQQQNNLIVTDVANSRVGFLATDCS

SEQ ID NO: 15200 - protein, 200 aa, Oryza sativa Indica Group
PDWIFDFMPSRGGYFIGNVSPARMDFRWFCLGNFIAILSSLTTGEQAEAILDLVEERWEEFIGEMPMKVCYPAMENQEWQIVTGCDPKNTRWSYHNGGSWPVLLWLLVAVSVKLGRPHIARRAVEVMEKRLVKDEFPEYYDGKAGRYVGKQARKFQTWSVAGYLVAKMLLDDPSNLRAVSLADDCHIRSAPVLKRSNSFP

SEQ ID NO: 15201 - protein, 333 aa, Enterobacter cloacae
NGVAGSYAEYVPLLHIVGAPCSGVQQRGELLHHTLGDGDFHHFYRMSEPVTAARAILTAQNACYEIDRVLEVMLMQSRPGYLMLPADVAKKPATPPVNALTTPPFPVNEACLNAFRQHAQAMLSVGSSVALLADFLAAFGFIQMLQCWMTDQLPTHTTVILGKGIVKRKHGGFSYPYHGAGGQRGPVPAIEGADTVICIGTRFTDTVTAGFTQQFARERTIEIQPFAARVGDVWFSGIPMREAINALIPLVRARAHAAANHRPPQAARAPVHQGTLNQETLWQTVQQFIRPDDILLADQGTAAFGAASLRLPAGAELLVQPLWGSIGYTLAAA

SEQ ID NO: 15202 - protein, 430 aa, Haemophilus influenzae 86-028NP
MMDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCVIEPLADLLKKKGSEIAALILEPVVQGAGGMYFYSPTYLVKAQALCKQYGVLLIFDEIATGFGRTGKLFAAEHAGISPDIMCIGKALTGGYLTLSASITTTEIAQIICSGEAKCFMHGPTFMANPLACAIAAESIRLLLESPWQQNIQRIEHSLKQQLSPLAEKDYVKEVRALGAIGVVEMKSAVNMKTLVPRFVEQGVWIRPFGKLVYVMPPFVIKDDELQKLTEGMILALIQEYEH

SEQ ID NO: 15203 - protein, 536 aa, Medicago truncatula
MATSHFSTQSNPLKVPNLIGGKFIESKSLTFIDVINPATQEVLSQVPLTTNEEFKAAVAAAKKAFPSWRNTPITKRQRVMLKFQELIRRDMDKLALNVTTEQGKTLKDAQGDVFRGLEVVEHACGMATLQMGEYVSNVSHGIDTFSIREPLGVCAGICPFNFPAMIPLWMFPVAVTCGNTFILKPSEKDPGASMLLSQLAMEAGLPEGVLNIVHGAHDTVNAICDHDDIKAISFVGSNVAGMHIYARAAAKGKRVQSNMGAKNHAVVMPDASVDATINALIAAGFGAAGQRCMALSTVVFVGGSKPWESILVERAKALKVNAGTEADADLGPVISIQAKERIHRLIQSGFESGARLLLDGRSIVVPGYESGNFIGPTILADVRSDMECYKEEIFGPVLLLTEADSLEEAISFVNENKYFVSNYFVSFAFVKLPFISYSDFSNRYGNGATIFTRSGVAARKFQTEIEAGQVGINVPIPVPLPFFSFTGNKASFAGDLNFYGKAGVNFYTQIKTITQNWKDSDSDDKINMAMPTSQKS

SEQ ID NO: 15204 - protein, 175 aa, Triticum aestivum
  misc_feature (154)..(154): Xaa can be any naturally occurring amino acid
MAPAVMVSSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRXQVQCVSFIAFRPPGCEESGKA

SEQ ID NO: 15205 - protein, 325 aa, Pseudomonas putida KT2440
MAKRIQFSQHGGPEVLQFVEFEPTPPGPQQVRVRNHAIGLNFIDTYFRSGLYAPPSLPSGLGTEAAGVVEAVGEGVSRLKVGDRVAHAGGPLGAYSEVHTLPEANLVKLPDTISFEQAAAVMLKGLTVQYLLKQTYEVKAGDVILFHAAAGGVGSLACQWAKALGAKLIGTVSSAEKAERAKALGAWATIDYSREDVAKRVLELTDGKKCPVVYDGVGADTWLTSLDCLRPRGLMVSFGNASGAVSGVNLGILAQKGSLYVTRPTLATYANNAENTQAMADDLFAMIGSGKLAVDIQQRYPLSEAAKAQAELSARRTVGSTVLIP

SEQ ID NO: 15206 - protein, 331 aa, Magnetospirillum magnetotacticum MS-1
MVSAFVGPVGTPARLVTDWPVGVRLAWNPEFLREGHAVADTLHPDRLVYGVPDDGDALVERLDAVYARLLDDGVPRLVTDLATAELAKVAANAFLATKISFANAVAEVCEAAGGDAVALVGTMALDRRIGGEYLGVGLGFGGGCLPKDIRAFAARARELGVGPAVSFLDEVDAINDRCRERAVVLARTACGGSLAGRRVAVLGAAFKPDSDDVRSSPALALARALAAEGADVVVTDPQALALAQAAAPELGYATDAREAATGADVVVLATEWDEYRHLDPGALADVVRSPRLVDARNAVDGARWRAAGWDVRALGVAAPRAARPQSSSPTA

SEQ ID NO: 15207 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQKVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 15208 - protein, 663 aa, Dehalococcoides sp. CBDB1
MLNIQNLSKSFGVRSLYTGVNLNIGARDRLALLGPNGSGKTTLFEMIAGRLEPDEGKIILRRGTTVGYLEQDIKPSSKQPLLKAVSSASDRLRSLSHKISLLQGELAEEKDGSESNRLMNELGELQHSFEALGGYNAEQEAKLILAGLGFKPADFDRPLHEFSGGWLMRAELAKLLFLSPDILILDEPTNHLDLESTRWFESYLKQYSGSVLFTSHDRAFLNSIATKILSLEEQKARLYTGNYDSYLRERELRLTQLESQSRRQQELIDKETKFIERFRYKATKASQVQSRIKKLDKLSAIVIPRQTKKMHFNFPEPERSGHDVIKLRNLTKSYGDMVIYQGLELVLNRGDKVALVGPNGAGKTTLLKILAGVMPFDSGYRNLGVNVNTAYFAQYYVESLCPSNNLIQELETILPDAPEQQLRGMLGAFLFSGDDVKKRISVLSGGEKTRLAIAKMLLKPANLVLMDEPTNHLDIPAREILADALQAYKGTLCFITHDRTLIREVATKIIEVRNGKIRIFEGDYDAYLEFAAANPFEDEILKNRTAVSSPRPAPVSASLSQKQRKTLEGQIRNQHYKETGALKQEISDTEEEITGLEKSKQELETLLADPDLYRSGQKVADASLEYKTCKERLIILGEKWLKLCQQNDTLKQKMEDTLKELDN

SEQ ID NO: 15209 - protein, 688 aa, Staphylococcus epidermidis RP62A
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 15210 - protein, 415 aa, Arabidopsis thaliana
  misc_feature (339)..(339): Xaa can be any naturally occurring amino acid
MASISETSDDGSNGGDPNQKPEEPHKNPQEGKEEENQNEKPKEDDHQEEEVENVPQIPPQMPLELIVSTIATLRRCHYPTLSLLSDSFRQVISSVDLFQTRSLIGSTEPVLYTLITFTSPNFEEPRWFILQRRNNTSLQLSLVTSLPPMFPGCTTVTIGHKIYVMGGLRSLNRRAKTVFVIDCRFHTWRYLQEMQVARSYAASAVIDGMIYVVGGSTKRSDDWVEVFNVETNTWENVPSVLSPYGRSKAPFNVHFVLDNKIYILDGNNRVAYDLRGRRWEDWGPAGNQLGYFWQVLYCVVDNLLYAVVPDHLHVTPIVVYDPREMGWRPVMGVDYLPNXVYSESRMTNFGGKLMILGCYQSQARFDYYGEVNVWCVEVALERREDGEIWGKVQSLSLVNKFRKSPVFVLSRTVTV

SEQ ID NO: 15211 - protein, 147 aa, Glycine max
MATTAALCGTMMSSSFLRRKAVVTSLKAFPNANAVFGVKGGRGGGVTAMASFKVKLITPEGEKEFECPDDVYILDQAEEEGLELPYSCRAGSCSVCAGKVVSGKVDNSDATFLEDEQLEAGFTLTCVAYPTSDVVIETHKEEDLSAA

SEQ ID NO: 15212 - protein, 389 aa, Streptomyces albus
MTAGQAGRGAGADEVRAVLLAGGEGRRMGPLGTGRLKPLIPFGGTSRLIDFSLANARRSGLSEVLLLSQYEEQRLMDDLHQVWNSSRGFRVHFGPYDEAYRRLPADELPEKLPEPGGPRERGTADAFLHKAAHVFGGRPSEILILHADHVYRFDYRDMLREHRASGAALTLAYQRIERRYVHLFGMVEFDAGGNLTNFVEKPAEPSSDLVFAAFCVFDSACLQRYLERLDGTDWQHDISRDVIPAMLAGGERIRGHLVRGHWEDIGTVDRYLRAHLALLADPPTLPLDRMPLTIRPEVPRRFLSSAAGVRSSLVPSDVRNAGLVERCVLFPGVRIGEGATVRDSVLLPGAEVPAGARIDASIVLEDGSVQPVGPDRPEDASARTCPGIG

SEQ ID NO: 15213 - protein, 473 aa, Vibrio angustum S14
MATVITEERSNGTLSLEKSDLNKNVFIACIIAALAGLLFGLDIGVISGALPFIAKEFGLATHTQEWVVSSMMFGAAFGAIGSGPLSNKFGRKYSLVVASILFTVGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQIMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNAQTFWLYAVLNIIFLFVTLILIPETKGISLEKIEQNLMAGIPLSKLGKK

SEQ ID NO: 15214 - protein, 88 aa, Glycine max
  misc_feature (27)..(27): Xaa can be any naturally occurring amino acid
MAEQTFIMMEPDGVQRGLIGEIISRLXKKGFYLKGLKLDTVYRPFAEKHYADLSAKPFFSGLDDYIIFGPVVAIIWEGMNFFQLTKIL

SEQ ID NO: 15215 - protein, 2211 aa, Debaryomyces hansenii CBS767
MAQISNPITPPMKSTGDRMMTLETQDGIAMQGYSFGAPVAAAGEVVFQTGMVGYPESITDPSYEGQILVITYPLVGNYGVPDRSLKDDDVPELPKYFESNKIHIAGLVVAHYTEEYSHFLAKSSLGQWLQEQGIPAIYGVDTRSLTKRLREKGSTLGRLALQKASSKSSEIIETSKWEQHFEIPEWDDPNVKNLVAKVSTKEPVLYTPKNDVKVGKNGKPLRILAVDVGMKYNQIRCFIRRGVELKVVPWDYDFSTEEYDGLFISNGPGDPSVMTSTVSTLQKVLEAGKTPVFGICLGHQLLARATGASTLKLKFGNRGHNIPCTSTISGRCYITSQNHGYAVDTNTLSSGWKELFVNANDSSNEGIYHDSKPYFSVQFHPESTPGPRDTEFLFDVFIQSVVDFNKSGVQKAVEFPGGLLEENRAAHPKVDAKKVLVLGSGGLSIGQAGEFDYSGSQAIKALKEEGIYTVLINPNIATIQTSKGLADKVYFLPVTADFVRKVIKHERPDGIYCTFGGQTALGVGIKLKDEFEGLGVKVLGTPIDTVITTEDRELFSQAMDEINEKCAKSAAANNVSEAIDAANSIGYPLIIRAAYALGGLGSGFADNEQELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYVVVKIPRWDLKKFTRVSALLSSSMKSVGEVMSIGRTFEEAIQKAIRSTDYQNLGFNKTSALMSIDIDNELQTPSDQRLFAIANALSDGYSVEKVWKLTNIDKWFLNKLDGLIKFGNLVTTYGVKENLPVTVLKQAKQLGFEDRQIAKFLNSNEVAIRRLRKEAGVIPFVKQIDTVAAEFPAFTNYLYITYNADSSDVSFDDHGVIVLGSGVYRIGSSVEFDWCAVRAIRTLRENGTKTIMINYNPETVSTDYDEADRLYFETINLERVLDIYDLEQSSGVVISMGGQTSNNIALPLYRQNVKILGTSPEMIDSAENRYKFSRMLDRIGVDQPAWKELTSIDEAEDFAEKVTYPVLVRPSYVLSGAAMNTVYSRDDLASYLSQAVDVSPDYPVVITKYIENAKEIEMDAVAKDGKMIMHVVSEHVENAGVHSGDATLVVPPQDLDPETVGRIVEATAKIGKALDITGPYNIQFIAKDNDIKVIECNVRASRSFPFISKVVGTDLIEMATKAIMDMPFTPYPGEKLPEDYCAVKVPQFSFSRLAGADPVLGVEMASTGEVATFGKNKYEAYLKSLISTGFKLPKKNILFSIGSYKEKQELLPSIRKLHELGYKIFATAGTADFIKEHSIPVHYLEVLGEKEDQKSEYSLTQHLANNLIDMYVNLPSSNRFRRPASYMSKGYESRRMAVDYSIPLVTNVKCAKLLVEALARNISLDVSEIDAQTSHKTAVIPGLVNINSFVSSFDEFEATTRASLASGFTFNTFLPQTSDCSTISNIETLADAIESATNSAYTDFSLSIAASETNSEEAAYAAEDAGALFIPFNDFNKSKVSAISAHFASWPENKPIITDAKTTDLASVLLLASLHSRSIHITGVSSREDLGLIIMAKEKELQVTCDVSVYALFLSQAEFPQLDFLPTKEDQNALWSGLKNIDCFSIGVLPYLVSKALNKKFCPGLGTKETLPLLFNAVKEGRLTTQDIVERFHDNPVRIFNIPKQESSVEFDIDRLAASTNDSEVLTIARANLQGAVNRVSFHNETVCLGGEILAVNALGHNGVEPRARFGSVTGIPSSPALSNKKARMSFNDGARRPSLLREQSSIPAEFEKLGAELVSQPPTSSVSGDNNALINYIRKNNTFLRNSVLSVKDFTRSDLHSLFTVAQEMRLAVERQGVLDILKGRLLATMFYEPSTRTSASFDAAMQRLGGRVVSVASASSSVKKGETLQDTIRTLTCYADAVVLRHPSEESVDIAAKYSPVPIINGGNGSKEHPTQALLDLFTIREELGTVNGITVTFMGDLKYGRPVHSLCHLLRHYQVRIQLVAPKELAMPENIKKMLQDNGMLVVESEVLTPEIIAKSDVLYCTRVQEERFEDKEQYSRLKDTYIVDNKILSYAKQHMCVMHPLPRTNEIREEVDFDQRAAYFRQMRYGLFVRMALLAMVIGVDF

SEQ ID NO: 15216 - protein, 792 aa, Salmonella typhimurium LT2
MSNNGSSPLVLWYNQLGMNDVDRVGGKNASLGEMITNLSGMGVSVPNGFATTADAFNQFLDQSGVNQRIYELLDKTDIDDVSQLAKAGAQIRQWIIDTPFQPELENAIRDAYAQLSSDDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAAGRPAIVRRTMGSKKIRMVYAATQEHGKQVKIEDVPQEQRDIFSLTNEEVQELAKQAVQIEQHYGRPMDIEWAKDGHTGKLFIVQARPETVRSRGQVMERYTLHAQGKIIAEGRAIGHRIGAGTVKVIHDIGEMNRIEPGDVLVTDMTDPDWEPIMKKAAAIVTNRGGRTCHAAIIARELGIPAVVGCGDATERMKDGEKVTVSCAEGDTGYVYADMLDFSVKSSSVDTMPELPLKVMMNVGNPDRAFDFACLPNEGVGLARLEFIINRMIGVHPRALLEFDDQDAALQNDIREMMKGFDSPREFYVGRLTEGIATLGAAFYPKRVIVRLSDFKSNEYANLVGGERYEPHEENPMLGFRGAGRYVAESFRDCFALECEAVKRVRNDMGLTNVEIMIPFVRTVDQAKAVIEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 15217 - protein, 388 aa, Frankia sp. CcI3
MDLFEYQAKKLFAEHGVPVPTGKTATTPEEARAIATELGGRVVVKAQVKTGGRGKAGGVKVADGPDDAFAKATAILGMDIKGHTVHSVLVEEASNIAEEYYASFLLDRANRTFLAMASREGGMEIEEVAATKPEALARIAIDPLKGVDAAKAREIAVAAKLPEAALDGASELLAKLWTVFVKSDATLVEVNPLILTGDGRVVALDGKVSLDDNADFRHPEHEAFVDVAAVDPLEQKAKEKGLNYVKLEGEVGIIGNGAGLVMSTLDVVTYAGEEFGGKRPANFLDIGGGASAEVMANGLSIILGDPAVKSVFVNIFGGITSCDAVANGIVQALKIVGDVSTPLVVRLDGNNAEEGRRILAEANLPVVKPVDTMDGAAKLAAELAAAAA

SEQ ID NO: 15218 - protein, 348 aa, Haemophilus influenzae
VEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGLMPDCTTRFSYQGKPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKPIKDVLLDINKWGIDHTFECIGNVNVMRQALESAHRGWGQSIIIGVAGVGQEISTRPFQLVTGRVWKGSAFGGVKGRSELPQMVEDSMKGDIQLEPFVTHTMPLDQINEAFELMHEGKSIRTVIHY

SEQ ID NO: 15219 - protein, 451 aa, Thermoplasma volcanium GSS1
MTTMIMENEERTEKYNEDALRYSEYYKGKIQTMSKVPVRSLDDFSIWYTPGVAAVSRKIATDHDLSFELTGRWNTIAILTDGTRVLGLGNIGPEAAMPVMEGKALIFNYLGGVNAIPVPIRVSSREEFVSVAKSLEPSFGGINLEDIESPKCFFLLETLQKEMNIPVWHDDQLGTASITLAGIINSIRIVGKKIEEVKVVFNGAGAANIAAAYLFKAAGFKKENIILVDSKGVLQPERQDMDSLMLNNPWKYQLAIETNGERVKGDLKEALKGADILISAAKSGPDTVDAKLVKEMNNDPIVFVLANPIPEMWPEEAKENGAKIVATGRSDFPNQINNSLVFPGVFRGVLDARAKGVNFDVMVAASYEIANFVEEPTAEKIVPTMEEWELYPRLASAVATKTVELGLARKIDSKEGFYKRARDIIENNRNIYRKMMDLGLIRMMPNGERKY

SEQ ID NO: 15220 - protein, 162 aa, Oryza sativa Indica Group
LSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 15221 - protein, 193 aa, Streptococcus pyogenes MGAS8232
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTIRQGALISAHAQVIGPIDIGANAKVGAAAVVLSDVPEDVTVVGVPAKIVRVHGQKDNRQIQSLQKQREVSYQLSK

SEQ ID NO: 15222 - protein, 439 aa, Zea mays
MAKHLAAMCRCSLLVLVLLCLGSQLAQSQVLFQGFNWESWKKQGGWYNYLLGRVDDIAATGATHVWLPPPSHSVAPQGYMPGRLYDLDASKYGTHAELKSLTAAFHAKGVKCVADVVINHRCADYKDGRGIYCVFEGGTPDSRLDWGPDMICSDDTQYSNGRGHRDTGADFAAAPDIDHLNPRVQQELSDWLNWLKSDLGFDGWRLDFAKGYSAAVAKVYVDSTAPTFVVAEIWSSLHYDGNGEPSSNQDADRQELVNWAQAVGGPAAAFDFTTKGVLQAAVQGELWRMKDGNGKAPGMIGWLPEKAVTFVDNHDTGSTQNSWPFPSDKVMQGYAYILTHPGTPCIFYDHVFDWNLKQEISALSAVRSRNGIHPGSELNILAADGDLYVAKIDDKVIVKIGSRYDVGNLIPSDFHAVAHGNNYCVWEKHGLRVPAGRHH

SEQ ID NO: 15223 - protein, 573 aa, Bacillus clausii KSM-K16
MADQKFAPTQDGPPSDVERIKEESNYLRGTLAESLNEPLSAGIPDDDNRLMKFHGSYLQDDRDLREERRRQKLEPAYQFMVRVRLPGGVATPKQWLAMDDLAHRYGNGTLRLTTRQTFQMHGILKWNMKKNIQGINAALMDTIAACGDVNRNVMSTPNPYQSEVHGEVYDWAKKLSEALLPKTRAYHEIWLDEEKVAGTPQQDEVEPMYGPLYLPRKFKIGVAVPPANDVDIFSQDIGFIAILEEGKLTGFNVACGGGMGMTHGDTKTYPQLGRIIGFCEPQQIMDVAEKLITIQRDYGNRSVRKYARFKYTIDRRGLDWLKNELHARLGWELGEARPFQFDHNGDRYGWTKGVKGRWHLTLFIQNGRIQDTDDYQLMTGLREIAKIHTGEFRLTGNQNVIISNITAAKKKAIQAIVETYRLTDGQHVSALRRNSMACVAFPTCGLAMAESERYLPSLIDKLEFILDEAGIREEDIVIRMAGCPNGCSRAALAEIGFIGKAPGKYNLYLGGGFAGERLSKMYKENIGEAEILETLEPILFAYAKEREEGEHFGDFVIRKGYVKAVESGTDFHQ

SEQ ID NO: 15224 - protein, 521 aa, Pseudomonas putida KT2440
MHRLSLLLPFLTWLPRQSGRSLRQDLLVGLSGAILALPQSIAYALIAGLPAEYGLYAAIVPVLIACLWGSSWYLICGPTAAISIVLYASISPLAVAGSADYITLVLLLTFLGGIFQLLLGLLRFGALVNFVSHSVVLGFTLGAAIVIALGQLPNLLGMALPSQATALMTVQDLASHAGEVDLPSLLLGLATVVIGAAFKLWRPRWPSLLISLILVSLLAWLLPGFFGHVPRVAAFTGQLPPFSPLPLLDMELMLRLLPSAVAVGMLGLVTSLSIARSLSARSEQLIDPDQEIRAQGLSNIAGAFFSGYLSAGSFTRSGLSYEAGARSPMAGVFSALWVALFAVTGAGLIAHLPIPAMAGSILLICWGLVDHRGIRALFRVSRSEFLVMALTAAATLLLELQTAIYAGVLASLFFYLKRTSRPRIQQSREGDADVLRVGGSIFFGAAHYLQVRLQRCQGPHVVIDARQVNFIDYSGVDMLHREARRLRRLGGSLTLHRARPQVIEELQKLEGVELCPIRFEE

SEQ ID NO: 15225 - protein, 646 aa, Candidatus Protochlamydia amoebophila UWE25
MIALIELTMRFGAKILFKQVNLQFNPGNRYGLIGANGCGKSTLIKILTGEVCADAGHVAIPQQLTLGSLKQDHYVYENERVMDVVLRGKQLLWRSLEEKKRILQREPFTDDDCQALSRLEKIIEDQDGYTAEGEAAKLLEGLGIREGSHQKPLHFLSGGYKLRVLLAQLFFGKHAILVLDEPTNHLDLYSIKWLEGYLRNFPGTLIVTSHDRDFLNNICTHIADVDYGTIKIYKGDYETFAKQKKQDLEQKEAMLTKHDKRREDLQGFIDRFGAKATKARQAQSKARLVEKIEDEMDSLNLLPTSRLYPNLNFVPERASGVTVLKAKNLYKTYGSKKVLENVSFEIERGDRLAIIGPNGIGKSTLLEILTDHAQPDQGEFDWGFATQIAYFPQDHAREVQGDLNLLDWLSQFDRTKTQEQVRDLLGLVKFSGDTVKQPIHTLSGGETARLILAKMMLLKPNVLIFDEPTNHLDLEAIDELTKALQNYSGTLLLVSHNRYFVSHIANRILEINYQKIEDFKGSYPEYVKKQEKDHLSKPKALSQRYAHEEAKTNSLSTYQDQKRLKSLKTQLKKRIFLAEEECHKIEEKIKEIEQIMTSEGFYQISTREKQLEYTQEKQLLENALMTSMEKWETASLELQQSEAEDE

SEQ ID NO: 15226 - protein, 324 aa, Pseudomonas aeruginosa PAO1
MGQLIDGRWHDQWYDTQKDGRFQRENAQRRHWLGEPAFPAEGGRYHLYVSLACPWAHRTLIVRKLKGLESLVDVSVVSWLMRENGWTFDPAHGSTGDRLDGLAFLHQRYTRDDPHYSGRVTVPLLWDKQAQKIVNNESADIVRIFNSAFDAIGANALDFYPEPLREEIERLNGRIYPAVNNGVYRAGFATRQDAYEEAFVQLFEELDYLEGLLGERRYLAGEYLTEADIRLFTTLVRFDAVYHGHFKCNLRRIEDYPNLSGWLRELYQRPGIGETVDFEHIKGHYYASHRTINPTGIVPLGPRLDLARAPGRERLPGKGIWGEG

SEQ ID NO: 15227 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDNPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 15228 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDNPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPACWADASKADRELNWRVTRTLDEMAQDTWHWQSRHPQGYPD

SEQ ID NO: 15229 - protein, 147 aa, Methanosarcina mazei Go1
MNKQNLVYLASFLVILIAILIFAPRGGDRPSGFTNVSVEEAKELLDEEDVFLLDVRTPPEFNSFHIEGATLIPVTNSSGSSLSSDKLLEARVDEVPENKKILVYCRSGHRSISASKILVNAGYSQVYNMEGGINAWTGAGYPVVSSE

SEQ ID NO: 15230 - protein, 688 aa, Arabidopsis thaliana
MATGVTHVFHKTCANNTYNIAHPSQTCDNILNHTYNFNIGGGRCAGCGEKIYDSLIYICNKCVLVPLRKGRFGSSYFHFNCAKYPPSEVIDVPQHHDHKLKLEMVKSCFSCATCGKDSDGYSYKCHECDLKFHVNCEKHPAEVTHFSHPLHPLKLVKVEPPAYTDKKCRLCGEKLANSEVFYHCSACNFSLDLQCIFYPPKQNPHDPNIHGHQLTLMPKSISFSCTSCGLKGDRSPYVCLPCDFTSHNDCSGFPWVININRHDHRVSRTSLIGVVNSVCGICRKNMDWSCGGYSCKRCPTSVFHTKCVTREDVWDGKEMKDEPEEEEDILPFKVIDENTIQHVSHKEHNLRLDKSGIFIEERICEACVYPIYHHSFYSCMSCSFILHESCAYLPLWKRHVVSNDRHKYKYWDYFIRCTACGLFSNGFRYEAMRASLDLRCASITEPFVHKSHPHPLFYTSPRGICIVCKKEAQHVLRCVEDDCEYIMDYKCALLPYEVKHNGKYWCDICEKETDPKTWFYTSKDCELTLHTNCVLGDFRGLKPRRKETIYVHDVSVYFVVVRNNSMSRPLCKQCKSRCIFPVILKTWNESSLRNEYYCSELLNICMIDTQSKDQGTNIVPQSKDLGETHSSRSKDHFNYNLMGRIIDKLNTRFYYDVFPVIITTVPECWKFLKDLFYAMFTIARKEKR

SEQ ID NO: 15231 - protein, 233 aa, Haemophilus influenzae
MNIQHNLNLIHQKIETACEEAKRNQNTVKLLAVSKTKPISAILSAYQAGQRTFGENYVQEGVEKIQYFESQDINLEWHFIGPLQSNKTRLVAEHFDWMQTLDRAKIADRLNEQRPTNKAPLNVLIQINISDEESKSGLQPEEMLTLAKHIENLPHLCLRGLMAIPAPTNKIAEQEAVFRKMSDLFEQLKQALPNQQIDTLSMGMTDDMPSAIKYGSTMVRIGTAIFGARNYSK

SEQ ID NO: 15232 - protein, 284 aa, Nicotiana tabacum
MAENKEEDVKLGANKYRETQPLGTAAQTDKDYKEPPPAPLVWRQKSCRHGLFTELEFSMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGITPARSLGAAIIFNQDRAWDDHWIFWVGPFIGAALAAVYHQIIIRAIAFKS

SEQ ID NO: 15233 - protein, 662 aa, Zea mays
MISARTAAASPASLWKQGGRSEGGGSCDGCRTYRNTLRRAAAAKVRALPSRAVEAVKMGSAAEMEQEEAEVAAAAAGVVVEDHYGEDSATEELPILPWAFSVARYVSFSWLKKYAEESYFYISGYTLLRDPHHNKGLAFMEKERDAHHLRGLLPPAVVPQELQIKKIMHNLRQYQVPLQRYMAMMDLQERNERLFYKLLIDNVEELLPVVYTPTVGEACQKYGSIFRQPQGLYVSLRDKGKVLEVLRNWPHRNIQVICVTDGEAILGLGDLGSQGMGIPVGKLALYTALGGVRPSACLPITIDVGTNNEKLLNDEFYIGLRQKRATGEEYHELMEEFMAAVKQIYGEKVLIQFEDFANHNAFNLLAKYSKSHLVFNDDIQGTASVVLAGLLAALKVVGRTLAEHTYLFLGAGEAGTGIAELIALEISKQTSAPIEECRKKIWLVDSKGLIVDSRKNSVQSFKKPWAHEHEPLTTLYDAVQSIKPTVLIGTSGVGRTFTKEVVEAMASFNERPIIFSLSNPTSHSECTAEEAYNWTQVVIFASGSPFDPVEYDGKVFVPGQSNNAYIFPGFGLGLVISGAIRVHEDMLLAASEALAAQATQENFDKGSIFPPFTNIRKISARIARAVAAKAYELGLATRLPPPRDLVKYAQSCMYTPVYRNYR

SEQ ID NO: 15234 - protein, 480 aa, Oryza sativa Japonica Group
MVQGCRCEVVDACVREVRLASPYRIHQIFRFTTPRRLALAHRGDTYKARDEGQCHWRDKAGSATRREGGESEGGERRRRRLMASPAVVAFAVAVAVAALAAFCGTDPLRTGSMVDFPGFVPHVVELPDASEMPPHADTRERLRGAEIRFRGEVQGPESVAFDPLGRGPYTGVADGRVVRWDGARWVYFAHSSPNWTAELCGHKASPLDYLKDEHICGRALGLRFDRRTGDLYIADAYFGLLKVGPDGGLATPLATEAEGVRFNFTNDLDLDDDGNVYFTDSSIHYQRRHFMQLVFSGDPSGRLLKYDPNTKKATVLHRNIQFPNGVSMSKDGLFFVFCEGSRGRLSRYWLKGEKAGTVDLFAILPGFPDNVRTNDKGEFWVAIHCRRSIYARMVSRNVRLRKFLLSLPIPAKYHYLMQIGGKLHALIIKYNPEGEVLDILEDTTGQVVRAVSEVEEKDGKLWIGSVLMPFIAVFDYANAS

SEQ ID NO: 15235 - protein, 499 aa, Ruegeria sp. PR1b
MNAASFTKSFWHDEAKKLEFRTKHLINGEWVDSEDGTTFDTINPATGETIAKVASGKAADIDKAVKNARETFKSGVWSMLAPRERLAVIERFSALIEENAVEFALLDCLDMGKPVMDMINIDIPESVKNLKFFAETADKVHGSLTATDPSVVHYILRQPLGVVGLITPWNYPLMMAAWKLGPALITGNSVVLKPAEQAPLSCALLGDLFLKAGGPAGVLNVVQGLGEEAGKAIGLHPDVDKIGFTGSTEVGKLLMTYAGQSNMKRVTTECGGKTPQIVFADYDNLDKAVTSAVYGIYGNMGEMCNAGSRILVQRPIYDEFIKRFSELTASNMVVGDPLDPDTTIGPLVTVEQQERVLEYIEIGKKEGATLALGGGRGLNSGCYVEPTLFTDVTNSMRVAQEEIFGPVGTVIPFDTAEEALEIANDSLYGLAAAVWTNDLKTAHRFGRDLESGFVWVNTFDIGDMTSIWGGYKQSGNGRDTCIEALSQYTQTKSVWMDMA

SEQ ID NO: 15236 - protein, 343 aa, Bordetella petrii
MTLACKIHGARDLRLETDDDAPLAPHEVELRLGAAGICGSDLHYYLHGRVGAFVIREPLIPGHEASGVVLRVGSAVTRVQPGMKVAINPSHPCGQCDYCRAGRDNLCRNMRFLGSASVYPHVQGMFRERFVMGERQLTAVHEDISLGELACAEPLSIGLHGVNRAGPLLGKTVLVTGGGTIGCMTVIAARLAGAARVVVADIADRPLQMARQVGADDTLRSDQAAPADIADSADVAIEAAGSPAALGTCLAAARRGGRIVQVGTLPAEGMVFPANNIMARELDYVGAFRAGIEFDWAVSFLRTRRVDVRPLMSAQLPLERAAEAFELAADRTRSTKVQLVCES

SEQ ID NO: 15237 - protein, 377 aa, Bacillus cereus G9241
MKAVTYQGPNKVQVKQVDDAKLEKKDDIIIKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEIFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 15238 - protein, 671 aa, Methanosarcina mazei Go1
MDLSVLAHVDVILGFAILILTIFSKFEVPPVLGFLVTGVLIGPHGLGIMDSGQNMEINAELGVIFLLFTIGVDLSLKDLWNMKKAVLVGGALQILFTTGIVLAVCTNLGFSHSASLFTGLLISLSSTAIVLKVLQDRNEVYTPHGKTSLAILIFQDLAIVPLILITPILAGSSVSFEGALPNIFFKGSLIILTFILSAKFVVPAIFYHVGKTGSKQLFFVSVVFICLSAAVFTYSIGLSLALGAFLAGIVISGSQYSQQAIGNIMPLKDMFMSFFFVSVGMLLDLHYLLDNLSVIILATISLIIIKLIAGSLVTFLLGCPLRTTILTGLALSQVGEFSFVLSRLGLEYSLLEEETYQTFLAVSILTMGVTPFLINASYRPADFIVKKVSDTTHGMKLINGIYSEPLYNEEMTEPQIKDHLIIVGFGFSGKTISKAAKAAGIPYLIIEMNPEIVQHEKAKGEKIQYGDATFGAVLEHAGIKNARVLVTGIADSSSTGKIVEKAKELNPNICVIVKVHDLQEMKRLNSMGADEIIPEEYETSVEIFVRLLEKYLVPRENIEKMVNDLRANGYRRLRKLVVEPGIDSGFSIKDGLPGIDIQVLKVGEGSSFQEKTLSELDFRRRHGVTIISVRRGTDMFHTPAGDFLLHAKDACVLLGKTEDLYNVRKFFESIQ

SEQ ID NO: 15239 - protein, 885 aa, Arabidopsis thaliana
MERHFVFIATYLLIFHLVQAQNQTGFISVDCGLSLLESPYDAPQTGLTYTSDADLVASGKTGRLAKEFEPLVDKPTLTLRYFPEGVRNCYNLNVTSDTNYLIKATFVYGNYDGLNVGPNFNLYLGPNLWTTVSSNDTIEEIILVTRSNSLQVCLVKTGISIPFINMLELRPMKKNMYVTQSGSLKYLFRGYISNSSTRIRFPDDVYDRKWYPLFDDSWTQVTTNLKVNTSITYELPQSVMAKAATPIKANDTLNITWTVEPPTTQFYSYVHIAEIQALRANETREFNVTLNGEYTFGPFSPIPLKTASIVDLSPGQCDGGRCILQVVKTLKSTLPPLLNAIEAFTVIDFPQMETNENDVAGIKNVQGTYGLSRISWQGDPCVPKQLLWDGLNCKNSDISTPPIITSLDLSSSGLTGIITQAIKNLTHLQILDLSDNNLTGEVPEFLADIKSLLVINLSGNNLSGSVPPSLLQKKGMKLNVEGNPHILCTTGSCVKKKEDGHKKKSVIVPVVASIASIAVLIGALVLFLILRKKRSPKVEGPPPSYMQASDGRLPRSSEPAIVTKNRRFSYSQVVIMTNNFQRILGKGGFGMVYHGFVNGTEQVAVKILSHSSSQGYKQFKAEVELLLRVHHKNLVGLVGYCDEGDNLALIYEYMANGDLKEHMSGTRNRFILNWGTRLKIVIESAQGLEYLHNGCKPPMVHRDVKTTNILLNEHFEAKLADFGLSRSFLIEGETHVSTVVAGTPGYLDPEYHRTNWLTEKSDVYSFGILLLEIITNRHVIDQSREKPHIGEWVGVMLTKGDIQSIMDPSLNEDYDSGSVWKAVELAMSCLNHSSARRPTMSQVVIELNECLASENARGGASRDMESKSSIEVSLTFGTEVSPNAR

SEQ ID NO: 15240 - protein, 133 aa, Zea mays
  misc_feature (99)..(99): Xaa can be any naturally occurring amino acid
MATIIAGTPTTSITRTGHVLKRPVGASSSTVLGLPAMAKAGRVRCSMEEKPSSSSNLGMGASLLAAAAAATMSSPAAMALVDERLSTEGTGLPFGLSNXLLGWILFGVFGLIWALFFVYTSTLEEDEESGLSL

SEQ ID NO: 15241 - protein, 138 aa, Microbacterium arborescens
MPTEETLVLVKPDGVARGLTGAILARIEAKGYALVDIRLVEADRELLERHYAEHAGKPFYEPLLEFMQSGPSVAIRLAGNRVIEGFRSLAGTTDPTTAAPGTIRGDFGRDWGLAVQQNLVHGSDSPESAARELQIWFG

SEQ ID NO: 15242 - protein, 418 aa, Pseudomonas aeruginosa PAO1
MGYQKIQVPATGDKITVNADMSLSVPKNPIIPFIEGDGIGVDISPVMIKVVDAAVEKAYKGERKIAWMEVYAGEKATQVYDQDTWLPQETLDAVRDYVVSIKGPLTTPVGGGIRSLNVALRQQLDLYVCQRPVRWFEGVPSPVKKPGDVDMVIFRENSEDIYAGVEWKAGSPEAEKVIKFLTEEMGVKKIRFTENCGIGIKPVSQEGTKRLVRKALQYAVDNDRSSVTLVHKGNIMKFTEGAFKDWGYEVARDEFGAELLDGGPWMQFKNPKTGKNVVVKDVIADAMLQQILLRPAEYDVIATLNLNGDYLSDALAAEVGGIGIAPGANLSDSVAMFEATHGTAPKYAGQDKVNPGSLILSAEMMLRHMGWTEAADLIIKGTNGAIAAKTVTYDFERLMDGATLLSCSEFGDAMIAKM

SEQ ID NO: 15243 - protein, 368 aa, Arabidopsis thaliana
MSSSNEPPRKTDQPSSSSASASASPSLFLSLPLEIISMILARVPKRYYPILCSVSKNMRSLVRSPEIHKARSLLGKDYLYIGFIDENYRPVYDYWYTLRRIENSTTENLFESIEFPYPSEPNRFSMNAVGPKIFFISESCTPSSRLSIFDTRFGELRQGPCLLVKRGYNCVGLVGGKVYVIGGYQDDEIAAESFDLNTQTWEAAPIPDEKESHRWICKANVSFDRKVCALRSREGMTCYDTRDGSCQRSEMPNDQWSRVGLCVIDNVLFVYFSRFGLMWYDSKLMLWRVVYGFDLDDARSVGIGEYYGKLAFIWEKPSLNVSESKEIWCRMIGLLRSEVGIHGAAEPSQLVEIVPNGYRMCHCLSLSG

SEQ ID NO: 15244 - protein, 76 aa, Zea mays
  misc_feature (12)..(12): Xaa can be any naturally occurring amino acid
  misc_feature (24)..(24): Xaa can be any naturally occurring amino acid
  misc_feature (52)..(52): Xaa can be any naturally occurring amino acid
  misc_feature (64)..(64): Xaa can be any naturally occurring amino acid
PGAVVGLVVFTXDDGGAWGGQGLXVFVVRVVTCPEDVGGVHAVVGFLAGVRXGLTFHAVVVARXGWGKCCVLGCSG

SEQ ID NO: 15245 - protein, 227 aa, Elaphocordyceps subsessilis
MKSTLLRPLLPRYKLCSPGSRSFPLPQLASASNTFRAARFFSATSAIMGNKVFFDIEWEGPVMQGGKPTSTVKEQSGRINFKLYDDVVPKTAENFRALCTGEKGFGYEGSSFHRIIPEFMLQGGDFTRGNGTGGKSIYGEKFADENGQLKHDRPGLLSMANAGPNTNGSQFFVTTVVTSWLNGRHVVFGEVADQESLDVVKALEATGSGSGAVKYNKRATIVKSGEL

SEQ ID NO: 15246 - protein, 177 aa, Haemophilus influenzae
IAAGISTERLNALIPSANAVVRVMPNTPVLVGEGMAGLFAPKNTSENHRTFAQDLLGAVGRTVWVDDETQMHAVTAASGSSPAYFFLMLEAMQQALIKMNIEEKTARELVQQSMLGAAKMVTENPQIALSTLRENVTSKGGTTASALAVFDAQHFNQIIEQAMQACLSRSQEMETLF

SEQ ID NO: 15247 - protein, 485 aa, uncultured marine bacterium 582
MREVKGYWQNYIDGAWVDGGAGRIDVINPGTGEKIAEQALADARDVDLAVQAAKRVHSTGVLTDMRPVERGRIVQAMGRYLLEHLEEIAALLSLEQGKPIWEARIEVTGAARYFEYYGNQAETLEGRSIPLGAGYFDFTTDEPYGVSAQIIPWNFPVEMTARSLSAALTTGNTVVVKPPEMTPLSNAWFAHAAEAVGLPKGAVNLVCGYGHQAGAALSAHPDINQVVFTGSVATGIAIASAAAKNVVPCVLELGGKSAAIVHSDADLVAMETDIRKGIFINAGQVCSAMSRIIVHESRHDELVQRAVSIAESLSVGPGADRQTFGANMGPMVSVKQRDRAAGLVSEAVSQGAKLVTGGRAMNIPGAFLQPTVLAEVTPEMTIAQTEVFGPVLSVLRFREDAEAIEIANGTDYGLVGGVFTRDLDRATQVARKIRAGQVFVNEWFAGGVETPFGGYGKSGYGREKGREALWNYVQTKNIAIKLKRT

SEQ ID NO: 15248 - protein, 421 aa, Vibrio angustum S14
MDIFKKQESKVRSYSNSFPVVFTKAKGSWLETEQGDRYLDFLAGAGSLNYGHNNPIFKQALLDYIEQDGITHGLDMHSTAKADFLEVLERNILAPRQLNYVTQFTGPTGTNAVEAALKLARKVKKRSSIVAFTNGFHGCTAGALAATGNQHHRQGAGTSLNNVTRIPFEGYADIDGLKLFETMLADNSAGMDKPAAVLIETVQGEGGLNVASNQWLQRLEKVCKQNDILLIIDDIQAGCGRTGTFFSFEPSGIKPDIVTLSKSIGGYGLPMAIVLFKPELDIWNPGEHNGTFRGNNHAFITATKALETYWADDQLEKHVAACSNIIANVIDKCLHDHPDMFVQRKGRGMMIGIECNDGDLSSQITKTCFENGLVIETAGPNDEVVKFFSPLTITTTELEQGLAIFENAVEHVVAKNFRKAS

SEQ ID NO: 15249 - protein, 606 aa, Aspergillus oryzae
MVFLNSESRSANSHAPRDSLELASLASSSPELDARSSSSSPSGISSSRKLSLEDEDPLSNSHVHSNLNSGGPRSARSYSVSSAFDFGRTLFPLSQTAGGYAPLGAPSALDRESGAADGSLERNKTLTYMNGLSLVVGLIIGSGIFSSPSQVNANAGSPGASLIAWVVAGLLAWTGAASYAELGGAIPLNGGSQVYLAKIFGELAGFLFTWCAVLVLKPGSAAIIAIIFGEYAVRAVVGAEVEQVNPWINKAVAFGGVLMVTLLNCISTRLAARIGDVFMFFKFIALLGVTIIGVVVAITGLSSNGSANEEWKSGWFKDTSVDISAWAVALYAGLWAFDGWDNTNYVTGEFKNPNRDLPRVLHTAMPLVILCYILANISYFLVLPHSTIEASNTIAVQFGDKVFGKAGALVFALIVSASCFGALNATIFTSGRLVYAAGKEGYLPSIFGHLWTRGSSASNRLQRRSWARQSISRLFGEHFRIGYTPINAMALNSALTLVYVIVGEFKTLVTFYGVAGYTFYFLTVLGLIVLRIREPYLERPYQTWISTPIIFCCVSIFLLSRAVIAEPLQTLIVVAFIVAGVPVYYWRIYQRDGQITLPGWKFWQAR

SEQ ID NO: 15250 - protein, 771 aa, Candida glabrata CBS 138
MAPKSASSGSKKKSSATSDEIKQPKFKLPTEYIIRPLPANSNSKESGTITVNSKVLSALEISSGSFCIISKFGENGIAAIANPSKNENHPANVILVSDTLRSVSNIILGDRVEIQKLTQQPAYAKSITVGPFEEGLANEKVKLVEKLLDDCGLIMPGMRFNEIATDNNEKLHFVVTDVDDDDLPDIGKLSLNADESETLEFMSKPVLFKKGLTKLKFTADKNVSKKYSLPQSLSYDAVGGLKCEIDLLKKAIDLPLHRPEIFADFGISPPKGILMHGPPGTGKTMLLRCVANASNAHVLSIDGPSIVSKYLGETESKLREIFNEAKKYQPAIIFIDEIDSIAPNRANDDSGEVESRVVATLLTLMDGTSSSGRIAVIAATNRPNAVDPALRRPGRFDQEIEIGIPDVDARFDILKKQFEKISTDKHTLSEGDIKSIASKTHGYVGADLTALCRESVMKTIQKALTENSTTDMTELKVGITDVESAMLEIRPSAMREIFLEMPKVYWSDIGGQEDLKRKMKEMIQLPLEAADTFAALGIKAPKGILLYGPPGCSKTLTAKALATESGVNFLAVKGPEIFNKYVGESERAIREIFRKARAASPSIIFFDEIDALSPDRDGSSTSAANHVLTSLLNEIDGVEELNGVVIVAATNRPDEIDSALLRPGRLDRHVYVSPPDFNARLQILKKCTKNFDLDNTDELLNDLATRTEGCSGAEVVLLCQEAGLAAIMDDIHTKKVDANHFEVALQGISKCITPEMLEYYQEFASRSGIAS

SEQ ID NO: 15251 - protein, 470 aa, Salmonella typhimurium LT2
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 15252 - protein, 677 aa, Candida glabrata CBS 138
MSTNWNTWKLKRISASNICQAFKEVTDNDTVLLIQSELFNYINHVITFSDLIKDTPVRKILRVDNNTTNDLRSILGSMPHIEIILLIDIRASLKIPFEIRNFLKEFKDLPVTIVYCSWQTEITDALIEKKDTVFLESYQLNNVRHLINHQLAITDRKIKLKKCTLYPFPTLDDDVLSLDILYSADNENRYVPYLQSIENASRDVMIDNISNCILSLLKEHKSIVTNFVGVGNEAQLLGQLLKSRIDRDIDEKQAFIREGLFGDKFPSGLETDLIVFDRSMDPITPLLTELTYAGMVNTLFDGYLDIEIDEEKVHFDYQKDDFWDEMKFMNFGSIGPRLNQSAKQLQKKYDDRHNAESLGEIKNFVDSLGHLQETQRYLKQHTITSTKILNEVENNEALQFNRIIEFEQDVLSDNLDHKACNDFIQDLIFEGDVASDLIIRLISLVSICKCGLREKDFLSIKKSMVDRFGINILFDIERLTEAGILVTKNTITKNKKAGTTEDLRAPYGRNVSNTIIKEYRSIAKWFATLPVGSNDDAQDISNPKEPDFAFCGVVPLSMRIIQAFYDRSILSKTYNAQQPYIISKEPKVTKLETLFSQVYCNSKHISSERWVPEPKVNKLPNTTGKKDNDDHPDIAIIVFLGGVTIGELATLKHLKGKLRDKGIKKRFLIITDGILKK

SEQ ID NO: 15253 - protein, 175 aa, Bordetella petrii
MNPYILTPDLNGEGLHIGIVRARFNEEIGQAELDACLQKLGELGVDERDIMVVTVPGALELGVALSHMAETFEFDALIALGAVIRGETYHFEVVSNEMARAISRISLETGIPVANGVLTVDTDEQAQARAAGKGGDCALVAVEMANLVAALEPEEDDEDEDEEDEDFDDEETDRR

SEQ ID NO: 15254 - protein, 447 aa, Salmonella typhimurium LT2
MKKVKKLSLTDLVLYGLVFMVPIAPVSLYGVVYNLSHGMVALVYIIGAIAMFFTAYSYSTLSQHISSSGSAYAYAGVCINPAVGFLTGWILLLDYLLFPTLVAVLGGVAVHAILPQIPVWVWPLIYVAIGTGVNYLGIQQTAKFDKLLVFIQLGILAIFVLLIVRLMLLDSSQITLSFRPFFDSQWFTPGLIATAISVAALNFLGFDAISTLSEESEGGGRAVSKATLLALVLATVLFIIVVAFAAFATGNVDRFAEGNATNEAFFTIAGNVGGIWLKVAFSIIVAFVCAVGNIITAQTAVSRVLFSMGRDRMLPAFLAHVHTTRKTPDYAILFTGGVTLLLSYLFSGKIESISTLVNFGALFAFFVVNLCVFILFNFRMKAQRRIFAHVISPIMGMIVIGYVCLNMNIHALILGISWAAIGIAILCYRKAHNQNIAIDLEGKKLLD

SEQ ID NO: 15255 - protein, 396 aa, Bordetella petrii
MSAPLASIAPGAAPESFGIASVAEIIAELRAGRIVILVDEEDRENEGDLVMAAEFVTPEAINFMVTHGRGLVCLTLTEERCRQLELPLMASRNGTRYGTNFTQSIEAAVGVETGISAADRARTIQVAVARDAKPSDLVQPGHIFPVRAVPGGVLVRAGHTEAGCDLTAMAGLTPAAVICEILNPDGTMARLPDLVEFARQHNLKIGTIADLIQYRSEHESVVKRVGDRSMQTAWGEFRAVAYQDTASGSAHLALVHGDIDPQRETLVRVHEPASILDALDAGATAHSWGVGRALQAIAKAPAGVVVLMNCQSSAEHLFQQIAGWSDTDARQPARDGDRYGLRTYGIGAQILRDLNVGQMRLLARPRKMPSMAGFSLTITGYDCDPSSSATSLKADT

SEQ ID NO: 15256 - protein, 358 aa, Aspergillus oryzae
MTLRPVLCRVTNRTPTARFLSATACRASSLRVPLDIPPPFPVTKSCPEPSCSCPTTPPMPYGLPIDYNQPLNGTMVAYAQQILICTGQRDWTSRIEDDGKRHTWGHLVRGLKRLLGRGGRYADMKPFNNILVSNSSFSPSAASTSTPSTASAFLFPSFKYFPSIPTEILDSTDAGTDLSTFVQAYLLPKKLSAMSESLPEVKKAELTRKPELECEFADVVDLDHSPVILICGHGGRDMRCGIMAPVLENEFRRVLGDKGFTLAGSGDHTIDSPGHAHVGLISHVGGHKYAGNVIVYIPPGMRKKSSSSPHSLAGKGIWYGRIEPRHVQGIVEETILGGKVVADHFRGGIDRSGDILRL

SEQ ID NO: 15257 - protein, 182 aa, Pseudomonas putida KT2440
MAIRSFQQHTPKVGPRAFVDRSAVVLGDVEIGEDSSVWPLTVVRGDMHRIRIGARTSVQDGSVLHITHAGPFNPDGFPLIIGDEVTIGHKVMLHGCTLGNRILVGMGSTIMDGAIVEDEVIIGAGSLVPPGKRLVSGYLYMGSPVKQARLLNDKERAFFSYSAGNYVKLKDQHLAEGYDQPE

SEQ ID NO: 15258 - protein, 662 aa, Photobacterium profundum SS9
MISTNLLLHKQSLNSTSMQTRRTRYTRKRQLNMAIEINVPDIGADEVEVTEILVSVGDKVEEEQSLITVEGDKASMEVPASQAGIVKEIKIAEGDTVSTGSLIMLFVEEKSEAEGAAAAPAVEAAAPVAAAPAAAELKEVHVPDIGGDEVEVTEIMVAIGDSIEEEQSLLTVEGDKASMEVPAPFAGVLKEIKIAAGDKVSTGSLVMIFEVAGSGASVAPAAPVAQAAAPVAAAPVASAAKEVNVPDIGGDEVEVTEIMVAVGDTVEEEQSLITVEGDKASMEVPAPFAGTVKEIKIVAGDKVSTGSLIMVFEVAGSAPAPVAQAAAPVAASAPAAKPAQAAAPAGDFQENNEYAHASPVVRRLAREFGVNLSKVKGTGRKSRIQKEDVQNYVKDALKRLESGAAASAKGGDGSALGLLPWPKIDFSKFGEIETKPLSRIKKISGANLHRNWVMIPHVTQWDNADITALEAFRKEQNAIEAKKDTGMKITPLVFIMKAVAKALEAFPSFNSSLSDDGASLILKKYVNVGIAVDTPNGLVVPVFKDVNKKGIYELSEELMAISKKARSGKLTASDMQGGCFTISSLGGLGGTAFTPIVNAPEVGILGVSKSEMKPVWNGKDFEPRLMLPLSLSYDHRVVDGAEGARFITYLNGCLSDIRRLVL

SEQ ID NO: 15259 - protein, 258 aa, Gossypium hirsutum
  misc_feature (138)..(138): Xaa can be any naturally occurring amino acid
  misc_feature (140)..(140): Xaa can be any naturally occurring amino acid
  misc_feature (151)..(151): Xaa can be any naturally occurring amino acid
  misc_feature (165)..(165): Xaa can be any naturally occurring amino acid
MASDQTLFHYCLLTLYIIALPTWISLYFLQAPYGKHNRPGWGPTISPPLAWFLMESPTLWLTFFLFPSGQHFYNPKSFLLISPFLFHYFNRTVLYPLRLARNTTQTRGFPVSVAFMAFGFNLLNGYLQARWVSHYKDXYXNEELFWWRFLXGLLIFVVGMWVNVXADKVLVGLKKQGDGGYKIPRGGLFELVSCPNYFGEIMEWFGWAVMTWSWVGFGFFLYTCANLMPRARATRLWYLEKFKDDYPKDRKAVIPFIY

SEQ ID NO: 15260 - protein, 157 aa, Haemophilus influenzae 86-028NP
MKVLEGSVAAPNAKVAVAIARFNSFINESLLEGAIDALKRIGQVKDENITIVRTPGAYELPLVARRLAESKKFDAIVALGTVIRGGTAHFEYVAGEASSGLGKVAMDAEIPVAFGVLTTENIEQAIERAGTKAGNKGAEAALTALEMVNLIQQIDAA

SEQ ID NO: 15261 - protein, 505 aa, Pseudomonas putida KT2440
MKAALPRELLASVVVFLVALPLCMGIAIASGMPPAKGLITGIIGGIVVGFLAGSPLQVSGPAAGLAVLVFELVRQHGMAMLGPILLLAGLLQLLAGRLRLGCWFRVTAPAVVYGMLAGIGVLIVLSQVHVMFDTAPQPSGLQNLLEFPATLSAALPQESTGAGWMAGALGLGTIAIMWGWERLRPQRLRFVPGALLGVASMTAISMWLALPVNRVQVPADLSEAIDWLRPEDLLQLADPTLLVAAFALAFIASAETLLSAAAVDRMHSGQRSDFDRELSAQGIGNMLCGVLGALPMTGVIVRSSANVQAGAQTRASAIFHGLWLLAFVVALSSVLQQIPVASLAGVLVFTGVKLVDFKAFRGLGRYGRMPMFTYAATALAIIFTDLLTGVLLGFALTLLKLAFKAARLKINLVSLAKDGHMELRLSGAATFLKVPALTQVLDTVPAGTTLHVPLGNLSYIDHSCLELLEDWSRSNSANGSRLLIEQRRLKRRIEGRLRTTAGVGA

SEQ ID NO: 15262 - protein, 329 aa, Rubrobacter xylanophilus DSM 9941
MVLSKVVVLSLGGTISSIPSSGPGVVPRLTGKDLVESVPQVAEVAEVEAESLRQMPSSDLTLEDLTEVALEVKERIDGGASGVVITQGTDSIEETAFAMDLLVQGDAPVVVTGAMRNPTLPGADGPANLLASVRVAASRAARGLGALVVMNDEIHAARFVKKTHTQSPSTFQSPSTGPIGWVSEGDVRVALRLPARHVLGMPPDGAGHSVALLKLALGEDGRLLPAVRQAGYAGLVVEAFGGGHVPSGMVGALEQLASEMPVVLASRTGSGDVLRRTYGFAGSEMDLLSRGLIWGGMLDGLKARLLLTFLLRHGKDREEIRAAFEKWYI

SEQ ID NO: 15263 - protein, 272 aa, Bacillus cereus G9241
MNKQIGFIGCGNMGIAMIGGMIKKNIVSPDQIICSDLNVINLKNASNEYGITITTNNNEVANSADILILSIKPDLYSSVINQIKDQIKNDVIVVTIAAGKSIKSTENEFGRKLKVVRVMPNTPALVGEGMSALCFNEMVTEKDIKEVLNMFNIFGQTEVVNEKLMDVVTSISGSSPAYVYMFIEAMADAAVLGGMPRKQAYKFAAQAVLGSAKMVLETGIHPGELKDMVCSPGGTTIEAVVTLEEKGLRTAIISAMKRCMQKSMEMSSLTSK

SEQ ID NO: 15264 - protein, 426 aa, Magnetospirillum magnetotacticum MS-1
MILLMFGVGLHFSIGDLLTVRAIALPGAIVQIGVATAMGAGLAWAFGWGAGAGLVFGLALSVASTVVLLRALEGQGLLDTDKGRIAVGWLIVEDLAMVVALVLLPALAPSLGGEAMSGSAQHGASAGLWVTLGLTLAKVSVFVAVMLVGGRRLVPYLLGLAARTGSRELFTLAVLASAVGIAFASSELFGVSFALGAFFAGMVLAESDLSHQAAADSLPLQDAFAVLFFVSVGMLFDPGIVLRAPLSILGVVGVIVLGKSLAAVAIVLAFGHPVGTALTIAASLAQIGEFSFILAGLGIALKLLPEEGRDLILGGALLSITLNPLFFVLSDRVSRWLGERPELRRRLERRSPAPPPLNNAAQGLRDHTVIIGYGRVGSAIGQALQDWNLPFVVVERDRRRVEDLRAQGVPAVFGDATAPGILDADD

SEQ ID NO: 15265 - protein, 208 aa, Microbacterium arborescens
MPSSRYILPQFEERTAYGYKRQDPYNKLFEDRVIFLGVQVDDASADDVMAQLLVLESQDPDRDIIMYINSPGGSFTAMTAIYDTMQYVSPQIQTVVLGQAASAASVLLAAGAPGKRLALPNARILIHQPAVGEAGHGQASDIEIQAAEILRMRTWLEETMARHTNRTQEQVNKDIDRDKILSAHEAMEYGIVDQVLTSRKRTPAAITS

SEQ ID NO: 15266 - protein, 430 aa, Xanthomonas axonopodis pv. citri str. 306 [sequence omitted]

SEQ ID NO: 15267 - protein, 416 aa, Claviceps purpurea
MTDIPGRRAFKCFNQEFVVDERYTVTKELGQGAYGIVCAAVNNQTKESVAVKKVTNVFSKKILAKRALREIKLLQHFRGHRNITCLYDMDIPRPDVFNETYLYEELMECDLAAIIRSGQPLTDAHFQSFIYQILSGLKYIHSANVLHRDLKPGNLLVNADCELKICDFGLARGFSADPEQNAGYMTEYVATRWYRAPEIMLSFQSYTKAIDVWSVGCILAELLGSRPFFKGRDYVDQLNQILHVLGTPNEETLSRIGSPRAQEYVRNLPVMPKKNFATLFPQANPHALDLLDKMLAFDPSSRISVEQALEHPYLQVWHDPADEPNCPTIFNFDFEVLDDVGEMRKVILDEVIRFRQMVRTASSAEPTTGQAQTAAAGQVPMPQAGGQWKAEDPRPQENTPQGNGLEQDLQAGLDAA

SEQ ID NO: 15268 - protein, 643 aa, Staphylococcus epidermidis RP62A
MKNNNETRRFSIRKYTVGVVSIITGITIFVSGQHAQAAEMTQSSSDSNEQSQQTEQVEHKEDTTHLSYELNQEGETASQSKTSQENQSDGNVQKKSNQIQQDSTQTSPLNDQKQTSMEQQSKDNHVTPNSRQDTYPKGQNQDDKGKQQFKDNQHSQTEHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 15269 - protein, 417 aa, Streptococcus mutans UA159
MATEIVMPKLGLTMTEGLINQWLVKEGDTVAAGDPVLEISSEKLTSEVEAPEAGVILKIVKGEGETVPCKQIIAWIGQEGEAVPDAAGDAPEVDTEAESEVASAGQTVVPEESRTVSAAPVAEKHEDGRIFITPLARKIAKEKGLDITYIKGTGGNGRITRRDVEAFNPASIPTAEPVTALSAPTNVNYGVGLTGIRKVIAERMMSSIHSSAQLTLHRKADVTPLMAFRQDIKTKVNAPLENGEIGITTLLTKAVTKALKDYPEANAWYAGGQYEEKEDIHIGMATALSDGLVVPVIRHADKLTLSDLGRTIKEEAEQVRKGTLDPSLYSGSTFSITNLGAQGIEYFTPILNAPEVAILGVGAIQKALTLDENGQVAEKQFLPLSLTFDHQVLDGAPAAEFLGAVISYLEDAYSLVF

SEQ ID NO: 15270 - protein, 462 aa, Coprinopsis cinerea okayama7#130
MAPVKVTKICCSGPTCAVIALKCPHIQVTIVDLNQARIDAWNSPDYKLPIYEPGLVDVVKQARGRNLFFSSDVDKGIEEADLIFVSVNTPTKKSGVGAGFAADLNYVELATRRIASVATSSKIVVEKSTVPCRTAESMRTILEANSKPGCRFDILSNPEFLAEGTAINDLLHPDRVLIGSLQTEEGLNACQSLCDIYSNWVPKDRILTVGLWSSELSKLAANAMLAQRISSINALSAICEATGANIDEVAHAIGYDTRIGPKFLKASVGFGGSCFQKDILNLVYLSESLHLPEVAAYWKQVVEMNEHQKRRFAKRVVDTMFNTITGKRIAVLGFAFKADTGDTRESAAITLIRDFQSEKAYVSVFDPQVEEEQIWQDLQEASPLVPLEQIKKQVTVHKSAMEACKGAEAVVIATEWKEFLQIDWEEVYQTMNKPAFVFDGRLLLDADKLRKIGFKVTTIGRP

SEQ ID NO: 15271 - protein, 225 aa, Lotus japonicus
MAPVKGPLTPIQVENLQFPASITSPATAKSYFLGGAGERGLTIEGKFIKFTGLGVYLEDKTVDSLATKWKGKSSQELLDSLDFYRDIISSPSEKLIRGSKLRPLSGVEYSRKVMENCVAHMKSTGTYGEAEAAAIGKFAEAFRNLDFPPGSSVFYRQSPDGELGLSFSPDDTLPEKEAVVIENKALSEAVLETMIGEHAVSPDLKRCLAERLPAVLNQGLLLSGN

SEQ ID NO: 15272 - protein, 274 aa, uncultured marine bacterium 582
MKAIIRKAVFPVAGFGTRFLPVTKAMPKELLPVVNKPLIQYAAEEAIAAGCDTLIFVTGRNKRAVEDHFDSNLELEAALRAKGKHAEAESLRNIVPPHVKCIFVRQPEQLGLGHAVLCAERAVGDEPFAVLLADDFLIGAVPGVMTDLIEAYTLSGKSQISVMQVDGPQISQYGVVRPGAGVNEVAGLVEKPALQDATSNLASIGRYLLTPDVFDILRDQSPGYVGEVQLVDAIDTMAAGAAVCQVPLTGLRFDCGSLQGYLDAIKYVTDHKLY

SEQ ID NO: 15273 - protein, 219 aa, Lactobacillus acidophilus NCFM
MQIYFVRHGKTEWNLASRFQGGHGDSPLLPQSLEDIKKLGQHLIGVKFRGIFASPLDRAFNTAQGIDNAMNANLPVVIDERLREFNLGDMEGMKFEEAEKKFPEQMNNFWHHPDKYDPTELHGEDYMHVIGRGKSFAEEMAKRFPDDNDKVLAVSHGAALSAIMGGLLGYPLKDIRKNGGLSNTSLTILETLDGGKTFKPVVWNETSYLGRKLSKTDSL

SEQ ID NO: 15274 - protein, 408 aa, Salmonella typhimurium LT2
MFKEERRHAIINLLIKDNSVSVSKLSDLYKVSQETIRSDLRYFQKSGMLQRCYGGGILNRDALSKLITENKIDISSTIATPIHQDAKLRRENPKKAGKVCVLGSFNIDVSATVPWFPQSGESILASQFGFYPGGKGANQALAANNAGAAAHFIFKVGKDQFSAFAMNHIIQSGITSYSAYQTDKAPTGSALIYVSAVDGDNIIAIYPGANMMLTTQEINEQHRYIAESDVMLMQLETNIEALTEFIRLGKQENKMIMLNPAPYTKQVTHLLSDIDIITPNETEASFLSGVTITDINDAKKAGNIILQSGVKKVIITLGARGSLICEHARTLYIPAWSAVVKDAAGAGDAFNGALAAALARQADMVAAIQYASAFASLAVEQVGASSMPQHLQVLHRMRTQSNKVIHIN

SEQ ID NO: 15275 - protein, 261 aa, Vibrio angustum S14
MDIFVVDAFTDQHFKGNSAAIMPVTTFPDASLMQRIAAENNLSETAFIKPTGDNTYAIRWFSPLTEIDFCGHATLASAFVLYQFYQLKGEITFTTEQVGTLTVKQAPNGNIEMNFPCQPGEEVEPPAALLKGLSITPTKVLKNRQAYIAVLPSEQAVQDVVCDSEQLKQLAPHDIAVTAQSTQYDFVSRYFWPANGGYEDPVTGSIHTALAPYWAEQLGKRELTAYQASQRGGVLQCKMIDNNRIIIAGSAVLYLRGKVYL

SEQ ID NO: 15276 - protein, 445 aa, Streptococcus mutans UA159
MAKYDLLIIGAGPGGYIAAEEAARLGKKVAVVEKKDIGGTCLNVGCIPSKAYLQHSHWLLSMQEANKYGISTNLESVDFAKLVNRKDQVVSTLQGGIHTTFKSLKIDYYEGQAQFLKDKSFMVNGEKISGKDVILATGSHPFIPQIHGINSVNYLTTDSFFNLKVLPEKLVIIGGGVIAIELAFAMQPLGVNVTVIEIAPQILLTEDKAARAIIRKKLKTMGAHIFEAAKIEEVHAQSVILEGDGAQEFDQLLVATGRKPNTELAQEMGLKLTERGFVKVDDYYETSTPHVYAIGDLTESYMLAHVASMEGIKAVRAICRQAQDPVDAQGVPRSLYTNPEVASFGLSEEEAKEQGYDVLVEQLPFSFNGRAIASTETQGFVKLISERRYHQILGAVIVGEHGTDLLQQLILLRQAEGTFDQVVDAVYAHPTISELIQEVAKRIVQ

SEQ ID NO: 15277 - protein, 214 aa, Triticum aestivum
  misc_feature (182)..(182): Xaa can be any naturally occurring amino acid
  misc_feature (185)..(185): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSXNFXQNGSHGIEYGDMQLIAEAYDVLKSVGELT

SEQ ID NO: 15278 - protein, 505 aa, Agrobacterium tumefaciens str. C58
MRTPKPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVAPTLLQLMNVPLPPEMTGKSLIDL

SEQ ID NO: 15279 - protein, 318 aa, Prochlorococcus marinus str. NATL2A
MASASSSLASKLTPLSKSNFLSSSDLNSDQILSLFELAKQLKTGNRRIDLGNRVLGLIFKKASTRTRVSFQVAMARLGGQTVDLNPQITQLGRGEPIKDTARVLSRYCDALAIRTFSQQELEEYAEWSTIPVINALTDLEHPCQSLADYLTIQEKFGELKGINLSYIGDGNNVANSLMICGAMLGVNVKICSPKGFEADSKIVEKAKSLSEFGSKISICNDPLKAMKHAQVLYTDVWASMGQEEEHLKRKKIFENYKVDQKLIELADEGAIIMHCLPAHRGEEITEEALESKSSHVFDQAENRLHVQQALLAVQLGGI

SEQ ID NO: 15280 - protein, 349 aa, Oryza sativa Indica Group
MGNREVLVVAFFIRSIYGGVQIVTKIAFNRGMSTTVFVFYRHAIAILFLVPVAFVVERKTAPPLSYKILLKLFVHALYGIAGSVNIYGLGLSYSSATSSSAISNLLPVVAFFLAVLMGMESLNLKRIHGIAKVFGVLFSIVGVIILAFYQGPELKSLNLQHLSSRNVVPTGSTVYTTKAWTSGIFLTVLSTTSWALWTVLQIVLPQGLMLEVYPSKLLNTTIQMVFATIQCFFIALAVERDFSRWKLGLDAGLIAVIYSGALVSGLAYYMQVWVIDKSGPVFLAMTMPITLIVTIVISSFVLGEAVTLGSIISGVVMVGGLYCVLWAKKAEQAIASKEEATLPVQATQV

SEQ ID NO: 15281 - protein, 398 aa, Dehalococcoides ethenogenes 195
MDNWQELEHKYYMQTFYRAPITIVKGQGAKVWDDKGKEYLDFVAGWAVNSLGHCHPAVVKAVSEQAGTLIQTSNNFYTIPQLKLAKLLVDNSVLDRIFFCNSGTEATEGAVKLARRYGKLKLKGAYEVITATGSFHGRTLAMVSASGQSKYQEPYTPLPTGFINVEYNNPQAIKTAITDKTCAVMLEPIQGESGVNVPDKGYLKAVRQICDEAGILLILDEIQTGIGRTGKLFAYEHSGIEPDIITLAKGLAGGIPIGAFMAKESASVFAKGEHGSTFGGNPLACAAGYAAMKFILDNHISENAGSMGSYLAEGLEKLKIKHSLIQGCRGCGLLMALDFKTNIAKEIVESCLEEGLLLNAVKPNALRFMPPLNITQADIDAAIAKLDSVLTRHESCGV

SEQ ID NO: 15282 - protein, 272 aa, Dehalococcoides ethenogenes 195
MNVSQVSNHIVVIKLGGSVLSSKDTSLKDIAALKQLGLKPVLIHGGASTVSDWSAKLGLETRLVNGERVTDDPTLDVVAAVLTGLVNKEIVAALLDMGVQAAGISGVDGATITGQMRATETGYLGDVTAVNTGLINALLDKDITPVISPVSFHHTKRPSGSRRLININGDPAAGEIAAALQAERLVFMTDVPAVKGKNGEALGEISAEHAAELLSSGTASGGMIPKLRSCLKATLAGASACIIDGRIPHMLVRELTEGNCGTTIIGQHLRRS

SEQ ID NO: 15283 - protein, 281 aa, Arabidopsis thaliana
MSTSAASLCCSSTQVNGFGLRPERSLLYQPTSFSFSRRRTHGIVKASSRVDRFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQQSTIHLHRTVNQIKSLGAKAGVVLNPGTPLSAIEYVLDMVDLVLIMSVNPGFGGQSFIESQVKKISDLRKMCAEKGVNPWIEVDGGVTPANAYKVIEAGANALVAGSAVFGAKDYAEAIKGIKASKRPAAVAV

SEQ ID NO: 15284 - protein, 601 aa, Kluyveromyces lactis NRRL Y-1140
MVLTPFLLLLGFCEALSPHVLNNQPDIALDIDRSPTLTPNQELLKIGSKFAIASDLELCSNMTLHKVFLDFPGSNAVDAAVTVALCIGMINFFNSGIGGGGFAVVSTKEESVTYDFRETAPLLSNNTMYDGLGDFASVVGGLSIAVPGELAGLYDMWSEYGSGKISWQNVLQPVIDLGYHGWEIQEVLGASLGAYEYFLRMNFEDWQFVFNEDGSIKKKGDWLKRPTLAKTLEVLAKNGSVAPFYDPNSYLVKSMVSKIKERGGIITREDFSLYKAEKQKPLSVLIRSGWENMPNNDLTVLTSSGSSSGAALIAALKVLDAFPSVTGGDYSTQQTYELVEAMKWLASARSRLGDYGGGDELPSRIQKVLNDPWIQHAVLKIKENGNDSNFRTLPNWKDYHPAYEMNEPHGTAHFSVVDDKHNAVSLTTTVNLLFGSLVHDPVTGVIFNNEMDDFSIAGRSNSFGLAPSAYNLIEPGKRPLSSCVPTIILNELGFPDLVVGASGGSRISPSILQVIVRKYWYQMPLLETIAYPRVHHQLLPDILEVESFPMVGKALIAELVKMGHTPKEMPSRSVVNGICRVNAEWHAVSDYWRKRGIAAAM

SEQ ID NO: 15285 - protein, 342 aa, Pyrococcus horikoshii OT3
MEKYEELFARIKEKAKLIDEKIFELIPEKDPRVLYEAARHYPLAGGKRVRPFVVLTSTEAVGGDPLRAIYPAVAIELIHNYSLVHDDIMDMDETRRGKPTVHRIWGVNMAILAGDLLFSKAFEAVARAEIPPEKKARVLEVIVKASNELCEGQARDLEFEKKSTVTIEEYMEMISGKTGALFEASAKVGGIIGTDNEEYIKALSSWGRNVGIAFQIWDDVLDLIADEKKLGKPVGSDIRKGKKTLIVAHFFENADEKDKQRFLKIFGKYAGDVKGRGIIEEDIKSDVMEAIDLLKKYGSIDYAAEIAKDMIKKANEALRILPKSKARMDLELLAKFIVEREY

SEQ ID NO: 15286 - protein, 486 aa, Bacillus pumilus SAFR-032
MTKTDVQMLKNYIGGQWIEAETSQTEAVYNPATGKIIAEVPLSTKKDVERAVQAAQEAFTTWSKTPVPRRARILFKYQQLLVDKWDELAELVTMENGKSITEAKGEVQRGIECVEFAAGAPTLMMGKQLPDIASGLESGMYRYPIGVIGGITPFNFPMMVPCWMFPLAIACGNTFVLKPSERTPILAARLAELFEEAGLPKGVLNIVNGAHDVVNGLLEHQKVKAISFVGSQPVAEYVYKKGTEHGKRVQALAGAKNHSIVLKDADLDAATKQIIGAAFGSAGERCMAAAVVAVEEEVADDLIQKLVDESNELVIGNGINEEVFLGPVIREEHKERTLQYIQSGIEEGASLIRDGRKDHETNGKGYFVGPTIFDHVTNQMKIWQDEIFAPVLSIVRVSSLAEAIDLSNQSKFANGACLYTDSASSIREFRENIEAGMLGVNIGVPAPMAFFPFSGWKDSFYGDLHANGTDGVEFYTRKKMVTARYM

SEQ ID NO: 15287 - protein, 347 aa, Solanum lycopersicum
MAGESISGNLKDLSLNRNGAVSKKSHLVVCFGEMLIDFIPTVAGVSLAEAPAFEKAPGGAPANVAVCISKLGGSSAFIGKVGDDEFGRMLADILKQNNVDNSGMRFDHDARTALAFITLTAEGEREFVFFRNPSADMLLRESELDVDLIKKATIFHYGSISLIDEPCRSTHLAAMDIAKRSGSILSYDPNLRLPLWPSEDAARSGIMSVWNLADIIKISEDEISFLTGADDPNDDEVVLKRLFHPNLKLLLVTEGSAGCRYYTKEFKGRVNSIKVKAVDTTGAGDAFTGGVLKCLASDASLYQDEKRLREAIFFANVCAALTVTGRGGIPSLPTQDAVRQTLAEVTA

SEQ ID NO: 15288 - protein, 355 aa, Cochliobolus heterostrophus
MAEFVRAQIFGTTFEITSRYTDLQPVGMGAFGLVCSAKDQLTNQAVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLANKFKNAEPDAVDLLENMLVFDPRKRVRAEQALAHPYLAPYHDPTDEPVADEKFDWSFNDADLPVDTWKIMMYSEILDYHNVDAAVPEQENNGS

SEQ ID NO: 15289 - protein, 178 aa, Microbacterium arborescens
MVVSSSATILPLGESRPRLHPTVFVADGARLVGDVTIGELSSVWYNAVVRGDRSRIEIGDRSNVQDGVVIHVDAQSPARIGDDVSIGHNAVVHGCTVEDGCLIGMNSTLLSGAVIGAGSLVAGGAVVLEGTVIPPGSLVAGVPAKVRRALTDDERGGLRRNAATYLQLAVEHGAVAIE

SEQ ID NO: 15290 - protein, 390 aa, Candidatus Protochlamydia amoebophila UWE25
MQRHSVILKPGKDKAIRNYHHWIFSGAVQSYPSFKDGQILPVCASSHQLLGYGYFNRRSGIVGRMVSFNNVPPLETLKKRLISAWKFRQQLFDFRQTNAYRFVHGEGDAIPGLTIDVYQDVFVLQSSTKGIDELKPWIIETLNELFQPRSIFEKSILPSRKEEGLADVQKHLSGEEVGDISFFENGLKFTTNLHKSQKTGFFLDHREMRQWIKTLSFNKKVLNAFSYTGGFSVYAMAGGAKRVDSVDISQEAVNACQKHFVLNELSEFGSRFICADVFNFLREDVLDYDLVILDPPAFAKKQKDVIAACRGYKDINRLAMQKMPRRSLLLTCSCSHHVNELLFQKVVFQAAAEANRNVRLIGRHQLACDHPINLFHPESDYLKSFLLYLD

SEQ ID NO: 15291 - protein, 326 aa, Bacillus cereus G9241
MIKDYSVQIEGQEKVCLDQWVAHYRTYATKGRSASYIPALGEINVSQLGICIVKPDGTMIKSGDWEVPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLPFQDGCGIGIYGPAIDEYGNSLPGIMLLEHIAKEWDLSIF

SEQ ID NO: 15292 - protein, 614 aa, Glycine max
MSYDKNPSPVPTSTTGDEEKKVTGGGYDVGVYSAHGRVDHNARAVDGHDLNDSYDPSKESLLTRLGLNIESFKRAPGTTRGLVAHGDIPPEYLQHDNPLLQQKMKPRHLQMIAVGGSIGTGLFVGSGASLGNGGPAAVLMAWIIMGVMLIMVTQALGEMAIIYPVSGGFYTLASRMLDPSFAFAMGWNYVLQWAVVLPLEITVAGTTVQYWTDKVPLGVWITIFFLLIIFFATLGTLGYAEEEFWSSCLKLAVVIMFIFIGIVCICGGGPASGDYGSYVGGRYWQNPGAFANGFKGVCAMFVTAAFSFAGTELVGLAATETPNPRKTLPSAVKNTFWRITIIYITSLTIIGLLIPYDDPDLFGGSGANVSPFVIVLDRANIGGLNHLVNATICISVLSIGLSCVYAGSRTLTALAETGYAPKMFTYVDKSGRPLYSVLAILAFGPIAYVNLANVGTDVFNWLLALSGLSTLFTWLAICVTHIRFRQAWKIQGHSVEELPFTAIAGVWGSWLGAILIVIVLIAQFYIGLFPLGGVESGNARAESFFLSYLAFPILLAFWVVGYAWKRTLPRKTTEIDLDTGRKSWLTVEEMRQYKAERRLAPWWKRIYRMLFTSS

SEQ ID NO: 15293 - protein, 166 aa, Xanthomonas axonopodis pv. citri str. 306
MSFNFRIGQGYDVHAFGPGDHVMLGGVRVAHSHGVLAHSDGDVVLHALCDAMLGALALGDIGRHFPPSDARWKDADSAQFLQHCDGLLRERGWRVGNADITVICERPKVGPHAVAMRERIADLLAIELDAVSVKATTSEQLGFTGRGEGIAAQAAVLLGRIAAPHQ

SEQ ID NO: 15294 - protein, 324 aa, Nostoc punctiforme PCC 73102
MSVIFFPPPIQQINSEIIRSAGVDLYVLRLDLMHPWVNGNKWFKLKYNLLEAKEKNFTTLLTFGGAYSNHIYATAAAGNLFGFRTIGVIRGEERLPLNPTLNFAVQQGMQLVYTNREMYRQRNTPVVEEYLQQRFGEVFIIPEGGSNLNGVRGCMEIIGDAMSTAVTERSRSAGYAYAFDRICVACGTATTLTGIALSLHQGQRAIAFPVLKNGSFLAQEIESLLTNYLASDLPTPSNSPAFWELVCDYHFGGYAKVNKELLLFSQQFREEHGIPLDYVYTAKMFYGVMDLLKQGFFSKGDSLLLVHTGGLQGNVGMEERFQRM

SEQ ID NO: 15295 - protein, 299 aa, Rubrobacter xylanophilus DSM 9941
MRSASPAGVEGFLALREVIEEYLEGLRFTEEPALERLQEAMRYSLLAGGKRVRPLLCMESASLFGAPPERVLPSAAAIELIHTFSLIHDDLPAMDNDDFRRGKPTSHKKFGEAMAILAGDAFFGESLALITDHQEGSAEQVLAVVRELAHATGLAGLAGGQALDLEHTGRRAGPKELELTHHHKTGALIRASARIGAILAGAGEEGLEAISRYATELGLCFQIVDDVLDAVGSSERLGKRAGGDAERGKATFVSVFGLEGARREADAACERALRALGRLEGRDTSRLEALALFVRDRDR

SEQ ID NO: 15296 - protein, 239 aa, Gibberella zeae PH-1
MYENLQLERREDVFILTLQKPPENRLTSQFCQEIIRALNDVRKELGPDAPGAVIIRGNDTKFFCTGLDLYERDTNPYASSEGFYPLVATLLDFPFPTICLITGHTFGGASVMTLAHDYRIMNAARGYWCMPVAELGLHFDGMGALLRAKLRPQTARKVILQGHKFTSSEALADGIVDEIAPPEEMLDRALELANTVKSKAKMGVYGLLRGELYGEALRAFQQISYVHSRLNSRQAKVKL

SEQ ID NO: 15297 - protein, 398 aa, uncultured marine bacterium 582
MTVALSGIAQRGFDTAEFARRCALAQAVMATQNLGAVLLASEAEIRYFTGFMTQFWQSPTRPWFVVLPATGAPVAVIPTIGVPLMRACYVSDVRSWASPAASDDGISLLLDTLRQHLGHKGRLGVLMGRETALRLPLGDIFVLTTALDDVEMCDVTKQMQQIRMIKSVAEIDKLRHVCATVSDVFDSVPDWVAAGMPLSELFRQFKIKALQAGVDDVSYLVGSAGQGGYRDIIAPPTDRPLQHGDIFMLDTGCVWDGYFSDFDRNFAVGDASDAAHQAHHQLYDATEAALAIVRPGIRAKDLYAAMDAVLRPGVAVGDEASGGDDVGRYGHGLGIQLTEPPSHTHWDETVIEAGMALTLEPSIVYGDGYLMAAEENILVTATGAELLSRRWGRDLRII

SEQ ID NO: 15298 - protein, 221 aa, Lotus japonicus
MALPSVTALQVENVAFPPTLIKPPASANTLFLGGAGERGLHIQDKFVKFTAIGIYLQDTAVPSLAVKWKGKPVDELTESVQFFRDIVTGPFEKFMQVTMILPLTGQQYSEKVSENCVAIWKHLGIYTDEEGKAIDKFVSVFKDQTFPPGSSILFTVLPKGSLAISFSKDGSIPEVESAVIDNKLLSEAVLESMIGAHGVSPAAKQSLASRLSELFKHHAEV

SEQ ID NO: 15299 - protein, 297 aa, Haemophilus influenzae
MSVKGDIGVIGLAVMGQNLILNMNDHGFKVVAYNRTTSKVDEFLQGAAKGTNIIGAYSLEDLAAKLEKPRKVMLMVRAGDVVDQFIEALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQ

SEQ ID NO: 15300 - protein, 226 aa, Lotus japonicus
MAPAKGSSLTPIQVENLQFPASVTSPATAKSYFLGGAGERGLTIEGKFIKFTGIGVYLEDTAVDSLATKWKGKSSQELQDSLDFFRDIISSPSEKLIRGSKLRPLSGVEYSRKVMENCVAHMKSAGTYGEAEATAIEKFAEAFRKVDFPPGSSVFYRQSTDGKLGLSFSLDDTIPEEEAVVIENKALSEAVLETMIGEHAVSPDLKRCLAERLPIVMNQGLLLTGN

SEQ ID NO: 15301 - protein, 324 aa, Dehalococcoides sp. BAV1
MLKLSSIYAPINEGLKGVEDEFKLVSESRKKSFPEMAEMLDYILVGGKVLRPALSMLSAMCFGAGIKKVLPLATSSEMLHIATLVHDDAIDKADTRRGRRTVNAVWGLEKAILLGDFLFAHAAETAAETGNMGIVTLFSQTLQIIASGELKQAYASFNPDQSYENYLERISGKTAALFVMATKGGAILADASPSDEEIMRSYGYNLGLSFQIVDDILDFVGNAKDMGKPIGSDLNNGTVTLPALLLMDRYPDNNPIKDMLNATDRIPHVAKAVEMINSSDIIDLSYKEAKRYADLACRNLSQLPKTAARESLYQLAEFIVERKN

SEQ ID NO: 15302 - protein, 603 aa, Vibrio angustum S14
MNKVLSQINIFPIKSTQKISLSQAYVKSAGIDLDRRFMIALTDGSMITSRRYPQLLLISTTIESNGLLFNYPNKPPLSLSFEQLALMTTSTAVWNDNCEAYTTSSDADLWFSEIIGQPAQLLYNGVESQRTGGKAQVKVSFADNFPVMIVSEASLNALNDRTQEVHSMDKFRANLVVSGVNAFAEDSWKRIRIGEVELEIMAPCSRCVLVNYDPSTAKKADNNEPLATLMTFRTDKVIPTNVNFGMNAIVVKEGIVRQGDQVEVLEHRTPETYPDQRVALTCVKREIIAKDFVSFSFKAQKDTALAPYLPGQYLPIRIAINGNIVERCYTLSSSPLEQEYTISVKRIEQGTVSNWLHDNLQVGDTIWSEKPSGQFYLELHKHQNTLLLSAGSGVTPMMSMLRSLISEKNTQGLTFYHYCKTQTDIPFAAELAEIQRNHPEISIHICLTQDNDTSHAYHGRICSEHFANIDIQDNYHAYVCGSSGFNQIAQELLRNQGLPTDRFHQELFNKVLTKPEQEQSLNIQYKQQQFTGNNQTSLLDQIEAAELPIKSGCRAGLCGRCKVKVAEGNVLQQDSAALSEEEKQQGVVLACCSIPTSNITIEQ

SEQ ID NO: 15303 - protein, 637 aa, Streptococcus mutans UA159
MIILQGNKLERSFSGDVLFDNINLQVDEHDRIALVGPNGAGKSTLLKILVGEETATSGEVTLKRDVTLSYLAQNSRFKSDNTIYDEMLHVFDDLRATERHLRSMEGQMAELVGNDFDKLMADYDRLSESFRQQGGFTYESDIKAILNGFKFDESMWQTKIAELSGGQNTRLALAKMLLEKPELLVLDEPTNHLDIETISWLENYLVNYQGALIIVSHDRYFLDKVATVTLDLTPHSLDRYVGNYSKFMDLKAEKIAMKEKNYEKQQKEIAKLEDFVQRNIVRASTTKRAQARRKQLEKMERLDKPDASKKSANMTFHVDKASGNEVLKVTDAAIGYDDKILAQPIDLDVRKMDALAIVGPNGIGKSTLLKSIMGQIPFIHGSSVYGSNVQVGYYDQTQSNLTASNTVLEELWSAFPRTAEVDIRNRLGAFLFSGDDVKKSVAMLSGGERARLLLAKLSMENNNFLILDEPTNHLDIDSKEVLETALIDFDGTLLFVSHDRYFINRVATKVLEISQNGSTLYLGDYDYYLEKKAEREAKTEFLQPMQSGSPSSSLAAATNYQAQKANQKEERKLKRRIAEIEERLETIEARETEINEAMLTTNDFTQLADLQKELESVQTEQLELLEEWEELSRQLED

SEQ ID NO: 15304 - protein, 162 aa, Haemophilus influenzae
MKPYLIAPSILSADLARLGDDVQNVLNAGADVIHFDVMDNHYVPNLTFGPAVCQALRDYGITAPIDVHLMVKPVDRIIPDFAKAGANYITFHPESSEHIDRSLQLIRDCGCKSGLVFNPATPLSYLDYVLDKVDVVLLMSVNPGIWWTIFYSSNIEEITTGS

SEQ ID NO: 15305 - protein, 142 aa, Dehalococcoides sp. BAV1
MERTLLLVKPDGVNRGLSGEILGRMEKLGLKLIGLRMLQMDAVLADKHYAPHRARPFFKDLVTYITSGPITAAVFEGENAVEKMRKAMGATDPAKSEKGTVRGDLGIDIEQNTVHGSDSAENAKHEISLFFSESELVNYDRR

SEQ ID NO: 15306 - protein, 214 aa, Chlamydomonas reinhardtii
NSNVKKSAFIKSSTRVADCPPDRIPEFAFIGRSNVGKSSLINSLTNNDRLAKVSKEPGMTKLINHYLINDSWYLVDLPGYGFAKAGKSNREEWLRFTKDYFITRDNLVSVMLLVDSSLPPQASGPGWRTVDRDCADWLAECEVPFCIVFTKIDNRKKDMPTNAANVKAFKQMMAEEWEALPRCFETSSKTGTGKSELLGYLASLRELHVRSGRM

SEQ ID NO: 15307 - protein, 375 aa, Chlamydomonas reinhardtii
MPCQAISNRRHPAFALCANPPQEIVFSSYINLMLLCAPLGWASAYFKWGAVATFSLNFLALIPLALILGDITEDLAVRFGDVVGGLINATFGNVVEVMVSLFALFKNLFTVVAASLLGSILSNLLLVMGCSFLLGGMYHSVQTFNAMSNRACSSLLMLACIGISIPSAASMLLVTDPALRADWILDVSRGTAVIMLICYACYLTFQLKTHSELFKGDDDDAVPMMTVGTSIGALTVITAIVAVCSEFLTDSIEEVSAHTGISETFIGLILLPIAGNACEHLTACIVAMRNKMDLSMGVAVGSSIQIALFAIPFAVVVGWATGHDFSLDFSPFSAMVLAVCVIHANFVTADATSHWLLGVQLIALYCVIAVAYFYR

SEQ ID NO: 15308 - protein, 188 aa, Streptococcus pyogenes MGAS8232
MILLIDNYDSFTYNLSQYLSEFDETIVLYNQDPNLYDMAKKADALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 15309 - protein, 451 aa, Oryza sativa Japonica Group
MVLRRFAWPYGGQRASFCGSFTGWRECPMGLVGAEFQVVFDLPPGVYQYRFLVDGVWRCDETKPCVRDEYGLISNEVLVDNTHPVVQPETSIRVVSMDEGTILTTMPPDQLSQNSGVQIAIFRHRVSEILLHNTIYDVVPVSSKIAVLDARLPVKQAFKIMHDEGLSLVPLWDDQQQTVTGMLTASDFVLILRKLQRNIRTLGHEELEMHSVSAWKEAKLQFYGGPDVAAIQRRPLIHVKDSDNLRDVALAIIRNEISSVPIFKPSTDSSGMPLLGLATLPGIVKFICSKLQEQPEGYSFLQNQIVSMPIGTWSPHTGKASNRQLRTSRPSTPLNSCLDLLLEDRVSSIPIVDDNGALLDVYSLSDIMALGKNDVYTRIELEQVTVEHALELQYQVNGRRHCHTCLSTSTFLEVLEQLSAPGVRRVVVIEPRSRFVQGIISLRDAFTFLIG

SEQ ID NO: 15310 - protein, 266 aa, Streptomyces netropsis
MVSSHSAFDSGELTELAVTAAREAGQILLRGAEEGPVRASAKSSRTDLVTVFDRRSEDHIVGLLTAHRPDDGVLGEEGGERPGTSGVRWVIDPLDGTANYVARYPAFVVSVAAELDGVGVVGVVHDPSRQETFSAERGRGARLNGRALHVPHAADGLAEVLLSTGFSSDLAVRARQAALAARIACRVRDVRSSGSAALDLCWVAGGRLGAYYESDTRHWDRAAGALIASEAGAWVGDLDGGPASDRMVIACTPGVEQGLRTLLGHA

SEQ ID NO: 15311 - protein, 166 aa, Chaetomium globosum
MATLQSGSSFPEGVSFSYIPPTGDLDLTVCGIPTTYDASKEFQTKKVVLVAVPGAFTPTCQEQHIVSYLSHLAELKAKGVDKVIFIASNDAFVMSAWGKANGIKDESILFMSDAGAAFSRSIGWASADRTGRYAVVVDHGKVTYAEADTTRGSIEHSGAGGVLAKL

SEQ ID NO: 15312 - protein, 282 aa, Chlamydomonas reinhardtii
MANPETAAVAINVLNKVIRYAVGLGVGASILQTSLYNVDGGERAIIFDRFRGVLDEPVGEGTHFRVPWVQQPNIMDIRTRPRSISSVTGTKDLQMVNMSLRILSKPDEPRLPHIFKTLGMDWEERVLPSIGNEVVKAVVAQYNAEQLITQRERVSRSVRESLMARAADFGIVLDDVAITHLSFGTEFTRAVEAKQVAEQDAERAKFVVMKAEQERNAAIIKAEGESEAAKLISDATKQFGYGLIELRKIEAAKDVAETMSKSRNVVYLPNTGNMLMQVNPNQ

SEQ ID NO: 15313 - protein, 441 aa, Streptomyces netropsis
MSHSVTLPSTKDIIELERRHRLPGGQSMTDLAGIVVDRAVNAEVWDRDGKRYIDFFTGVGVSNIGHSHPAFLEELTTQLSRCAVGTFYTDVRSRYFALLAAQLPEQLGEIHMFSTGSEAVEAAVKLARAATGKHEIVSFWGGFHGKTQGALSLHGGPRKHRSGPFPPGSHQVPYADCHHCPLQLEHPECGQRCVDLAEQSIENGSVGDLAAVIVEPVQGTNGNIIPPEGYLRTLRQLADRHGALLILDEVITGFGRTGALFAFEHDPGIAPDVVVLGKAMASGVPASAIVSRSGLVEGTSFAVPSAAASTFGGNPLASAASLATLRVLLDERLPERSHELGKSVSDRLSAWREEFPFVGNADNIGLMIGVELVDPATRLPLPKGITRRLFQELMARGVLAMAYDSRIRLYPPLSIPTHHLEEGLAAFEGAFRAMAPAISRL

SEQ ID NO: 15314 - protein, 230 aa, Bacillus pumilus SAFR-032
MSAIFSPSLMCMDLTHFREHIHILNTRADRYHVDVMDGHYVKNITLSPFFIEQLRKLTDKPIDVHLMAESPQEFLIDACIDAGASMVCLHPEVVQRDVFRIIRHIHQRDCEVGFVLNPATPIAVLDSYLHLIDRVTIMTIDPGFAGQPFIKEMLQKIKQVKEVKEKKGYSFSIEVDGSCNEHTFRQLAEAGNEIYIIGNSGLFGLHQQLDTAWETMKQLFSKETASIESH

SEQ ID NO: 15315 - protein, 294 aa, Hyphomonas neptunium ATCC 15444
MFRDGLMKDERILVTGGGTGLGKEMAEGFLKLGAEVHICGRRGGVLEETAKELMAKHGGKVVPHACDIRVAEAITEMNDTIWSKHGPLTGLINNAAGNFISRTEDLTIRGFDAISNIVFRGTFYMTHDIGKRWIAEKRRGNVCSILTTWVWNGGPFVVPSAMSKAGVNVMTQSLAIEWGRHGLRFNAIAPGPFPTEGMSKRLSPDAEGAERMDRGVTNPMGRVGEMHELVNLATFLMAPGAEYVNGQTIAIDGAMYNASGGNFSMLTAWGDEQWVAAREAIEATNAKDRAKRTV

SEQ ID NO: 15316 - protein, 434 aa, Brassica insularis subsp. insularis
SYTLLFFVILFLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPEDTLLQEMKLGRNLIGSENEKILTSWKSPTDPSSGDYSFILETEGFLHEFYLLKNEFKVYRTGPWNGVRFNGIPKMQNWSYIDNSFIDNNEEVAYSFQVNNNHNIHTRLRMSSTGYLQVITWTKTVPQPNKFWSFPEDTCDLHKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTEELDDMRKYDAGGQDLYVKVAAASLVPS

SEQ ID NO: 15317 - protein, 318 aa, Bordetella petrii
MDQQVQLVATGDVGNFIVVDCAPQAPGPGEIRLRHDGIGVNFIDIYHRMGLYPLPLPAVLGVEGAGTVEAVGEGVSNVRVGERVAYAGIPGAYAATRLLPAWRAISLPDGIDTKVAAVSFLRGMTAHMLLTRVYPAARGTIVLVHAAAGGLGATLTRWAHDLGCTVIGTASSPEKASLAREHGADHVIVGRAADVAAEVARLTDSRGVDFAVDGIGGDMLRKTLASTRPLGVVASVGQAGGPIPPVAVSELRPMLVRPSIMAYAADQEAYAVAAQAVIAAIRQGIVRGAAHEYPLARAAQAHGDLESGKTTGSVMLAP

SEQ ID NO: 15318 - protein, 423 aa, Oryza sativa Indica Group
MDRFKMIKEVGDGTFGSVWRAINKQNGEVVAVKKMKRKYYSFEECMSLREVKSLRRMNHPNIVKLKEVIRENDILYFIMEYMECNLYQLMKDRVKPFSEAEVRNWCFQIFQALAYMHQRGYFHRDLKPENLLVSKDVIKLADFGLAREVTSVPPYTEYVSTRWYRAPEVLLQSSIYDSAVDMWAMGAIMAELLTLHPLFPGTSEADEILKICNVIGSPDEQSWPQGLSLAETMKFQFPQVSGNQLAEVMTSVSSEAVDLISSLCSWDPFKRPKAAEVLQHTFFQGCTFVPPTVRSKAGVLPKTPPCVGVKGVSEHGMPRRYSTGTLSTTKPHSNASLKSSGLSKTGHPVLRHSRSLPETGRATMHKVSTLTERLSHMSVTSRTRTTPKPAAPLLKAGLGKSDLLGKTDEIPPAKRLTRKLVFV

SEQ ID NO: 15319 - protein, 413 aa, Hyphomonas neptunium ATCC 15444
MFEFSSYHILLVALGALILLSHWVPRYFSGREPASSALLMSGGVALSFLMPDLADWLSPLNANKLWEVSTELCVIIGLFGVGLSIDNITAKGKWRSTVRLLLILMPATMLLTILAGTLLVGLALPAAVLLSAVIAPTDPVLAKDVQVGPPSQGKEHPVRFALTTEAGLNDGLAFPFVYLGITMIAAGTLSSDLLMEWVARDVLYKIVVGVIVGIVLGKMLGHIVFRLPRNNPLSETQADILALTGIVLTYGAAELAEGYGFIAVFVAGAMLRQQSAEDKFHGRLYSFIQALEHTLTAILLIGLGAVMPGVLADLKFEYVLLVILLIFVVRPVVGWLALSGTGLNGRQKFVTAAYGIKGIGSVYYLAYAQSHLPDFEGLKALWTITVLLIFSSTIIHGLSAGFALSRATERDVK

SEQ ID NO: 15320 - protein, 916 aa, Oryza sativa Indica Group
MLDKQKKEEKNIKLREWRARSAQKAESKFGEEGVTNDAIMQNLTQTELLAKEKKDEKNRKLREWRAKRKAQSNSVDGGGASATVMQNLTHAQLLAKEKREKSRKQREWHEKSAKRKAESNNVPDEVTSYRTIHTPTSCHSQVTKSQKVADKENHDPDDPNDWLHRNDVYKPRFNVRKASNLEQTGAGLVIGENIRYKGVEDAKCVDNDFEGVSQVLEDDGYESYRVDVIGVIGISTDDPHDRVYHKLPKTHHVLKKVPDCKHCQAIRFQFESPGFCCREGKINVKIPTVPDELIRLFTSQVHNDAKYFRKHIRYFNFHFSFTSLGVTLDQRVSTAAGTGVYTFRVHGALYHRLDNLVPGSQGPCHMQLYFYDTEDANALAHRVRRSPDLDINLVRVILRILVQNPYVQTFSRVGSMSNLDDYMIELNTNVTPDQRRYNAPTASQVAAIWLEGDDPMKTFDRHVLVHAKGDKPCYIKAYHGCYDPLAYPLFNPNGETGWNLKMLYNDPNQILCDVEMDETCEASTFGDVHTNEESTFNDLPDNEDDNDDSSKSGKGKKDKFVTAREYYCFRLQGVVDVLSSGETSGSAVGKRIVLPRSFPGGDRDMQRRFLNAMALVQCFGRPDYFITMTCNPYWDEITEHLEPGQQPQDRPDLVARVFRAKLRDVLDLIVKKIYFGEPQIRSWLLQGCNLQPQHPFENRRARSRRKMDANRRQGGIQQLLAAEQEAQQIVNAARSAKSARLRQAKEEAEREIAEYRAQMEAEFQRKVAESSGDSGANVKRLEQETDTKIAQLKEQAANVSPEVIQMLLRHGPVIFVPDGAVLLLGYFVNYGAGKWVILKDDESETATSMDADCRRLRDRSTTRRAADRRLPDCAGACPCRASFGSPCGAGGVVSAPRHRRRMAVRRRADIVTLLHC

SEQ ID NO: 15321 - protein, 544 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVYIGGAESEGHFSLINQACSMFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 15322 - protein, 210 aa, Pseudomonas putida KT2440
MQVKNPILGLCQKAKFALSAAKVEQCPDDQGYEVAFAGRSNAGKSSALNTLTHASLARTSKTPGRTQLLNFFSLDDERRLVDLPGYGYAKVPIPLKQHWQKHLEAYLGSRECLRGVILMMDVRHPMTDFDKMMLDWAKASSMPMHILLTKADKLTHGAGKNTLLKVQSEIRKGWGDGVTIQLFSAPKRLGVEDAYRVLADWMELEDKPVV

SEQ ID NO: 15323 - protein, 370 aa, Medicago truncatula
MGGVTSSMASKFAFFPPNPPSYKLIKDDLTGLLLLTPYPHRENVEIMKLSTRRGTEIVAVYVRHPMATSTLLYSHGNAADLGQMYELFIELSIHLRVNLMGYDYSGYGQSSGKPSEQNTYSDIEAVYKCLEESFGAKQEDIILYGQSVGSGPTLDLAARLPQLRAVVLHSPILSGLRVMYPVKRSYWFDIYKNIDKIPLVNCPVLIVHGTSDEVVDCSHGKQLWELCKEKYEPLWLKGGNHCDLELFPEYIRHLKKFITTVEKSPSQRYSFRRSTDQFEQPRKSTDKFEVSRKSTDRREKPRKSTDKPEKVKNSSSSNGGDMLEKLRMTFDHKERSRRSVDCHEKSRKSVDHQLEKGRKSVDRLDRIRTG

SEQ ID NO: 15324 - protein, 95 aa, Brassica napus
MAEVDNQLEIKFRLTDGSDIGPKAFPDATTVSALKETVISQWPREKENGPKTVKEVKLISAGKVLDNNKTVKDYRNPVSNLVGAVTTMHVIIPTS

SEQ ID NO: 15325 - protein, 451 aa, Staphylococcus epidermidis RP62A
MANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAERYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIRGRGLMYGVELVENKSTQTPLDIPTVELIIRRCKENGLMIRNLENVITFVPILSMSNKEIKKMVKIFNKALHQTLGKK

SEQ ID NO: 15326 - protein, 449 aa, Agrobacterium tumefaciens str. C58
MQGRGDADPYRMARSCVKGRNMSTNYLSAASVRTKNPAGVIATCGLMIMFDGYDLVVYGAVAPALLKESTWALNPAMVGRAAALTLVGMLLGALFAGTMADRIGRRKVVLLSLAGFSAMMIASAMTPNFLAFEITRFFAGLGLGALLPTVTALVLEFSPPQRRAQANSLSFLGYLIGGIISGILGMLLLESYGWRPLMLIGGLPLILLPIFMRFLPESPEWLASKGRQAEADGICDSYGLQRIVPHAKMQKGGVGALFSEGRLASTLNAWGIHFCSLLLTFGMVNWLPTIMNKMGYDISSALSFSVMLNVGAAIGILIGGRFADKGNVKVVVAILFAVGAASIFALTANKGPLLYVFVALAGAGTIGTQILANVLVGRLYPVHIRGTGLGFSLAVGRLGGIAGPMIGGLVLQRGLAPEWNFYIFGSVAVVGLMLTVLTLLYRTSGDARV

SEQ ID NO: 15327 - protein, 568 aa, Vitis vinifera
MSIRTHILTRYLTHFLPNFFPEESFQNLASYKTALSHTCFRLKDRLLNRSSVANEMLLFQESENAMKKCLTWWDLVWMSFGSVVGSGIFVITGQETRYDAGPAIILSYAVSGFSALLSVLCYTEFAVEIPVAGGSFSYLRVELGDFVAFIAAGNILLEAIVGAAGLARSWSSYFASMINTDTDFLRIRVSYFADGFNLLDPIAAVVLLIADGIAMSGTRRTSILNWISSVLSFMVILFIIVIGFIRGKTSNLVPFFPYGARGVFRAAAVVYWSYTGFDMVATMAEETKNPTRDIPLGLVGSMSMITVVYCLMALVLSMMQKYNEVDANAAYSVVFEKIGMTWAKYLVSICALKGMTTSMLIGGLGQARYMTQIARAHMIPPWFALVHPRTGTPINATLLMAIPGATIALFSSLDVLSSIFSFSTLLIFMLVAVALLVRRYYVKDTTAKRDLVKFLACLIVIIGSSIGIAVLWNSNTTEWVGYAVGAFLWFLGTLGMGLLPKQRVTNVWGVPLVPWLPSLSIGMNLFLIGSLGYQAFLRFFICSAVMLIYYFLVGLHATYDMARQNQQA

SEQ ID NO: 15328 - protein, 442 aa, Kineococcus radiotolerans SRS30216
MTAELLAAPFSDAELAALRADFPILTRSTRSGKPLVYLDSGATSQKPRAVLDAERRFYETRNAAVHRGAHQLAEEATDDFEAARAAVAGFVGAPAHEVVFTKNATESLNLVAHAFSTTTAYAQRGTAPAGQVVDPRFVLAEGDEILVTEAEHHANLVPWQELCARTGAVLRWVPVTDGGILDVDALEGLVGERTKVVAFAHASNVLGGVAPVARLVAAARRVGALVVLDACQSVPHLPVDLPALGVDLAAFSGHKMLGPSGVGVLWGRAEVLDAMPPFLTGGSMIELVRMERSTFAPAPQKFEAGVPMAAQAVGLHAAVDYLRALGPDGSGVARVEAHERALTARLLGELAELPWVRVLGPQDAADRVGLVAFTVEDVHAHDVGQLLDDEGVAVRVGHHCAWPLHRRLGVTASTRVSFGPYNQGSDVDAVLRGLHRVRVLFA

SEQ ID NO: 15329 - protein, 255 aa, Dehalococcoides sp. BAV1
MSSINVSVKDPGFESEEAQARKRYMLQLFGFQAKHYDLHDDIMGMGIHRRWGKEMVLEILTYTRNMPQVKMLDLACGTGFVTFNTLRYMKNVDIDAFDITPEMVEVAKGRLKKNFADRSVKFWVGDAEIPYGDAKYDVIGTCFAFRNFANKNLAAANIFKALKPGGLLVLQDMTKPEKQPMRGIYLFALKNLMPVMARIIGTEKRSARYLANSVLAMPSNAEITAILQNQGFINIKSRYQSGGMGTLTVAYKPEN

SEQ ID NO: 15330 - protein, 502 aa, Aspergillus nidulans FGSC A4
MKPPYYMETGCKRNPGSDSTLKVRWTLYTRLLQSANQGLGIDPGSGQVFASCPTNTVADVDAYVSSAHRSFLSYRETNPRARAKMLLNWHNLIAQSKNDIAKLVVYETGKPMAEAVGEVDYALGFAWWFAGEAERVRGSIAQPSISERRTFVIKQPIGVCIALVPWNFPVAMIIRKAAAALAAGCTVVIKPSPETPLSVLALADLALQAGFGPGVINVLTTDNLNTPDVSEALCKHPLVRKVTFTGSTAVGQLIARHCSEGLKKVTLELGGNCPFIIFDDGDLEQALAALMILKWRTAGQACTHANRVYVQSGVYDTFLRMIVNATKQLKVGHGASPGTTMGPLTTSRGIEKLERHVADALAKGARLELGGHRLQLEGNYFQPTIISGMSAYMLTTQEEIFGPLLGLYRFETEEEAVRMANDTSMGLASYFFTRDVSRTWRLLENLEAGMIGMNTGNSSAAESPFGGIKASGYGKEAGKDVAIEEYLIAKTGTLTVGAVSKL

SEQ ID NO: 15331 - protein, 321 aa, Prochlorococcus marinus str. NATL2A
MFKTIRFSWIKRKQIFSFLVVSTIIFFSLFTNPNTASAASGGRIGGGSFQAPSSPQRQNYGGYGGNNFRGYGGGYRGGGIGFPFLLPIFGFGGGGIFGFLILMSIVGVIVNSFKSSSNFSNASNNSIVSQSTNPSKVSLIQFQIGLLASAKEIQVNLRGLAASSNTSTSSGLQRVLQDTTLSLLRKPELWVYSNIETGSVPYTSAESTFNRISITERSKLKAELTSNYSGQISSSTNKQSNPGDSDSTNEYIAITILVATKKDLSLQNSANTEVITEALRILGSISSNDLIALEVIWQPDGEGETLREEELIIQYPNLKHL

SEQ ID NO: 15332 - protein, 450 aa, Staphylococcus epidermidis RP62A
MSKSYDLIVIGAGPGGYVAAIRGAQLGKNVAVIEKNNAGGTCLNVGCIPSKTLLEHGEKAHSIRVANDWGITTKDLKIDFTQFVQRKKKVVQTLTGGVKQLLKKNKVTYIEGEARISKNLKVDVNNETYQAKDIILATGSQPFIPPIDGLDQVNYETTDTFFDLEKLPKQLAVIGGGVIATELASSMADLGVRVTIIEVADDILLTEINETREMLKAHLDNQGIKILTKAKIKQVKESKIILDGQDDVSFDTLLVATGRQPNTQVAKDLNLEMDGKFFKVNEHYETSQKHVYAIGDLIKGYQLAHAASAHGIHVVETIMNKQPSLVRQEDITRCIYTRLEAASVGLSEEQAKEAGYDVKVTQSAFQGNAKALIKGENEGFIKLVVDKKYGEVLGAFIVGPHATDIIGELLSVKASEGTIHELSQIIQPHPALLEAIGESADAFFDSAIHM

SEQ ID NO: 15333 - protein, 465 aa, Streptococcus mutans UA159
MSHQNAKNTTQNPKELENGMVRGLQNRHVQLIAIAGTIGTGLFLGAGRSISLTGPSIIIVYLLTGLFMFWMMRAMGEMLYHDPDQHTFINFITKYIGKEWGYFAGWSYWVSVIFLGMAEITAIAKYVQYWFPSWPAWIIQIVFLLILGSVNLIAVRVFGEAEFWFAMIKIIAILALIATAIFMLLTGFKTSQGPVSFANISKGFEMFPNGWMKFLMSFQMVFFAYQAIEFVGITVSETQNPRKVLPKAIQEIPMRIVIFYVGALIAIMTIFPWRALPSDTSPFVMVFKLAGIKWAAALINFVVLTSAASALNSTLYSTGRHLYQLANEAPNQFMKRFKIGTLSKTGVPSKAIIFSAIVIAISAFINVLPGIKDAFALITASSSGVYIAIYVLTMLAHLKYRKSNDFMADGYLMPHYKILNPITIIFMVFVFITLFLQDSTYIGAIGATIWIAAFGFYSKFKFKKQ

SEQ ID NO: 15334 - protein, 295 aa, Oryza sativa Indica Group
MYPIRQQFGFGFGFVCASRSSVVEPVQLHSNGNSDHTPKKSSESSLILIRHGESLWNEKNLFTGCVDVPLTPKGVEEAIEAGKRICSIPIDVIFTSSLIRAQMTAMLAMMQHRRKKVPIIVHNESEQAHLWSQVYSEETRKQSIPVITAWQLNERMYGELQGLNKQETADRFGNEQVHKWRRSYDIPPPNGESLEMCAERAVAYFKEHVVPQLTAGKHVMIAAHGNSLRSIIMQLDKLTSQEVISLELSTGIPMLYIFKEGKFIRRGSPVGPSEASVCAYTRKLAQYRQKLDSMV

SEQ ID NO: 15335 - protein, 346 aa, Pyrococcus horikoshii OT3
MNLRGKMIVIKFGGSSLRSEFKSAVSLIKALSEEKDVVVVVSALKGITDLLEKYTDTFDSRYAVEVSKTYLEFGKRMGIDTSSLSPYLKQLFNPPDLPPQALRDYILSIGELLSAAMIAEKANGAVIFPWDLFVAHGSFGNGFIDIKKSKRNVKLVKEALESGKIPIIPGFIANLNGYRVTLGRGGSDYSAVALGVLLNSELVAIMSDVEGIFTADPKMIPYSLLIPYMSYDEILIASKYGMEAIQWKAAKLAKEYEALILFGRASDWRMGTVVSNSSSHMPLLSYDQGKLLVMNMDSEIPYEVVEEGEFWRVYRVPKRDSIKIIKELHRKIIYQENAQLLGRVKA

SEQ ID NO: 15336 - protein, 196 aa, Lactobacillus acidophilus NCFM
MIIKSSEYAVSAVKEEQYPKDNLPEIALAGRSNVGKSSLINTLLKRKNLARTSSQPGKTQTLNFYLVNDDFYLVDVPGYGYAKVSQKRRQEFGEMIQDYLETRPNLKGLIILIDSRHEPTKDDISMYEYAQYLNIPILVVCTKMDKIKKNQTNKVMTGLRKKLDLNYDHVTVLTFSSVTKFHVTELGNWIEDKISQ

SEQ ID NO: 15337 - protein, 742 aa, Halobacterium salinarum
MNEVQLEVAKAYPNDSGRGIARLDPDTLLHLKLSPGDIIDIEGAETTAAKVWRADRQDWNTDTIRIDGFTRQNAEVGIGERVKIRKADAEKADTLVLAPPEEASVQFGSDAAGMVKRQILKRPVVARDIVPVMSSTNHPFMRSPGQAIPLIAVETEPEGVCLVTEDTDVELREEPISGFERTGGGITYEDIGGLENEIQRVREMVELPMKHPQIFQKLGIEPPQGVLLHGPPGTGKTLLAKAVANETSASFFSIAGPEIISKYYGESEQQLREIFEDAKDDSPSIIFIDELDSIAPKREDVTGEVERRVVAQLLTMMDGLEGRGQVIVIAATNRVDAVDPALRRPGRFDREIEIGVPDEIGREEILKIHTRGMPLSDDVNLSTLADDTHGFVGADIESLSKEAAMRALRRYLPEIDLDEEDIPPSLIDRMIVKREDFKGALSEVEPSAMREVLVELPKITWDDVGGLTEAKNNVKESVEWPLNQPEKFTRMGVEPPAGVLLYGPPGTGKTLMAKAVANETNANFISVRGPQLLSKWVGESEKAIRQTFRKARQVAPTVIFFDELDSLAPGRGQTGGNNVSERVVNQLLTELDGLEEMEEVMVIAATNRPDIIDPALIRSGRFDRLVQVGQPGIEGREQILKIHTQDTPLAADVSLRELAERADGYVGSDLANIAREAAIEALRDDEDADDVGMAHFRAAMENVRPTITDDLMEYYDQVEDQFKGSQGPNVNSRQGSEHIGFQ

SEQ ID NO: 15338 - protein, 408 aa, Prochlorococcus marinus str. NATL2A
MSKLRFDVVSLFPEAFKNFFNHGLIKKAFEEKIASIHIHNPRDHAMDNYRKVDDEPYGGGAGMVLKPEPYFSVFDQIPKLNKKRILLMTPQGRKISQPDFSRWSKEDQLILICGSYEGFDERIRSLADEEISIGDFVLTGGEIPAITLINGVVRLLPGTLGSAESLKEESHNEFLLEHPQYTRPAEFRGMKVPDVLLSGNHKLIREWRQKQREIRTKSRRPDLFELWKLDQLSFIKRSSLLKTEVNLRIGNGYDMHRLVSGRPLILGGVELNHPEGLGLDGHSDADVLTHAIMDAILGALSLGDIGKYFPPDDPKWKNADSLILLGHVMELIENKGWQIQNIDSVIVAERPKLKPYIDLMKEKISKTIGLNIDDVGVKATTNEKLGAEGREEGICCHAVVLIKRNENS

SEQ ID NO: 15339 - protein, 185 aa, Arabidopsis thaliana
  misc_feature (102)..(102): Xaa can be any naturally occurring amino acid
  misc_feature (144)..(144): Xaa can be any naturally occurring amino acid
MASSILSYAAVVTSPAQTTMVAPFTGLKSYAAFPATRKTNKDITSIASNGGRDNCMNVWPPIGKNKLETLSYLPDLRDVKSAKEGDYLLRNKWIPCVEFQLXHGFVYREHGNTPGYYDGPYWTMRKLPLLGCTDSAQVLKEVEXCEKEHPGAFIRIIGFHNTPQVQRISIIGYKPPSLTAAKSLL

SEQ ID NO: 15340 - protein, 451 aa, Lactobacillus acidophilus NCFM
MKVVKFGGSSLASGQSVEQALNIILNDPERQVIVVSAPGKRNNADTKVTDLLIKYAEQVLKHEETDAIVKQIFARYQEIGYFFGLNDEKLQIIQNILLALPNQNYPDNNYLMAAFKAHGERLNARLIALILQHENIKSRFLDPVDAGLIVTGEPNDALVNPESYLNLDQIKIDPNEKIIFPGFFGITPSGNIATFSRGGSDITGAILARGFHANIYENFTDVNGIFAANPNIVMHPISIKKMTYREMRELSYAGFSVFHDEALIPAIQGQIPINVKNTQEPDNPGTMIVPEKNFSPDNTITGVTSQKHFSALYLHKYLLNKEAGFTLRILQILYKHNIPYEHMPSGIDDITIIFNNDFLNDQLIDQICNEIQATINPDQLEWIDDYAIIMVVGEGMKKTPGVSRQILDSLASQGITPRMINQGASQISIMIGTKKEKADKAVKIIYQDFFN

SEQ ID NO: 15341 - protein, 303 aa, Streptomyces netropsis
MRGILLAGGTGSRLWPVTRAVSKQLMQIFDKPMIYYPLSTLMMAGIREILIITTREDQPGFRRLLGDGSHLGIEITYAVQECPEGIAQAFLIGSDFIGAETVALALGDNIFHGQAFGRRLRAHRNLSGARVLAYPVADPSAYGVVEISETGAAVSVEEKPEKPKSRYATVGLSFYDHRVVDIARGLRPSERGELEITAVNEEYLRRGELAVTVLDRGTAWLDTGTFSAMVQASEYVRVMEERQGLKIGCVEEVAWRCAYIDDDQLRELGRPLLKSGYGDYLLALLDEPRTHHGFPLPAAEDAW

SEQ ID NO: 15342 - protein, 278 aa, Zea mays
MAAAAVAGSRSREERWSLAGKTALVTGGSKGIGRAIVEELAGFGVRVHTCARTAADLDERLRAWAADARLPGRVTASVCDVSARGDREALVAAARAELGPRLDILVNNAGQSMFRAATETAAGDYARLMATNLESCFHLAQLAHPLLLAAGAGAGAAVVNVSSIAGLVAYPALAAYSATKGGLNQLTRSLAAEWAGDGVRVNCVAPGGVQTDMFSSVALEMDPETSLRMMEAELARVPLRRFGETEEIASLVAFLCMPASSYITGQVICADGGRTIAA

SEQ ID NO: 15343 - protein, 307 aa, Corynebacterium glutamicum ATCC 13032
MSLPIAQHQNAVKTVVVPAAGMGTRFLPATKTIPKELLPVVDTPGIELVAKEAADLGATRLAIITAPNKDGILKHFEEFPELEATLEARGKTDQLNKVRAARELIATVPVVQEKPLGLGHAVGLAESVLDDDEDVVAVMLPDDLVLPFGVTERMAEVRAKFGGSVLAAIEVAEDEVSNYGVFKLGELDAESESEGIRRVVGMVEKPAPEDAPSRFAATGRYLLDRAIFDALRRIEPGAGGELQLTDAIALLIEEGHPVHIVVHEGKRHDLGNPAGYIPAVVYFGLRHAEYGSKIHRAVKEILAEFES

SEQ ID NO: 15344 - protein, 184 aa, Ustilago maydis 521
MSSIGSAVASSSRTLLRSNTRQVARTAIRSFATTRAASNTPAPAVDAKISTIVDQIEKLTLLEAADLVSHLKTRLNITEIAMPAASAAPAGAAAASGAAEEPAEEAAKPKEKSVFTLKLTGLKDPTAKAKVIREVKAANSNMNLVEAKKFVESTPQVLKEGLNKEDAEKLKTAIEAAGGTVELE

SEQ ID NO: 15345 - protein, 242 aa, Candidatus Protochlamydia amoebophila UWE25
MSTYNKNRPQTIQIMFNSIAKQYDRTNAVLSFCLHRRWNLELVKKVQSQQTSHTLLDLCAGTGDVAFSYLNQVSAPCQAYLVDFSSEMLACAEEKAKSFGKTPHSFQYVLADVQRLPFSNQTMDCATMAYGIRNIHHPLQSLQETYRVLKPGGCLGILELTRPENKFLQIGHQLYLKTLLPLLGKWLTANENAYQYLRKSIHTFIPPGELEELVKTAGFINTGRYSLAGGIATIITGFKPMK

SEQ ID NO: 15346 - protein, 166 aa, Oryza sativa
  misc_feature (32)..(32): Xaa can be any naturally occurring amino acid
  misc_feature (100)..(100): Xaa can be any naturally occurring amino acid
  misc_feature (148)..(148): Xaa can be any naturally occurring amino acid
TKSSPTHPVELNEVKLIDGYYIMDPAKASGYXVDENTICIVAIPRSTLNGEYEDVKLLNDLLTKKNAETGWDTPIHVNAGSGWFIAPMLYPELKWDFRLXLANSMIISGHKYGLVYAGIGWCIWTSKEDLSEELMFHMNYLGADQPTXTLNLWKGCSHVIAHDYQL

SEQ ID NO: 15347 - protein, 272 aa, Medicago truncatula
MVKYIVKDANMLVFVTPHQFMEGICKRLDGKIRTDAEGISLVKGMEVKKEGASMISTLISNQLKINCSVLMGANIANEIAMQKFSEATIGYRENKEAAERWVQLFNTPYFNVTSVQDVEGVEMCGTLKNIVAIAAGFIDGLEMGNNTKSAIMRIGLKEMMAFSKLLFPSVKYSTFFESCGVADLITTCMGGRNRKVAAAYARNGGKRSFDELEAELLKGQKLQGVLTAKEVYEVLTARGWVERFPLFTTVYEISSGLLPPSAIVEFNNKSKL

SEQ ID NO: 15348 - protein, 720 aa, Oryza sativa
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQALIRRLASSHEVLLTVEEGSIGGFGSHVAQFMALDGLLDGKLKWRPLVLPDRYIDHGSPADQLAEAGLTPSHIAATVFNVLGQAREALAIMTVPNA

SEQ ID NO: 15349 - protein, 88 aa, Medicago truncatula
MNKVTIVGSGNWGSVAAKLIASNTIKLSNFHDEVRMWVFEETLPNGDKLTDVIKQTNENVKYLPGVKLGQNVVADPDLENAAKFQNSP

SEQ ID NO: 15350 - protein, 219 aa, Methanosarcina mazei Go1
MKIEKKSEMKFPYSEKVLEHFRNPHNVGKIENPDGKGLEGSPACGDMVAVYIKVDPRTKVIEDIKFESYGCASNIATGSVITDLARGKTLDEAKKITWKQASEELDGLPPIKAHCSVLAVEGLRAAIRDYEEKHGLVTEKEPTTEEVVQQRLKHVMNPLTGLDVVRTNLILKTSVEAGVIRVVVDLPADHQFAPAIKEDIIEKLGALWDVERVDVVFTA

SEQ ID NO: 15351 - protein, 143 aa, Kineococcus radiotolerans SRS30216
MTDTTAQRTLVLVKPDGVRRNLSGEVLRRIEAKGYTLVALELRTADRELLAGHYAEHEGKPFYEPLVEFMLSGPVLAAVVEGHRVIEGFRSLAGTTDPTTAAPGTIRGDLGRDWGLKVQQNLVHGSDSPESAAREIGLWFPNL

SEQ ID NO: 15352 - protein, 486 aa, Kineococcus radiotolerans SRS30216
MSQENGRGPDRADAEERQRTTTKVVLISVVAAIGGFLFGFDTAVVNGAVDAVAEEFRLAAGLKGFAVSCALLGAAVGAWFAGRLADRFGRKAVMVIAGALFAVSAVGSAFAFGVWDLILWRVVGGVGVGIASVIAPTYIAEVAPAHIRGRLASLQQLAITVGIFAALLSDAFIANTAGGASETTWFGWDAWRWMFVVGVIPSLVWALLALQIPESPRYLIAQGKTQRAGEVLREVLGTRSLEAVQRKVADIKNSMRREDEPSLRDLRGPRFGLLPIVWVGILLSVLQQGIGINVIFYYSTTLWKAVGFDESDAFTTSVITSVTNVVVTFIAIATVDRIGRKPLLTVGSAGMFLSLTVMAIAFSQASGSGQDVSLPQPWGTIGVIAANVYVISFGATWGPVVWVLLGEMFPNRIRAAGLAVAAAAQWLANFAISTSFPSLAKLGLQYAYGLYAVIALLSFVFVRRAVQETKGRELEEIGAETTSTAP

SEQ ID NO: 15353 - protein, 396 aa, Oryza sativa Japonica Group
MPPPPSATAGRRSPFSALLLYVTFALVILLLLTSYSPSIPHRGRSLHRRLKLHPRNPSLSGAGAGAPTGGNGAPQKQQNHHHAAPFDPEIAELERRLEDKEWEREHYRILHGDGGGGEADEHMREWEEFLREDEDFINDDERFNLGDRIRALFPKIDLAPRDGFASLDELTRWNLEQSRADQLHRSAREMELYDKNGDGVVSYGDFRAQHNESSGEVNSLGFPWWKEEHFNASDADGHGFLNKTEFNDFLNPSDSENPQIINLLCKQEIRQRDKDGDGKLNFEEYFHGLHDHIHGYDYENADISHIGNNTVAKERFSKLDKDSDGFISEHELEPVLDKLHLSERYYARQQAAHAISEADKDHDGRLTLDEMIENPYAFYGSVFLSDDEDYFHDEFR

SEQ ID NO: 15354 - protein, 160 aa, Methylobacillus flagellatus KT
MIRVGNGFDVHQLVEGRPCIIGGVEIPFAKGLKGHSDADVLLHAVSDALLGAAALGDIGKHFPDTDERFKDADSRVLLRHVVALLKAKHYNIVNIDATIIAEAPKMAPHIARMVQHIAEDCDILADCVNVKATTSEKMGFVGRGEGIAAQAVCLIQKYQI

SEQ ID NO: 15355 - protein, 132 aa, Helicobacter pylori
SNIKYELDKESGALMVDRVLYGAQNYPANYGFVPNTLGSDGDPIDALVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 15356 - protein, 391 aa, Lactobacillus acidophilus NCFM
MPELASDLGLSKKIQDVRASGIRIFDNKVSTIPGIIKLTLGEPDMNTPEHVKKAAIKSIEENDSHYAPQKGKLELRKAISNYLNKVTGIDYNPETEIIVTVGATEAINATLFALTNPGDKVAIPTPVFSLYWPVATLADADYVLINTAEDDFKLTPQKLEKAVEENPAIKTVILNYPTNPTGVEYTEDEIRALAKVIEEKHLYVITDEIYSSLTYGVKHFSIASLIPERAIYISGLSKSHAMTGYRLGYVAGPAKIMEQIGKVHGLMVTTTTDSSQAAAIEALENGLDDPDEYRRVYQKRRDFVLKALEEMGMHAVKPDGAFYIFAKIPAKYGKDDMQFALDLAFKEKVGITPGSAFGPGGEGYVRLSYASSDENLHEAMKRIKQFLQEDK

SEQ ID NO: 15357 - protein, 628 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 15358 - protein, 433 aa, Salmonella typhimurium LT2
MKNELMQRLRLKYPPPDGYCRWGRIQDVSATLLNAWLPGVFMGELCCIKPGEELAEVVGINGSKALLSPFTSTIGLHCGQQVMALRRRHQVPVGEALLGRVIDGFGRPLDGRELPDVCWKDYDAMPPPAMVRQPITQPLMTGIRAIDSVATCGEGQRVGIFSAPGVGKSTLLAMLCNAPDADSNVLVLIGERGREVREFIDFTLSEETRKRCVIVVATSDRPALERVRALFVATTIAEFFRDNGKRVVLLADSLTRYARAAREIALAAGETAVSGEYPPGVFSALPRLLERTGMGEKGSITAFYTVLVEGDDMNEPLADEVRSLLDGHIVLSRRLAERGHYPAIDVLATLSRVFPVVTSHEHRQLAAILRRCLALYQEVELLIRIGEYQRGVDTDTDKAIDTYPDICTFLRQSKDEVCGPELLIEKLHQILTE

SEQ ID NO: 15359 - protein, 90 aa, Glycine max
ISARSVNAMLGLDWDLNTPPLPDTGQWLLLASNETLPSPIVEILRARIIGLHHYLMLYMMLAYTVLSDAAKAPGLGLCATYMYTMAVGRL

SEQ ID NO: 15360 - protein, 495 aa, Zea mays
MARKMLIDGEVAAVADGGHYDYDLFVIGAGSGGVRGSRTAASFGAKVAICELPFHPISSEWLGGHGGTCVIRGCVPKKILVYGASFRGEFEDSKNFGWEINGDINFNWKTLLENKTKEIVRLNGVYQRILTSAGVTMIEGAGSLVDAHTVEVSQPDGSKQRYTAKHILIATGSRAQRVNIPGKDLAITSDEALSLEELPKRAVILGGGYIAVEFASIWRGMGAEVDLFYRRDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 15361 - protein, 475 aa, Bacillus pumilus SAFR-032
MRNQEKHFINGEWVASTGNETTEVINPATEEVIGTISLGTKEDLDKAVKAARSAFPSFSKTSRNERVKMLENIVRGYEKRKDELVEVMTQELGAPLKVSEEVHYKMGYEHFSKAAEALKSYTFTEDRGGHTIIKEAIGVSGLITPWNFPTNQTSLKIAGAIAAGSTVVLKPAEITPFAAMILAEIIDEAGVPKGVFNLVNGTGDVIGDGISSHPDIDFVSFTGSGAVGSKIMENAADNVKKVALELGGKSPLIVLDDADVDVAAETAIQHIAMNTGQVCSAATRVLIPESMKDQFEKALLNALPKFTVGDPREDHATGPLVSKKQWDTVQSYIEKGIEEGATLLAGGTGKPDGIDKGYFAKHTIFTNVKNDMTIAQEEIFGPVMSVITYQNLDHALEIANDTVYGLAGYVVGKDEKTLKYVAEHIRAGQITINNAETDYFAPFGGFKQSGIGREWGDFGIEEYLEVKAVMGLPTA

SEQ ID NO: 15362 - protein, 260 aa, Synechococcus sp. WH 7805
MSIRIAIEQLAAFAEAPFQGNPAAVCCLDAWLPDPLMQAIATENNLSETAFLIGSRGRYQLRWFTPSCEVDLCGHATLAAADVVFRREPEQHTLQFESRSGTLKVQREGDRITLDFPVQRAHPCLPPAGLQEAIGATPQSCLLGVDLIAVFADEDTIRTLQPDPERVAALPGRGLIATAPGKHVDIVSRFFAPGCGIPEDPVTGSAHCSLTPYWCETLGKAVLNARQLSARGGSLRCTLQGERVLISGRVIPYLSGTIQV

SEQ ID NO: 15363 - protein, 568 aa, Clostridium thermocellum ATCC 27405
MGKIFIVKESDIKINEGLIDESEVEDQITNLEVAICRTFIEIYDLNDGFKGILSEEENRIFEFYKEILDDQTFFEEIKSLIKNERYSAEKAIYTCINKYIDEISKSNNEYIKQRIFDLNDIAKRLVRNISVSVADENGLKINEINSEQIMVLKELTPIIAASLAKKEVKGVVAEEGAGYFTHASIILRSTGIPAVNGIRMDEIEKFDGSPAIIDGSKGVVVANPSEAEIQDLKSGLSEKKQALKNGRNGAAACERKPVETADGYRIRLLANISSVKEFLVAKKLGVDGIGLVRTESLFINYKRIPDEKRQYLIYSKIAKDLDGKPVVIRTADIGGDKVPQALAINDQSLSRSARGIRRSLEHKTELVTQIRAIMRAGKFGKVFISFPMVDSIEQIMEVKRIIKDISDELAEKKGEPVNRIGIGTMVETAEAVKIIDEILNEVDFISIGTNDMLHQICEQSRKCSTLEMRSYLEPVFLQTLKHCLDKAAEKNKPACVCGEMATDPMAIVVLLGMGAKDLSMSPSYIENTCRFIRTIKLDEAKEAAQKALESQNLQEVKNMLSELTKNRM

SEQ ID NO: 15364 - protein, 572 aa, Bacillus pumilus SAFR-032
MVKTALTAPEGPPSDVEEIKEKSDYLRGTLKEVMLDPISAGIPDDDNRLMKHHGSYLQDDRDLRNERQKQKLEPAYQFMLRVRLPGGIATSKQWLVMDELAHKYGNGTLKLTTRETFQLHGILKWNMKKTIQDIHSTMLDTIAACGDVNRNVMCTSNPYQSEVHHDVYELAKKLSDDLLPQTRAYHEIWLDEEKVAATPDTEVEPMYGPLYLPRKFKIGVAVPPANDIDVFSQDLGFIAIIENEQLIGFNVAIGGGMGMTHGDTATYPQLAKVIGFCTPEQVVEIAKQVITIQRDYGNRSVRKNARFKYTVDRLGLENVKEELEGRLGFALLEARDYHFDHNGDRYGWVKGINGRWHYTMFVEGGRIIDYDDYPLMTGIREIAKIHSGDFRLTANQNLIIGNVTSHKKKQIEQLIQEFGLSDGQQHSALRRSSMACVALPTCGLAMAEAERYLPRLIDKIEEIVEENGLSDKEITIRMTGCPNGCARHALGEIGFIGKSPGKYNMYLGAAFDGSRLSKLYRENVGEEEILNELGSLLPRYAKEREEKEHFGDFVVRAGIVKETTDGTNFHVQ

SEQ ID NO: 15365 - protein, 401 aa, Chlamydia trachomatis
MYNVKKDFPIFKNQGDPYVYLDSAATTHKPQCVIDSIVDYYSSSYATVNRALYTASHDITFAHWQVRSKVGSWIGAQYDQEIIFTRGTTSSLNLLAIAANDSWLAGGTVVISEAEHHANLVSWELACQRSGATIKKVRVDDEGMVDCSHLEQLLKQGVQLVSLAHVSNVSGAVLPLPEIAHLVHRYEALFAVDGAQGVGKGPLNLSEWGVDFYAFSGHKLYAPTGIGVLYGKKELLESLPPVEGGGDMVIVYDFEELSYQEPPLRFEAGTPHIAGVLGLGAAIDYLQALPFSITDRLTELTHFLYEQLLTVPGIQIIGPKQGAARGSLCSISIPGVQASDLGFLLDGRGISVRSGHQCSQPAVVRWDLGHVLRASLGIYNEQQDILLFVEALKDILRAYRS

SEQ ID NO: 15366 - protein, 320 aa, Triticum aestivum
  misc_feature (52)..(52): Xaa can be any naturally occurring amino acid
  misc_feature (90)..(90): Xaa can be any naturally occurring amino acid
SASSPSTSASSILRRHPPPRRSACPRRAASRLSVVAAMSDDPIKEWILTEGXGCINAAQRYDTDAGSFFVKTNRRIGPAMFEGEALGLKXAMYDTKSIRVPLPYKVGSLPTGGSFIIMEFIQFGRSRGDQSALGRKLAEMHKSAKSDKGYGFYVENTIGSTPQINTWTADWIEFYSKHRLGYQLKLISQRFGDSAIYEKGQRLIEKMHLLFDGAVIEPCLLHGDLWSGNISADANGDPVILDPACYYGHNEAEFGMSWCAGFRGDFYSSYFEVMPKQPGFEKRRDLYLLYHYLNHYNLFGSGYRSSAMSIIDDYLRMLKA

SEQ ID NO: 15367 - protein, 290 aa, Hyphomonas neptunium ATCC 15444
MRVRKAVLPVAGLGTRVLPATKAIPKELLPVVDRPVIQYVVDEAIEAGIEHIVFVTGRSKGAIEDYFDHAYELEAQLKLKNKTDILKQVEASRLPAGSSSFVRQQAPLGLGHAVWCARDVIGNEPFAVLLPDVIVKGKPSSLKQMVDAYDKVGGNIVAVDPVPEERVSSYGVIAPVSRDGRLIKMSGMVEKPPRDSAPSNLAITGRYILQPEIFGLLEKQGAGAGGEIQLTDSMAKLMELQDFYAYEFEGSVHDCGNKTGYFDAVLAHALDNPDTAEFARALVKKTAQGL

SEQ ID NO: 15368 - protein, 171 aa, Zea mays
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKAKEGPNRCATCRKRVGLTGFNCRCGNTYCSMHRYSDKHDCQFDYRTAARDAIAKANPVVKAEKLDKI

SEQ ID NO: 15369 - protein, 174 aa, Triticum aestivum
QGSSVTMKVSDATLAGMQDDAERVWSPELARLIRETAEPFVNVIYDADPLPRLSWAGGSVALVGDAAHPTTPHGLRSTNMSVHDARVLGECLARWGQTPPPRALAEYEAARLPVVAAQVLHARRLGRLKQGLPVEDGDTGAFDAWAATAEDALQLRQRGMPYFGGAPTVDGGSL

SEQ ID NO: 15370 - protein, 494 aa, Salmonella enterica subsp. arizonae serovar 62:z4,z23:--
MSDVTLLAEVTTFLRQRHGQFIAGERQAGNGAKFTVTNPATGKTIAEVVSATPAQAEQAMQSARLAFDVWRKMSTLQRGALLLKLADTLVAHREELAQLESVCSGKTIMLSRGLELDQSVAFLRYFAGWAGKITGETLDVSLPSMGEERYTAFTKRQPIGVVVGIVPWNFSIMIAIWKLAAALVCGCTIVIKPSEYTPLTLLRVAELAKEAGLPDGVINVVNGVGGEIAQQLIAHPDCAKVSFTGSVATGEKVRRSAISAGKRVTLELGGKNAALFLNDLTAQAMVNGILEAGYLNQGQICAAAERFYLPQEKLDTVMTLLRQRLSEIVPGSPLDEKTVMGPLANQAQLEKMLRLIQLAREEGDTIVYGGEILPGEGYFLQPTAVKVRSENSPLMHEETFGPLCSFIGYQNEKEALSRINASPFGLAASVWSENICKALRYAEDIDAGMVWVNMHTFLDPAVPFGGMKGSGIGREFGSAFIDDYTELKSVMIRY

SEQ ID NO: 15371 - protein, 692 aa, Zea mays
  misc_feature (100)..(100): Xaa can be any naturally occurring amino acid
MGEAYFNGMAAERFCVRNSGAQAVVEGIGDHGCEYMTGGTVVILGKTGRNFAAGMSGGIAYVYDVDGKFSARCNNELVDLYHVEEEDDIITLKMMIEQHXRNTESVLARDILSDFDNLLPKFVKVYPRDYKRVLENMKLQKGVANHAKEPKMANGISVTTKKVQLDQSASRPTRVANAKKYRGFITYERESISYRDPKERVKDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPAGLAAADQLNKMGHFVTVFERADRIGGLMMYGVPNMKTDKIGIVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLTKPPSNRAADNPWPQWPRIFRVDYGHQEAATKFGKDPRSGEVLTKRFIGDENGKVKALELVRVKWEKVDGRFQLKEIQGSEEIIEADLVLLAMGFLGPEASIAEKLGLEKDNRSNFKAQFGDFATSVDGVFAAGDCRRGQSLVVWAITEGRQAAAAVDKYISRHDQNVAGDITPLWGQGLVQPGWSIKKT

SEQ ID NO: 15372 - protein, 299 aa, Vitis vinifera
MRIQRQKELREKRTFRRRIPLRRGRVSPRLPVPDHIPKPPYLSSTSLPELSSEHQIHDSEGISRMKAACELAARVLDYAGTLVRPSVTTNEIDKAVHQMIIEAGAYPSPLGYGGFPKSVCTSVNECMCHGIPDSRQLQDGDIINIDVTVYFNGYHGDTSKTFLCGNVTDGLKRLVRVTEECMERGIACCKDGASFKKIGKRISEHAEKFGFGVVERFVGHGVGTVFHSEPVILHHRNDKSGHMVEGQTFTIEPILTIGSTECITWSDNWTTVTADGFPAAQFEHTILITRTGAEVLTKY

SEQ ID NO: 15373 - protein, 681 aa, Kineococcus radiotolerans SRS30216
MPVHVRTLDLPAAGAGRMALLTLDPGDPRKPFVLGAETLLALERAVDEAERLVADEGLVAIGVTGVNGVFCAGADLKSVARTTSREDAVATAELGHRVLGRFATSPVPTFAYVNGLALGGGLETALHCTYRTVSEQVRGLGLPEAHLGLVPGWGGTYLLPRIAGPDVAVQVAVENALANNRTLTGPQAFEAGIVDARFEAADFLVESLRWTASVLAGTTPVTRRDLADETTWTAAIERGRAVADARVHGAAPAPYRTLDLLSAARTADRETHFAAEEAALGDLIVSGELRAGLYAFDLVQRYAKKPAGAPARDLARKVTSVGVVGAGLMASQLALLLLHRLQVPVVLTDVSPDRVEKGVGFVREGVAELLRKGRVSPDTANRLSASVSGSVDKSALADADFVVEAVFEELAVKQDVLRELEPLLRPDAVIATNTSSLSVTAMASVLEHPQRFVGFHFFNPVAVLPLVEVVRTPETDEASLATAFAVGARLKKTCVLVQDAPAFVVNRISTRMFDEVVRALDAGTPLLEVERSLDPLGLPMSPFRLASFVGPAVMLHVHETLAAAFPDRYRVSGNLRRWVEAGGPALVTPKGPVAATGADEGLFEVGSSPLTREEVLHRVQDALADEVRRVLDEGVVAGPEDVDVCLVLGTGHPLFTGGITPYLDRVGASERVTGRRFHPAG

SEQ ID NO: 15374 - protein, 260 aa, uncultured marine bacterium 582
MTVKTDKPSQLRVLVTAGASGIGRVIAESFAQTGARLHICDIADAALGEAKKTHPTWGVSRCDVSQSDQVARLFEEVGNNLGGLDVLINNAGIAGPTGGVEEITADDWRRTVDINLNGQFYCANRAVPLLKQSPNASIICISSVAGRLGYAYRTPYAATKWAIIGLTKSLAIELGPSGIRVNALLPGIVAGPRIEKVISDRAQTMGVSYGDMEQEYIDKVSLRRMVTAQDVANQAVFLCSPGGVNISGQSISICGNVEVL

SEQ ID NO: 15375 - protein, 557 aa, Xanthophyllomyces dendrorhous
MFILVLLTGALGLAAFSWASIAFFSLYLAPRRSSLYNLQGPNHTNYFTGNFLDILSARTGEEHAKYREKYGSTLRFAGIAGAPVLNSTDPKVFNHVMKEAYDYPKPGMAARVLRIATGDGVVTAEGEAHKRHRRIMIPSLSAQAVKSMVPIFLEKGMELVDKMMEDAAEKDMAVGESAGEKKATRLETEGVDVKDWVGRATLDVMALAGFDYKSDSLQNKTNELYVAFVGLTDGFAPTLDSFKAIMWDFVPYFRTMKRRHEIPLTQGLAVSRRVGIELMEQKKQAVLGSASDQAVDKKDVQGRDILSLLVRANIAANLPESQKLSDEEVLAQISNLLFAGYETSSTVLTWMFHRLSEDKAVQDKLREEICQIDTDMPTLDELNALPYLEAFVKESLRLDPPSPYANRECLKDEDFIPLAEPVIGRDGSVINEVRITKGTMVMLPLFNINRSKFIYGEDAEEFRPERWLEDVTDSLNSIEAPYGHQASFISGPRACFGWRFAVAEMKAFLFVTLRRVQFEPIISHPEYEHITLIISRPRIVGREKEGYQMRLQVKPVE

SEQ ID NO: 15376 - protein, 424 aa, Agrobacterium tumefaciens str. C58
MIGLGYVGLPLAMTVAKAGFKVVGFDIDPGKITAIEAGRSYIEAVSDEVLASVRQDDGFVATSDFLRLAECDVIAICVPTPLTKYREPDLSYVEKTCRDIAAHLRKGQLVVLESTTYPGTTDGVVKTILESTGLVSGVDFFIGFSPEREDPGNRDFETSTIPKVVAGDGEAAGKLMAAFYGSVVKKIVPVSTNATAEAVKITENVFRAVNIALVNELKVVYEAMGIDIWEVIDAAKTKPFGFMPFYPGPGLGGHCIPIDPFYLTWKSREYELPTRFIELAGEINTGMPRHVVGRVAEALDIHSGKALSRSKVLVVGLAYKKNVPDIRESPSLKLLELIQERGGDAAYFDPYVAEIPKTREYSHLMGMKSISWDRETIGSFDAVLVATDHDNVDYAALSDWAPLIIDTRNVFARRDIAAKHIIKA

SEQ ID NO: 15377 - protein, 172 aa, Streptococcus mutans UA159
MDLKNYIATIEDYPQEGVTFRDISPLMANGNAYSYAIREIVQYATDKKIDMIVGPEARGFIVGCPVAYELGVGFAPVRKPGKLPREVIEAHYEKEYGIDTLTMHADAIKPGQRVLIVDDLLATGGTVKATIEMIERLGGIVAGCAFLIELDGLDGRQAIEGYDTKVLMNFPG

SEQ ID NO: 15378 - protein, 308 aa, Lactobacillus acidophilus NCFM
MKNIYFNHDGNIDDLVSYLLLLQAPDIKLLGVGAIDADGYIDPSVEACRKMTDLFNLRSDELTVARSNSRAVNQFPHEWRMATYSFNYLPMLNEKGHIDTKQAELPAHLDMVEKIKESKEPVTLVMTGPLTDLARALDTDPDIEKNIDMLYWMGGSLDGHGNVAIVNADGCQEWNAFWDPYAIKRVFDSNIKIQMVGLESTEELPLNDELRQHWASLRRYPAIDLVGQGYSMIVSIPSAELYLWDVLTTISALYPEVVETEQAHARVITDGLSAGSFVRDPNGREVTLVTKANKQLFFDKMDEILKRK

SEQ ID NO: 15379 - protein, 287 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYHYYRSGSGSRRSSERHRSPDSDGSRRRRGRSRSRSRSPVREGSEERRAKIEQWNREREAAQV

SEQ ID NO: 15380 - protein, 509 aa, Bacillus pumilus SAFR-032
MGMIEEFELKKQRIVKGGAERYHQKNKEKGKLFVRDRLQLLLDQDSFMEDAMFAECKDEHLPADGVVTGTGRMNGQTVCVMANDSTVKAGSWGVKTVEKIIRIQETAEKLNCPMLYLVDSAGARITDQIAMFPGRRGAGRIFYNQVKLSGRIPQVCLLFGPSAAGGAYIPAFCDIVVMVEGNASMYLGSPRMAEMVIGEKVTLEEMGGANMHCSISGCGDILAKTEEEAIQIARDYLTYMPANYTEKPKPAAAKAPKASEMTIQGLIPKGQNTPFDMYQLIDLLIDEGSFFEIKKLFAAELITGFGRMNGQPVGLIANQPRVKGGVLFHDSADKAAKFIQLCDAFHIPLLFLADIPGFMIGTKVEQAGIIRHGAKMISAMSEATVPKISVIVRKAYGAGLYAMAGPAFEPDCCLALPSAQIAVMGPEAAVNAVYANKIAELPAEERAAFIQEKRKEYQEDMNIYELASEMIVDGVIPFDHLRNELCHRFHAYSSKEMTFTRRKHPVYPV

SEQ ID NO: 15381 - protein, 194 aa, Clostridium thermocellum ATCC 27405
MSLVPIVVEQTNRGERSYDIYSRLLKDRIIVLSDEINDVTASLVVAQMLFLEAEDPDKDIQLYINSPGGSVTAGFAIYDTMQYVKPDVSTICIGMAASMGAFLLAAGAKGKRFALPNSEIMIHQPLGGARGQATDIKIHAEQIIKIKNKLNRILSERTGQPFEKIERDTERDFFMSAEEAKAYGIVDEVMERRK

SEQ ID NO: 15382 - protein, 490 aa, Zymomonas mobilis subsp. mobilis ZM4
MAQNKMLSFVHLKQAYPEKRSAQERDKDFNEIYRSFSDEQASCQASRCSQCGVPYCSAYCPLHNNIPDWLKMTAEGRLQDAYALSSATSTMPEICGRICPQDRLCEGNCVIENSGHGAVTIGSVEKYITDTAWKEGWVEPLQPITELGISVGIIGSGPAGLTAAEKLRQQGYQVHVYDRHDRAGGLLTYGIPGFKLEKDIVARRVKRLADGGVTFHTNFHVGKDASLEELRERHAAILIATGVYKARGLATPGKELNGIVDALDFLISSNRKSFGDKVEAFDNGTLDAKGKKVVVIGGGDTAMDCVRTAIRQGAESVRCLYRRDRVNMPGSAREVKNAEDEGAEFVWLSAPESFVGKDHVQSVKVRGMRLGAPDGSGRRSPEPDPARLFDMDADLVICALGFSPEDLPTLFNAPELSVTPWGTVEADPVTLQTSIEGVFAAGDIVRGASLVVWAIRDGLVASEQMHQWLATRQQDKQDAPTKAKKKAVFA

SEQ ID NO: 15383 - protein, 596 aa, Zea mays
CCAVQALMTIKNTLKDPHGVLKNWDQDSVDPCSWTTVSCSLENFVTGLEVPGQNLSGLLSPSIGNLTNLETILLQNNNITGLIPAEIGKLTKLRTLDLSSNHLYGAIPTSVGNLESLQYLRLNNNTLSGPFPSASANLSQLVFLDLSYNNLSGPVPGSLARTFNIVGNPLICGTNNAERDCYGTAPMPPYNLNSSLPPAIMSKSHKFAIAFGTAIGCIGLLVLAAGFLFWWRHRRNRQVLFDVDDQHMENVSLGNVKRFQFRELQSATGNFSSKNILGKGGFGYVYRGQFPDGTLVAVKRLKDGNAAGGEAQFQTEVEMISLALHRNLLRLYGFCMTATERLLVYPYMSNGSVASRLKGKPPLDWVTRKRIALGAGRGLLYLHEQCDPKIIHRDVKAANILLDDCCEAIVGDFGLAKLLDHRDSHVTTAVRGTVGHIAPEYLSTGQSSEKTDVFGFGILLLELVTGQTALEFGKTANQKGAMLDWVKKTHQEKKLDVLVDQGLRGGYDKMELEEMVRVALLCTQYLPGHRPKMSEVVRMLEAGEGLAERWEASHSQSQSADSHEFKVPDFTFSRCYSDLTDDSSLLVQAVELSGPR

SEQ ID NO: 15384 - protein, 628 aa, Synechococcus sp. WH 7805
MRRVGSRWDCLCHGLILQPIPNPTLGSAGACLARLHISPANHRTTLVIRILLLLLSLSLTPGSAAPVSREDPEQADTRKQTMSTAAGSAVVVTANPLASKAALGVLASGGHAVDALVAAQAVLAVVEPQSSGLGGGGFLLHWDARRQALEVFDGRETAPARSRSDDLLQPSGEPLSYRAATRHPHAIGVPGTVALLWEAHQQLGQRPWSSTLTPAIRLARDGFLPSPRLRRSVALAQRLGASHNHAFQQLYLPGGTPLPAGRLFRNPALARTLEVLAQEGGRAFYQGPLAQRIQRGVNALQSQEPGFKGWTAADLASYSVVRRAPLCRVQMKHRVCTVPPPSSGGLAVLQTLALLDATGSFNDPSNPQSWRHLVLAESWADADRLYWVHDPIDGTIPTQGLLDPAYIRARVQAMQASPERVAQPGLPPGMKRFPFGRPGPGTELGTSHVTIVDGRGNLASYTTTVETVFGSRNLVEGMVMNNQLTDFDWRPVVGGLPVANRRRPGRRPVSSMAPTIVFNGDQPVLALGSPGGKRIPHYISRVLLAALPWAEPPARSVGLPLVSPQGNTLVIERKPPLPWPVNPNELNAPGRELRLQTLGSGIGLVQRIGNRWHGAADPRREGTALALP

SEQ ID NO: 15385 - protein, 250 aa, Pseudomonas aeruginosa PAO1
MTAPFKDHFSTGSANYAAHRPTYPAQLVDELAALCPGTRLALDCGCGTGQLTVLLAERFERVVGTDASAAQIDKAQARERVEYRVALAEDSGLAAASADLVTVAQAAHWLDLPRFYEEVRRVARADAILALVTYGVLHVDGPMEPLVQHFYHQVVGPYWPAERRHVEEGYRNLPFPFEERRLPDLAIEVAWTLDELLGYVGTWSAVKEAGKALGQDPGAAFVDELREAWGDPQTRYRVSWPLTVRAGVIR

SEQ ID NO: 15386 - protein, 401 aa, Chlamydia trachomatis
MYNVKKDFPIFKNQGDPYVYLDSAATTHKPQCVIDSIVDYYSSSYATVNRALYTASHDITFAHWQVRSKVGSWIGAQYDQEVIFTKGTTSSLNLLAIAANDSWLAGGTVVISEAEHHANLVSWELACQRSGATIKKVRVDDEGMVDCNHLEQLLKQGVQLVSLAHVSNVSGAVLPLPEIAHLVHRYEALFAVDGAQGVGKGPLNLSEWGVDFYAFSGHKLYAPTGIGVLYGKKELLESLPPVEGGGDMVIVYDFEELSYQEPPLRFEAGTPHIAGVLGLGAAIDYLQALPFSITDRLTELTHFLYEQLLTVPGIQIIGPKQGAARGSLCSISIPGVQASDLGFLLDGRGISVRSGHQCSQPAMVRWDLGHVLRASLGIYNDQQDILLFVEALKDILRAYRS

SEQ ID NO: 15387 - protein, 324 aa, Pseudomonas aeruginosa PAO1
MPSRITLNANGGPEVLRLEQVQAQQPGPGEVWLEQAAIGVNPLDLGQRSGAVPIPLPSGLGLEGAGVVAALGPGVSGLAPGDRVAYATGPLGAYASARLYPAERLLKLPDTLAFEDAAALLFKGITAHYLLYATYPVGPGTRILLYGAAGAVGQLMAAWARHLGAWVIGVVSKAESVERARAAGCDEVLVFDAASLAAQVAELTAGRKVDVVYDPIGRATFEASLNSLRPRGLLVSFGATSGVPPAVEVATLNAKGSLFLTRPSLAAHTANPEEYRLRAQAVLRAHADGVIQPRVWRRYPLAEAAVAHTDLLEGRSQGALVLLP

SEQ ID NO: 15388 - protein, 380 aa, Zea mays
MRDDVAFQIINDELYLDGNARQNLATFCQTWDDENVHKLMDLSINKNWIDKEEYPQFAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGARY

SEQ ID NO: 15389 - protein, 530 aa, Arabidopsis thaliana
MEEELRVRLNDHQVSKVFPVKPKSTAKPVSESETPESRYWSSFKNHSTPNLVSSVAALAFSPVHPHSLAVAHSATVSLFSSQSLSSSRRFSFRDVVSSVCFRSDGALFAACDLSGVVQVFDIKERMALRTLRSHSAPARFVKYPVQDKLHLVSGGDDGVVKYWDVAGATVISDLLGHKDYVRCGDCSSVNDSMLVTGSYDHTVKVWDARVHTSNWIAEINHGLPVEDVVYLPSGGLIATAGGNSVKVWDLIGGGKMVCSMESHNKTVTSLRVARMESAESRLVSVALDGYMKVFDYGRAKVTYSMRFPAPLMSLGLSPDGSTRVIGGSNGMVFAGKKKVRDVVGGQKKSLNLWSLISDVDESRRRALRPTYFRYFQRGQSEEPSKDDYLVKEKKGLKLTRHDKLLKKFRHKEALVSVLEEKKPANVVAVMEELVARRKLMKCVSNMEEGELGMLLGFLQRYCTVQRYSGLLMGLTKKVLETRAEDIKGKNEFKGLLRNLKREVNQEIRIQQSLLEIQGVIAPLMRIAGRS

SEQ ID NO: 15390 - protein, 306 aa, Brassica napus
VDPRVRAWLMLTCFQTSVISSSMFLTAMAANPLSANLAFNTIKQTIGWTDWAKAAIVPGIVSLIVVPFLLYLIYPPTVKSSPDAPKLAQEKLDKMGPMSKNELIMAATLFLTVGLWIFGAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLSKWWGYGFLISIVNILIWLGVGGAWWKFIGLW

SEQ ID NO: 15391 - protein, 375 aa, Oryza sativa
  misc_feature (24)..(24): Xaa can be any naturally occurring amino acid
LRSPPRLTQPPVAMGNRTSRHHRXPDAAMGRVLGRPMEDVRATYTFGRELGRGQFGVTYLVTHKATGKRFACKSIATRKLAHRDDIEDVRREVQIMHHLTGHRNIVELRGAYEDRHSVNLIMELCEGGELFDRIIARGHYSERAAAALCREIVAVVHSCHSMGVFHRDLKPENFLFLSKSEDSPLKATDFGLSVFFKPGEHFKDLVGSAYYVAPEVLKRLYGAEADIWSAGVILYILLSGVPPFWAESEDGIFDAVLQGHIDFSSEPWPSISSGAKDLVKRMLRQDPKERLTAAEILNHPWIREDGEAPDKPLDITVISRMKQFRAMNKLKKVALKVVAENLSEEEIVGLKEMFSYSYCEVFFLSQILYGSILGK

SEQ ID NO: 15392 - protein, 284 aa, Medicago truncatula
MFFLQSFHHRQTPSSYPPSQSSNSIVPNRYPNRNGYIKFRTTYNENLHYLKALTIINPNTKPNNLPHPDTINHILTIITFLKSHSFTEADIPRLVHHSPHLFTTSISPTSLSPVFTFLASDLLASVEDSHGLILRCPNLLFTDVNHILKPTLHFLREEVGVSNLNRPTNRNAHLLNTRVEKMRMRVRFLEEVVGFTYEEARNVCARLPAILGYDVENNLWPKFVYLVKEMEREVEELKKFPQFFGFSLDKRIVPRHLHLKERGVRIPLNRMLMWGDEKFYAKWK

SEQ ID NO: 15393 - protein, 401 aa, Chlamydia trachomatis
MYNVKKDFPIFKNQGDPYVYLDSAATTHKPQCVIDSIVDYYSSSYATVNRALYTASHDITFAHWQVRSKVGSWIGAQYDQEIIFTRGTTSSLNLLAIAANDSWLAGGTVVISEAEHHANLVSWELACQRSGATIKKVRVDDEGMVNCNHLEQLLKQGVQLVSLAHVSNVSGAVLPLPEIAHLVHRYEALFAVDGAQGVGKGPLNLSEWGVDFYAFSGHKLYAPTGIGVLYGKKELLESLPPVEGGGDMVIVYDFEELSYQEPPLRFEAGTPHIAGVLGLGAAIDYLQALPFSITDRLTELTHFLYEQLLTVPGIQIIGPKQGAARGSLCSISIPGVQASDLGFLLDGRGISVRSGHQCSQPAMVRWDLGHVLRASLGIYNDQQDILLFVEALKDILRAYRS

SEQ ID NO: 15394 - protein, 135 aa, Neptuniibacter caesariensis
MSEKKPKLVRSEQEWKEQLSPEQYRICREKGTERAFTGEYYDNKQLGKYLCVCCGDELFRSEVKYDSGSGWPSFWEPVSSEVIDEHRDSSHGMIRTEVTCASCGSHLGHVFPDGPQPTGLRYCINSASLNFEEGE

SEQ ID NO: 15395 - protein, 446 aa, Brassica rapa
MKGVIPHYHHSYTFFFVILVLFPHAFSTNTLSSNEALTISSNKTLVSPGDVFELGFFKTATKNSQDGSTDRWYLGIWYKTTSDKRTYVWVANRDNPLHNSIGTLKISHASLVLLDQSDTTVWSTNLTGVAHLPVTAELLANGNFVLRDSKTNDLDRFMWQSFDYPVDTLLPEMKIGRKHKSSEKEKILTSWKSPTDPSSGDYSLILETEGFLHEFYLFKNEFKVYRTGPWNGVRFNGIPKKMQNWSYIDNSFIDNNEEVAYTFKVHNNNNMIHSRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEALVEKRIGLKECREKCVRDCNCTGYANMDIMNGGSGCVTWTGELVDMRKYDAEGQDLYVKVAEASLVPS

SEQ ID NO: 15396 - protein, 301 aa, Neptuniibacter caesariensis
MQAVLDEIQRQIPLANGESRRIFHGRGHCFDGFEHLVVDWFPPYAVARLYKPVEADWLEALSETIKSVPEVEGLVIQQRSRGQDSLQDVVWGDVPDQMNTMELGLFYQVKPQRNQNSGLFLDMREGRRWVMQNAGGKRVLNLFSYTCAFSVAALAGGADHVVNVDMSRGAINTGKENHRLNGLQDGRVKFLAYDLFRSWKRVRQYGPYDLIVIDPPSFQPGSFVAEKDYRRVIRRLNELTEAGSQVLACHNDPKNGTEFLKQLMLEECPDFRFVERLANPEDFPEAEVEKGLKVLLYTREK

SEQ ID NO: 15397 - protein, 1058 aa, Oryza sativa Japonica Group
MAAYASYSFAQCSLKAAADGHGWWGFRAGENRRSRPIQNGNIAVPIGMNKLINLRHLIAHEKVHSAIDSVGKLTCLQKLIFKVQDADSFEIGQLRAMNDLVILGISQLENVKTKKEARSARLMDKEHLKELSLSWNDNMSSGPTEENTRYDVLEGLEPHGNLKHLQLTGYSGATSPTWFASKVTSLQVLHLENCTEWRIVQYLEMLPLLRKLKLIRMWNLVEVSIPSYLEELVLVNMPKLENCVGTYGIELTSRIRVLMVKDCPQLNEFVLFHRDHFHAEQKSWFPSLNKLMIGHCYRIIMWKILPLEEMRALKELELMDVPIVEELPVPSLEKLVLIQMRSLQICSGITASPVQVSTSQVDQNEWISSLRELTIYDCSSLVVSLPIPPSPLMSYSSIKRLSAFPTMEINNRKFTIESDELSELDGRILSFHNLKGVTSIYLRRCPNLTRISTEGFNQLITLECLVIQKCPNLFQLQISDQANNTSSATNIPALPSLKSLTISSCGIAGRWLTQMLHHVNSLEKLDLFDCPQIKFLLTNQPTEREVTSSLASAEITSAGDEQLLQIPCSLLHSLMWLSISECPDLEFCGGSGGFAGFTSLVQLQIKNCPKLVSALVSETNDNGLLPMSLQDLSLSPLSVSENLQSFSPEGLPCLRRLSLCRSQHLKSMQLHSCTSLEYLKISGCRSLVVLEGLSSLRRLDIQMNPELSAAWHLKLQEQEQGGNQAQVFPPSLVELHISNLEGSISSQFLCLPSVTKLAVRDSPALKSIQLKHCMTLEKLEIINCKLLASIEDFHSIRNLRSLKVLGTRSLSPYLQQEASGMWFRLESLMIDDAAVLSVHLCIQLTSLRILQFWSMGMASLTEEQERALQLLTSLRQLGFSRCQKLESLPANLRSLDFLEDANGLGMRAIPGEDYCRIVIQYPSDTDSKWKDPKTGEPEGLSFEFNLCEAVASWEQDELVKIHSPMRGDPGRVVKWLPTKDTIEAARAASEKLLKRPGAGSEGPLSSCTMIKKLEKVKTAKRSVVHDAALNHLEYIRGSTRYPLERNAGGGYFCMINDR

SEQ ID NO: 15398 - protein, 235 aa, Kineococcus radiotolerans SRS30216
MPELFRPPFDAQMGDRPMMTPQSRPNPAHGPSARYVLPQFEERTSYGMKRSDPYTKLFEDRIVFLGVQVDDASADDIIAQLIVLESQDTERDIIMYINSPGGSFTALTAIYDTMQYIRPDIQTYCMGQAASAAAVLLGAGAPGKRFALPNSRILIHQPAMAGGDYGQASDLEIQANEILRMRSWLESTLAFHSHRTADQVREDIERDKFLTAREAVEYGLIDEVLTSRKASAPPL

SEQ ID NO: 15399 - protein, 323 aa, Brassica napus
  misc_feature (312)..(312): Xaa can be any naturally occurring amino acid
MTSPTALICETQAWKDLKGHVEDINKTHLRDLMSDAHRCESMMLEFEGLLLDYSRQRATVETMDKLLNLAKAAQLSEKISRMFNGEHINSTENRSVLHVALRAPKYAVIKADGKNVVPEVWNVLDKIEDFSEKIRSGSWVGATGKPLKDVIAIGIGGSFLGPLFVHTALQTDPEAAECAKGRQLRFLANIDPVDVARNISGLNPETTLVVVVSKTFTTAETMLNARTLRNWITTALGAPAVAKHMVAVSTNLALVEKFGIDPNNAFAFWDWVGGRYSVCSAVGVLPLSLQYGFSVVEKFLKGASSIDKHFQXTPFEKNIPVLL

SEQ ID NO: 15400 - protein, 475 aa, uncultured marine bacterium 582
MTLITPVLLAGGYGTRLWPTSRKGYPKQFSKLLGDETLFQSSAKRLVSSQTVQFDAPITMTNSDFRFIVVEQLQRASVDPGAVLIEPEGRNTAPAVLAAAIYASNRNPDANILIAPSDHIIPDTLAFHAAICKGVKETANGRIVTFGITPTRPETGYGYLELSAPSSGCAVPLKRFVEKPDLASAKAMLDAGTYLWNAGIFLFRAKDMIAAFKALAPELIGPVSDAIEQGHADLGFFRLAAAPWTKCQNISIDYAIMEKINTLSAVPYSAGWNDLGEWDSVWLELGPNAEGVVTSENATAIECQDVLLRSENESQHLVGLGLENIIAIAMPDAVLVAHKSRAQDIKLVVSTLKTNGVPQAETFPKDHRPWGWFESLIIGGRFQVKRIHVLAGAALSLQSHHHRSEHWIVVEGTAKVTVDDNVTLLTEGQSTYIPLGAVHRMENPGKVPMVLIEVQTGVYLGEDDIKRYKDNYART

SEQ ID NO: 15401 - protein, 526 aa, Methylobacillus flagellatus KT
MQQKILILDFGSQYTQLIARRIREANVYCELHSWDVSDAFIREFNPAGVILSGGPNSVYEDETPRAPQSVFELGVPVLGICYGMQTMAAQLGGSVENAAKREFGYAEIRAQGHSALLKGIQDKSNAEGHGLLDVWMSHGDKVTALPEGFKIIASNSATPIAGMADENRRFYAVQFHPEVTHTKQGKALLNRFVHDICGCDQSWNMPDYVETAVQRIREEVGCDEVILGLSGGVDSSVAAALIHRAIGDQLTCVFVDNGLLRLNEAEQVMETFGKNLGVKVIHVDASAKFLGDLSGVNDPEAKRKIIGREFVEVFQQEAAKLPQAKWLAQGTIYPDVIESAGAKTKKAHTIKSHHNVGGLPDTLKLKLLEPLRELFKDEVRELGIALGLPHDMVYRHPFPGPGLGVRILGEVKREYADLLRQADHIFIEELRSTKDADGKSWYDKTSQAFAVFLPVKSVGVMGDGRTYDYVVALRAVVTTDFMTAHWAELPYDLLGKVSNRIINEVRGINRVVYDISGKPPATIEWE

SEQ ID NO: 15402 - protein, 559 aa, Xanthobacter autotrophicus Py2
MIAFGHPRPRGMSNVPANRAAPLRAPVSFAYESQSLTSFSNLGLAEPIVRALTEAQHVTPTPIQAEAIPQILAGRDLIGIAQTGTGKTAAFALPILDRLVRHPHRPEPKSVRALVLSPTRELSGQIVENFEKFGRHANISVSLAIGGVPMGRQIRALSRGVDVLVATPGRLIDLVENHAVKLDQVEVLVLDEADQMLDMGFVHAIRAIVRRLPHKRHSLFFSATMPHAIAELAGSMLRDPVRVAVTPVAKTADRVEQRVILVDKANKGQLLAEVLSTEDIDRALVFSRTKHGADKVVRVLAKAGIAAEAIHGNKSQNQRDRVLAAFREGKIRTLIATDIAARGIDVTGVSHVINFDLPNVPESYVHRIGRTARAGREGIAISFCDHEERAFLRSIEKLIKMQLPSSDRRGAGTRFAVPELEPIILDERDETSERSDYIGRSGRQNPRGQRPRHGDERSGEGRSRAPRSEEGRPQAARAHQPRGEGRPAGGRPEGRPDAGGAQGAGHRAGQPARAEGRGQRTERGQRPAGDIGGLGFMQSVPNRGQRSDSRPGGAKRPVR

SEQ ID NO: 15403 - protein, 488 aa, Bacillus halodurans
MAHTVSEQRIHEVGSMKRDHYRMVINGERVDSDETFETFNPAKGEILATVAKASREHAEKAVQAARHAFDHGKWRKYPVGKRARVLNQIAAIMRERFQELVEIEVLNSGKAISAAQPQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYIGR

SEQ ID NO: 15404 - protein, 273 aa, Nostoc sp. GSV224
MLEDLQIAFIGGGTMGEMIISRLLSTKIVPKADLIIVSDPVSARCLHLEREYGVRTTTSNIEAVLGVSIVILAVKPQILAEVLGMLKDKIPPNALVISIVSGASISSLCQGLNHPAVVRTMPNIAVQVGHGTTVWSASSSVTEIQRSHTQIILQALGKEFATQNEHYLDMATALSSAGTGFVFLYIEAMIDAGVQMGLTRTQAQELTLHTIAGSVELMFQTHEHPAVLRNKVTSPGGVTAAGLYELEKGGMRTVISNAVLAALSRTQQLGNIS

SEQ ID NO: 15405 - protein, 132 aa, Helicobacter pylori
SNIKYELDKESGALMVDRVLYGAQNYPANYGFVPNTLGSDGDPVDALVLSDVAFQAGSVVKTRLVGVLNMEDESGMDEKLIALPIDKIDPTHSYVKDINDLSKHTLDKIKHFFETYKDLEPNKWVKVKGFEN

SEQ ID NO: 15406 - protein, 298 aa, Xanthobacter autotrophicus Py2
MPQSPTPAPMPAPVADAFAPKLTKAGTERWHDVVDPVWARLRNEAEEAAEREPLLAAFLIGAVLGQPSLEAVIGERIAARLDHADVPASAIRAAWLEAAARDKTIPQALRADIMAVVDRDPAATRTLEPVLYFKGFHAIQTHRLSHFLWASGQRDFALYLQSRASSVFAVDIHPQVPMGRGIFLDHATGVVIGATAVIEDDVSILQGVTLGGTGKETGDRHPKIRRGVLIGAGAKVLGNIEVGRCARIAAGSVVLKPVPRNTTVAGIPAKVVGEAGCAEPSRSMDQMFEDNIWSGADI

SEQ ID NO: 15407 - protein, 386 aa, Zymomonas mobilis subsp. mobilis ZM4
MMKRTDNIALIVAAGQGKRAGEGLPKQYRQIAGKAILAHAIDNLLAHPEIDTVQVVIADGHQTLYQEAVGDRDLPQPVIGGVFRRDSVINGLKAAHDRGYKRVLIHDAARPFLPKTVIDRLLDALKSSKAAIPVLPVVDTLVNQEVEAVDRNLFHRVQTPQAFDLETVIAAHQAWTGSDEPTDDAQVVRAFGKKIALVTGDRLLEKLTYPADFSVAEAQMTEKMISVCGSGFDVHCFEAGDHIMLGGIKIPHDHGLAGHSDADVALHALTDALLGAIADGDIGTHFPPSDPQWKGANSTQFLEYAVALAKKAGAIIDHADVTVICEAPKVGPYRPAMRKHIAQILGLPEQRVSIKATTTEKLGFTGRKEGIAAQAVTSIRLPDILC

SEQ ID NO: 15408 - protein, 538 aa, Clostridium thermocellum ATCC 27405
MSYLTVGLILILALFAIRFSNRYGIPALLLFIVLGMFFSIGIDFGDYEFADTFATVALMVIMFYGGFGTNWKMGKPVAKEAIVLSSLGVITTALMTGLFCHYVLGFKLLEGMLIGSIVGSTDYASVSNILRSKNLNLKYNTASLLELESGSNDPTAFTMTMVFLSAIIGTKLSVPVLILSQVVLGIVMGCIFSFVIGKLLKNYSLESDGLYAVFMASIILVTYAATDLLGGNGYLALYILGIYLGNMEFKGKRNIMFFFDGFTEIMQIGLFFILGLLSELPKFIAGLPWALAIMLFMTVIARPVTVYGLMLPFRLKFNQLNIISLAGIRGAAAIAFAIMAVNSPAVLSVDVYHIVFGICVLSSLIQGSLMPFAAKRLDMLDPGDTVLKTFNYYQDKSEIGFLETRIGPNSSLIGKKVKDLNLTFDFIVAKIERNGKTIVPRGHVTIKENDLIVIGGAVHFDKTGHELTEFTISKGHKWPNKYIKDLELPHNHLIIMIQREGNEIIVPVGDTLLLEGDKIIMIKAEHPLEFPLANEMAT

SEQ ID NO: 15409 - protein, 151 aa, Oryza sativa Japonica Group
MVPGGMGGGGPMGAAAAGGGGGGDGRHDDEAVLTEFLSSLMDYTPTIPDELVEHYLGRSGFYCPDLRLTRLVAVATQKFISDIASDSLQHCKARVAAPIKDNKSKQPKDRRLVLTMDDLSKALQEHGVNLKHPEYFADSPSAGMAPAAREE

SEQ ID NO: 15410 - protein, 322 aa, Hyphomonas neptunium ATCC 15444
MAANDQVPVGSGFHAKSTAREVVEGISLSGKHAIVTGGYSGIGLETVRALAGAGAKVTVPARRPDAAKDALTGINGVTVAAMDLADLGSVRRFAQDYSAAAPKLDLLINNAGIMACPLAHVGDGWEAQFGTNHLGHLALYQGLLPALRAANGARVVALSSTGHVRSDVIWDDPNYTSRAYDKWEAYGQSKSANALFALGVDMREKANGIRAFSVHPGGIFTNLQRHLPDEEMVALGWKSPDGTIPEMIQAMFKTPEQGASTTVWAATAPKLNGKGGVYCEDCDIARAATPDSKRWEHARAWISDDARAEKLWAMSDTFLANA

SEQ ID NO: 15411 - protein, 116 aa, Arabidopsis thaliana
MKSFENELSTTTAALSSGETQPDLGYLFEASDDELGLPPPLTPPQTLLPPSCEETVTELVRASSDSSEVGELCGFEDHVTEFGPCDLGDDGLFEYFDGCLDSGDLFSWRPEFLPAE

SEQ ID NO: 15412 - protein, 191 aa, Medicago truncatula
MDVYNWFWNFKDNKSLNPYEQAISIIGKTLAPFAEDNLIPCFGFGDSSTHDQEVFGLYPDERLCNGFEEVLSRYREIVPNIRLAGPRSFAHIVKTATAIVERSGGQYHHVLMILANGQKDPSSDVGGRTNLKKLAQVTRTRHGRLSPQERKTMDAIVEASKFPLSIILVGVGDGPWDKMKEFCDNIPTKGL

SEQ ID NO: 15413 - protein, 330 aa, Streptococcus agalactiae NEM316
MRSLFGGLREKVASDYVKIVFPEGSDERVLRAAARLKFEGLVDPVILGKADEVHDSLARLGFVDQDYSVIDPEQYEKFEEMKEAFVEIRKGKATMEDADRLLKDVNYFGVMLVKLGLADGMVSGAIHSTADTVRPALQIIKTKPGISRTSGVFLMNRESTQERYIFADCAINIDPNAQELAEIAVNTADTAKIFDINPKIAMLSFSTKGSAKAPQAEKVQEAAKIAKDLSPELAVDGELQFDAAFVPETAEIKAPNSDVAGKANVFIFPDLQSGNIGYKIAQRLGMFEAIGPILQGLNAPVNDLSRGSSAEDIYKLAIITAAQAIDEKSK

SEQ ID NO: 15414 - protein, 213 aa, Kineococcus radiotolerans SRS30216
MSEILSAPGLVTPQQARTGTPGMGLDDNVYQRLLQQRIIWLGTEVRDDMANAICAQLLLLAAEDPDADIFMYINSPGGSVSAGMSIYDTMQYIKPDVATIATGMAASMGQFLLCAGAAGKRSALPHAKIMMHQPLGGLGGSASDIKILAEQIIATKKQMAELIAQHSGQTFETITRDSDRDRWFSAQEAKEYGLIDHVVGHTSEVEGGGGTDA

SEQ ID NO: 15415 - protein, 361 aa, Arabidopsis thaliana
MEAKEETPWSSILVPSVQEMVKDKMITTVPPRYVRYDQDKTEVVAHDSGLISEIPIIDMNRLCSSTAVDSEVEKLDFACKEYEFFQLVNHGIDPSFLDKIKSEIQDFFNLPMEEKKKLWQTPAVMGGFGQAFVVSEDQKLDWADLFFLIMQPVQLRKRHLFPKLPLPFRDTLDMYSTRVKSIAKILLAKMAKALQIKPEEVEEIFGDDMMQSMRMNYYPPCPQPNLVTGLIPHSDAVGLTILLQVNEVDGLQIKKNGKWFFVKPLQNAFIVNVGDVLEIITNGTYRSIEHRAMVNLEKERLSIATFHNTGMDKEIGPARSLVQRQEAAKFRSLKTKDYLNGLFSRELKGKAYLDAMRIEGK

SEQ ID NO: 15416 - protein, 406 aa, Medicago truncatula
MAVGGGGSVKNPAICGCSAQPTGVGGGALVIRRNDAQHGSLSSQKLHTVDAIVEARKFPLSIILVGVGDGPWDMVKEFQDNIKMQTRTFHNFKFVNFTEIMSKSNNISPSLKEAEILLAIREILFQYKAAKELGLLGVALPTPSASRGTSKPYYRSASFPSASSRPYQSASFEGRAPFYPNDNNLASPSSTYYNKAKRESGLPLSLKKLGNTREKKSLTWKAFISHACDSVLDIPPKYHWALLLICVSFLSYQAKNTTAPFEYFQLEKTIKAPPQTLVLAFGEAFEVFFPEITHITKFMLCYFLTLMLVCSLQLGLQIFCILLIISAPLFYFPELVRRASKVGVDCGLFELPLIWFATLGAVGLSLICGILTLLLAYLSWRFLSKGKQNVEDVDVSLEELSEILQV

SEQ ID NO: 15417 - protein, 140 aa, Medicago truncatula
MVIESPKLIFGIDFSQSNQLTGKYSLIRQSLHDIRNVPNSCEKAISIIGKKFSPFLDDNLIPCFGFGDASTSDHDVFSFYRDERFCNGHEEILSRYREIRPNIQPAGTTSFAPIIEMATKIVDQSGGKHHVLVIISDGQV

SEQ ID NO: 15418 - protein, 420 aa, Staphylococcus aureus
MKLTVVGLGYIGLPTSIMFAKHGVDVLGVDINQQTIDKLQNGQISIEEPGLQEVYEEVLSSGKLKVSTTPEASDVFIIAVPTPNNDDQYRSCDISLVMRALDSILPFLKKGNTIIVESTIAPKTMDDFVKPVIENLGFTIGEDIYLVHCPERVLPGKILEELVHNNRIIGGVTKACIEAGKRVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPAYVVDTTKQIIKALSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVLYYNYGNIFNFIDK

SEQ ID NO: 15419 - protein, 481 aa, Pseudomonas aeruginosa
MIPVILSGGSGSRLWPLSRKQYPKQLVALTGDDTLFQQTIKRLAFDGMQAPLLVCNKEHRFIVQEQLEAQNLASQAILLEPFGRNTAPAVAIAAMKLVAEGRDELLLILPADHVLEDQRAFQQALALATNAAEKGEMVLFGIPASRPETGYGYIRATADAQLPEGVSRVQSFVEKPDEARAREFVAAGGYYWNSGMFLFRASRYLEELKKHDADIYDTCLLALERSQHDGDLVNIDAATFECCPDNSIDYAVMEKTSRACVVPLSAGWNDVGSWSSIWDVHAKDANGNVTKGDVLVHDSHNCLVHGNGKLVSVIGLEDIVVVETKDAMMIAHKDRVQDVKHVVKDLDAQGRSETQNHCDLYRPWGSYDSVDMGGRFQVKHITVKPGARLSLQMHHHRAEHWIVVSGTAQVTCDDKTFLLTENQSTYIPIASVHRLANPGKIPLEIIEVQSGSYLGEDDIERLEDVYGRTAEPALQVVAGSR

SEQ ID NO: 15420 - protein, 242 aa, Geobacillus stearothermophilus
AAAKPATTEGEFPETREKMSGIRRAIAKAMVHSKHTAPHVTLMDEADVTKLVAHRKKFKAIAAEKGIKLTFLPYVVKALVSALREYPVLNTSIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 15421 - protein, 346 aa, Rubrobacter xylanophilus DSM 9941
MKAMALAAGKGTRLFPLTGEVPKPMAPVVNTPIIEHIFALLASHGMRKVYVNVHYLADALLNAYGQTSRINGMEVHLSREERLMGTAGGVKRLADRFDETFVVVSGDALTDIDLGELVAFHREKGALATIALKRVYDTSEFGVVDIDAGGNIRGFQEKPPPEEAISTLANTGIYVLEPRALEYIPEDTFFDFAKDVFPQLLEAGEKFVGYQGDFYWSDIGTLSAYRQAHYDVLSGKVRVRIPGEKRSKGLWIGEDAKIHPSASFEGYVVIGGDAVIGRDVVLSGSVTVGRDCWIRRGATIKSSILLPGSTVGDGAYLEDCIVGHGYDVRPGEIIRGGALIRRPPGH

SEQ ID NO: 15422 - protein, 266 aa, Solanum melongena
DDGSVDRTWTGPPEVKFMAEPVSPHDDFVDGVAVKDVVADEKSGNRVRIYLPERNDSSVDKLPVVLHFHGGGFCISRADWFMYYAVYTRLARVANVIIVSVFLPLAPEHRLPAACDAALAALLWLRELSRKQSQEPWLNDYADFNRVFLIGDSSGGTIVHQVAARAGEEDLSPMKLAGAIPIRPGITRSQRSKSELEQEQTPFLTLDMVDKFIALALPIGSTKDHPITCPMGEAAPALEELKLPPYLYCVAEKDLIKDHEMEFYEA

SEQ ID NO: 15423 - protein, 484 aa, Agrobacterium tumefaciens str. C58
MAKAATPKKTAAVNGAGKVTQVIGAVVDVAFEGELPPILNALETQNNGNRLVLEVAQHLGENVVRTIAMDSTEGLVRGQSVADTGAPIEVPVGLETLGRIMNVIGEPVDEAGPIVTAKKRAIHQDAPSYVEQSTEGQILVTGIKVVDLLAPYAKGGKIGLFGGAGVGKTVLIMELINNVAKAHGGYSVFAGVGERTREGNDLYHEMIESNVNKLGGGEGSKAALVYGQMNEPPGARARVALTGLTIAENFRDEGQDVLFFVDNIFRFTQAGSEVSALLGRIPSAVGYQPTLATDMGQMQERITTTNKGSITSVQAIYVPADDLTDPAPATSFAHLDATTVLSRSIAEKGIYPAVDPLDSTSRMLDPMIVGEEHYEVARKVQSTLQRYKSLQDIIAILGMDELSEEDKLTVARARKIERFLSQPFFVAEVFTGSPGKLVALEDTIKGFKGLVNGEYDSLPEAAFYMVGSMEEAIEKAKKLTAEAA

SEQ ID NO: 15424 - protein, 335 aa, Bdellovibrio bacteriovorus HD100
MSKLRVGINGFGRIGRVLFRAGFEKFDIVGINSLDSIEGDAHLLKYDSAHGVFNADVSTEGHNLIVNGKKIAVSKTRNPAEVPWKDLGVDLVLECTGAFKKREDFMQHISAGAKRVLVSGPAEKGADITMVYGINHESYDPSKHVVVSNASCTTNCLAPLAKVLNDTFGIEHGTMMTVHSYTNDQKILDAPHSDLRRARAAAVSMIPTTTGAAKNVGLVLPELKGLIDGISVRVPTPNVSLVDFTFTAKKDVTRESVNEALIKASEGAMKGVLAVEHNELVSVDFNGNKHSSIVDLATTMVVGPRMVKVLSWYDNETGFSNRMVDVALHMQKKGL

SEQ ID NO: 15425 - protein, 428 aa, Lactobacillus acidophilus NCFM
MLKSVIENVHALEIFDSRGNPTVEVHVTLSNGVVGKAEVPSGASTGENEAVELRDGGSRLGGKGVSKAVNNVNTEINDALKGMDPFDQPKIDQTMIDLDGTPNKGRLGANAILGVSMATAVAAANANRQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIIKAGYKPGEDIGIACDCAASYFYNKEDGKYHLEGKVLTDDELAAYYDKLLDEFPELMSMEDPYDENDVEGMVKFTATHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 15426 - protein, 401 aa, Bdellovibrio bacteriovorus HD100
MANGLKGIKTVRDFELAGKVVFLRLDLNVPMENGKITDENRITASLPTIKYCMEQGAKLVMASHLGRPKTKDDTEFSLEPVAKRLQDLLNAEVILVEEPDSDAPKHLLPSLKPHQLILLENVRFEEGETKDSVEFAQKIANYSDIYINDAFGASHRAHATIHALPSVMKDKGIGFLIEKEITMLDSLLQNPKRPYIAVMGGAKVSDKIAVIERLMDVVDGFIVGGAMAYTFLKAQGLPVGKSLVENDKLKYAKEMIERIEARNKTILLPVDHVATKGITDTAHAHVTNDVAIAEDELGVDIGPKSIKNFSAALREAGTIFWNGPMGIFENPAFAKGTFGVAQAIADSEAIKIVGGGDSAAAAEASGFAGKMTHISTGGGASLEYLQGDKLPGLEILRTRIR

SEQ ID NO: 15427 - protein, 241 aa, Bdellovibrio bacteriovorus HD100
MKKIFAANWKLFKSPKETREFFGQFKELAGKATGEVVFFPSAISLEAASESLKGTSIKFGAQNCYFQAQGAFTGENSAQVVKDLGGSYVLIGHSERRAIFGEGDALVADKVAFVQGLGLTPMLCIGETLQERESAKTFRVLETQLNLGLAKADKTKPVVVAYEPVWAIGTGKVATPEQVAETHTDVFNILKALGFETAPILYGGSVKPDNAAGLIKQPHVNGFLVGGASLEAKSFSEIASV

SEQ ID NO: 15428 - protein, 435 aa, Cytophaga hutchinsonii ATCC 33406
MNNDLIQTDAAHLWHPYTPLLNTRPYAEVVSAKGMYLHLADGTSLIDAISSWWVNIHGHANEVLAETIKNQILQLDHTLFAGFTHKPAVDFATTFLRVLGCNQQRVIYSENGSTAVEVAMKLAVQYWKSKGRQKTTFLALEGAFHGDTFGAMSVSARGLFTEAFESLLNPVKFIPFPDGTNDAFVLESMEKHIRENAVAAFIYEPLIQGTGGMRTYTAEMLDKMITVCKQNDVLCIADEVMTGFGRTGNAFASQYCTTTPDIMCFSKAITGGLLPLGVTTCSREVEAPFLSGELRRAFFHGHSYTANPTICQLALASLKLFESETCQNNIKRIGAAHQAFVLTHVNHRHIKRIESLGTILSVEIKTGQQANYEHDIRHFLYDFFIKKGILLRPLGNIIYVFPPYIITDQELEKIYSAIVEMLGKLDDYLKNPGMN

SEQ ID NO: 15429 - protein, 478 aa, Candida glabrata CBS 138
MQSMNVQHQVMPGHEQMMPQRDPQNMNMMQNYSPHMGRARMNVQQPNFPMQSMMQDVGNPYLNAQEQDMNKRQMQQNMPMNIQPQLQMQHQNQNFNISTPVNASMPPGLNLYQQQQQQQQQQQQQQQQQQQQQQQQQRQGQGQGQQNQQNQQQQQQQQLGQQQIPQQSQNQGSIGVNPALTNVPKQMGAAANALPGAASALPPMILPPPNHLFVRDVWKGNLYREFASIRRLVQQYNHISISTEFVGTTARPIGNFRSKADYHYQTMRANVDFLNPIQLGLSLSDENGNKPDNGPSTWQFNFEFNPEKEMVSKDSLELLTKSGINFEQHQTMGIDQLEFGQLLMDSGLVLDPEVTWVTYHAAYDLGFLINILMNNSMPNNKDDFEWWVHKYLPNFYDLNLVYKAIQDFKQPNQQQQYTLTSLADDLGIPRFSIFTTTGGQSLLMLLSFCQLAKVSLNKLPNGADLISYRNIIYGIDGE

SEQ ID NO: 15430 - protein, 330 aa, Candida albicans SC5314
MTKSPIPIWLDCDPGNDDAFAILLSLFDSRFQLLGISTVHGNAPISMTTHNTLGLLDLLRVYNKVKVYKGAEFPLKVPSKFALEVHGKNGLADIEFSENTINEISQDMDCIEAMKQTIDLNSENINLVCTGTLTNVAKLITKYPDVTSQIKWVSIMGGSFGFGNITPYAEFNLHTDPHAAKLVIQELSNKVILSPLNFTHKVIATSEIRKHMYDDNNEKRSSPIRNVFFRILTFYYKVYAANGFLEGPPIHDPLAVYSLLPFFNSFEQYGYTCAQKNIDIITEGVRMGESVIVEGGNTDKGVYIGEAIDNKKFWDSILLALQNADLQTKN

SEQ ID NO: 15431 - protein, 306 aa, Bacillus halodurans
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIQDM

SEQ ID NO: 15432 - protein, 253 aa, Xanthobacter autotrophicus Py2
MPHAAPVGRARGTGTETPMVHAEDPKRRAAAHALTYVTDGMRLGLGTGSTARHFVELLAEKVHAGLNILGVPTSEQTLSQAVSLGVPIATLDEAGPLDLCIDGADEVGPGLALIKGGGGALLREKIVASAAREMVVIADSSKKVAMLGRFPLPIEVVDFGVASIERHVADAVRKAGCEGPVKLRRDGDGHPFVTDQGHLILDVHLGRIPDPAALARAVEEVAGVVEHGLFLGLARRVVLAGADGITVLEPGSF

SEQ ID NO: 15433 - protein, 142 aa, Hyphomonas neptunium ATCC 15444
MADRVLIAISRYYKHISDELEAGALEVLEAAGAKITVMEVPGAFEIPGVIAMSADSGRFDGAVALGCVIRGETSHYDYVCGESARGLMDLIVQRRQAIGYGILTVENEAQALARADRKRKNKGAEAANACLAMIKFRKELIG

SEQ ID NO: 15434 - protein, 170 aa, Zymomonas mobilis subsp. mobilis ZM4
MDSGEVIERHTLSVTVDNVAGILARISGMFSTRGYNIESLTVADVTKDNAISRLSIVTSGLPHVIDQMVHQLDRLPPVHRVVDLTAIGPHVERELALIKVVGVGDNRIEALRLAEVYHARVVDATIASFIFEVTGTTEKVEKFLELMGELGLVEVARTGIAAMARGRDAF

SEQ ID NO: 15435 - protein, 388 aa, Candida glabrata CBS 138
MVLWWRRIKKVSESKKTSRKPKNTAFRQQRLKAWQPILSPQSVLPLLIMVACIFAPIGVGLLVSAFNVQKLEIDYTDCDQLVAGNDYTFIPHDKVKHQFKRKLSVYPQWKLESGTDGDVCKLQFEVPHQMKKSIYMYYKMTRYHQNHRKMVEAFDKKQLKGKAISGSKLDKKCDPLRTIGDKIVYPCGLTANALFNDTFSETLAGVKGSSDYEMTKNGTAWGTDRHRYGKTEYDASEIVPPPNWAHMFPNGYTNDNIPNLGQWPEFQIWMRTAALPSFYKLYMKNDDDNLPRGTYEISIGMNYLVRSFGGTKSILLTDNSIIGATNIALGIIYLVVAVIATLFAVIFLLKVLIQPTNVKGHMYLDFDSIDQSSFYSRNSANTPLREIL

SEQ ID NO: 15436 - protein, 398 aa, Bradyrhizobium sp. ORS278
MTHIDTDAAWPDHKPTALLVLADGTVLEGYGLGAEGHAVGEVCFNTAMTGYEEILTDPSYAGQLITFTFPHIGNVGTNDEDIETVNMAATPGARGVILRTAISDPSNYRATRHLDQWLRARGIIGLSGIDTRALTALIRSKGMPNAVIAHSKDGTFDLDALKKEAREWPGLEGMDLVPMVTSTQRFNWDETPWVWNEGFGQQAKPEFNVVAIDYGIKRNILRLLAGVGCKVTVVPATTSAENIMAMKPDGVFLSNGPGDPAATGKYAVPVIQQVIASGTPTFGICLGHQMLGLAVGAKTKKMHQGHHGANHPVKDETTGKVEITSMNHGFAVDQDTLPAGATQTHISLFDGSNCGIQLEGKPVFSVQYHPEASPGPRDSHYLFQRFAELMREKKRSAA

SEQ ID NO: 15437 - protein, 586 aa, Bacteroides fragilis NCTC 9343
MYIENINSPKDIKELSVEQLSVLAEEVRTALIRKLSEHGGHIGPNLGMVETTIALHYVFNSPIDKIVFDVSHQSYVHKMLTGRMAAFLDPAKYDDVTGYTNPDESEHDFFTIGHTSTSVSLAMGLAKGRDLTGGKENIIAVIGDGSLSGGEALEGLNNAAMLGSNMIIIVNDNDQSIAENHGGLYKGLKELRDTNGESPDNIFKAMGLEYYYLGDGHDVSALIKLFTSVKDIDRAVVLHIHTIKGKGLKYAEENKEYWHAGGPFHIEDGSPKGPGWPVNETVRESVLDLIEKRSDVVAITAGTPSVIGFTEDYRKRAGKQFVDVGIAEEHAVAMASGIARNGGTPIFGVFSPFLQRTYDQLSSDLCLNNNPAVIMVFMASVYGMNSNTHLGIYDIPMISHIPNLVYLAPTSKEEYLAMFKYATTQKAHPIAIRIPMMMPETGIEDTTDYSLLNKYQVVRKGSGVAIIALGDFFELGVQIADKYKILTGNDVTLINPKFITGIDEELLECLKTDHELVLTLEDGIVEGGFGQTIASFYGLSDMKVKNYGIKKSFPTDFRPEELMRENGLSVEQIIEDIKSVCREHVM

SEQ ID NO: 15438 - protein, 448 aa, Physcomitrella patens subsp. patens
MENQSWPYFDPDYETASSSFDPPRVTIENDTSDNVTVVQVHSADRHGILLNVVQVLTDLDLVIVKSDMFSDKGWFFDVFHVVDHSGNKVRDRSVLDHIQNSLGYRTRREQSSADLLRRSSGLSVSDHTVVELTGPDRPGLLSEISAILTQLDCNVNAAEVWTHNLRVACVIYLTDTTTGGPIQTQSRLELIKEQLSKVLRGAHDENLARWKIEYATEITHVERRLHQLMYDDRRHAGQDYSRSSEDRPKIQIKRNERGYSMVSIQCKDRPKLLFDIVCTLTDMQYVIHHALINSHEADTTQEFFIRHENGCTLETPAEQHLIVCLEAAINRRTTKGLRLELCMNDRVGLLSEVTKIFRENGLSVARADVSTRDDKAVNVFYVLDASGRPVNMKVVEEMRKTIGHAILQVKGTPPQESELPNPGANFFGGLYRTFSGLTSMNWRSTAIA

SEQ ID NO: 15439 - protein, 308 aa, Solibacter usitatus Ellin6076
MDKSACYIQRVIQSAVVPVAGLGTRLLPATKSQPKEMLPVARKPIVQYVVEELVSNGIEQILFVTGRSKASIENHFDHDPELFQALTQANKQDLLSELDVVALKAKFFYTRQRMQRGLGDAIMCAENFAGEEPFLVALGDSILGLNAVSKAVARMADVFDSKRASCVIAVEEVPAEETRHYGIVQPEAGADDVFRVVNLVEKPAPKDAPSNLAIAGRYIFSPVLFDMIRRVKPDKRGEIQLTDAIQFMCEEGRRVMAVKLTPEEKRYDIGNFPSYFESFVEFALADPIYGADFRQVLERLLLKTPAKV

SEQ ID NO: 15440 - protein, 212 aa, Vitis vinifera
MGNMAQEEESVKATPLAAMAEAFEELSKLVKTCPSYHLRLITFCDACSLVSVLFGCLGIAFKFAELEYVSKIRDLLEASKTYDTLEDIIDRDIENNTVRSAGSHSRNLRRVRQGLDLIRALFEQFLLSDDFSLREAASAAYSQVCAPYHTWAVRTAVSAGMYALPVREQLLVRLNENGQSAEKQMRRYINASLPVIAYIDELYMARNISLDW

SEQ ID NO: 15441 - protein, 148 aa, Triticum aestivum
  misc_feature (22)..(24): Xaa can be any naturally occurring amino acid
  misc_feature (28)..(28): Xaa can be any naturally occurring amino acid
RAIEEFIHRHPWPPEQSILRAXXXCFSXPLRLRVAVAKPLAAPMRRQLLRAQATYNVKLITPEGEMELQVPDDVYILDFAEEEGIDLPFSCRAGSCSSCAGKVVSGSVDQSDQSFLNDNQVADGWVLTCAAYPTSDVVIETHKEDDLL

SEQ ID NO: 15442 - protein, 361 aa, Triticum aestivum
  misc_feature (350)..(351): Xaa can be any naturally occurring amino acid
MKALILVGGFGTRLRPLTLSVPKPLVDFANKPMILHQIEALKDVGVTEVVLAINYQPEVMLNFLKDFESKLGIKITCSQETEPMGTAGPLALARDKLDDGSGEPFFVLNSDVISEYPFAELIEFHKSHGGEATIMVTKVDEPSKYGVVVTEEETGKVERFVEKPKVFVGNKINAGIYLLSPSVLDRIELKPTSIEKEVFPRIAADKGLYAMVLPGFWMDIGQPRDYITGLSLYLESLRKRAPARLAAGAHVLGNVLVHETATIGEGCLIGPDVAVGPGCVVEAGVRLSRCTVMRGARVKKHACISGSIVGWHSTVGKWARVENMTILGEDVHVCDEVYSNGGVVLPHKEXXSSILKPEIVM

SEQ ID NO: 15443 - protein, 580 aa, Pseudomonas syringae pv. phaseolicola 1448A
MDATTINSLFLVGALLVAASILVSSLSSRLGIPILVIILAVGMVAGVDGGGIIFDNYATAYLVGNLALAVILLDGGLRTRVASFRVALWPALSLATVGVLITTVLTGMVAAWLFNLSVIQGLLIGAIVGSTDAAAVFSLLGGKGLNERVTASLEIESGSNDPMAVFLTVTLIGMLASGQTGLHWGLLGHLIQEFGIGSFIGLGGGWILLQLVNRINLAAGLYPILVIAGGLAIFALTNAIHGSGFLAVYLCGLVLGNRPIRSRHGILHMLDGMAWLAQIGMFLVLGLLVTPHDLLPIAIPALGLALWMILVARPLSVMVGLLPFKAFHGREKAFIAWVGLRGAVPIILAVFPLMAGLPNAQLYFNLAFFIVLVSLLLQGTSLPWVAKLLKVTVPPDPAPISRAALEVHVTSEWELFVYRLGAEKWCIGAALRELKMPEGTRIAALFRGQQLLHPSGSTTLEVGDLLCVIGHEHDLPALGKLFSQAPQRGLDLRFFGDFVLEGDARLGEVAALYGLKLDGIDPGMPLSQFIVQKNRGEPVVGDQIEWNGTIWTVAVMDGNKIQKVGVKFPEGTRPGPGLFL

SEQ ID NO: 15444 - protein, 359 aa, Dehalococcoides sp. BAV1
MYHNVTLIPGDGIGPEISEATRRVLEATGVKFNWEVVNAGADVVAEYGTPLPDIVLESIRKNKVAIKGPVTTPVGSGFRSVNVGMRKALNLYTCLRPCKTYPGVPSRYDNVDIVIVRENMEDLYAGIEFEKGSAEALRLIEFIKENKKVEIRTDSGISIKPISVFGTERIFRWAFKYAKDNNRKKVTAVHKANIMKYSDGLFLAVGRKVAEEYPEIEFEDRIVDNMTMQLVKTPTQFDILVCPNLYGDILSDLCAGLVGGLGVAPGANIGDEYALFEPTHGSAPKYKGLNKVNPMAMMLSGVLMLRYLKEEKAADKLENAIAAVIAEGKSVTYDMLSPDKQAVAVGTSQVADAIIAKMK

SEQ ID NO: 15445 - protein, 403 aa, Bdellovibrio bacteriovorus HD100
MKVSFADIQKARELLKDIICPTEMSHSISASNLLKSEVYLKFENTQRTGSFKFRGAYNKISNLTADEKARGVVASSAGNHAQGVALSAKLAGVKSTIVMPETASISKASATRDYGANVVLKGEIYDEAFEHAQKLEKEHGYTFVHPYQDPYVIAGQGTIGIEILEKVPDLDTVIVPIGGGGLISGVALAVKAINPKIRVIGVQSDRSPGMAHLYNKQPLSQIKRAATIADGIAIKNPSQVMLDSFISKYVDQVVTVSDDEIAEAIVFLMERAKTVAEGSGAAAMAAAMSRGLDLGKKTCVIISGGNIDLNIVSKIIDRGQILRGRLCELSVIVDDLPGNLSRLTQAIASQKANILEVRHDRVSKGLSLRETRIDFVLETTSIEHVERIKRALEETGAKVIQST

SEQ ID NO: 15446 - protein, 455 aa, Xanthobacter autotrophicus Py2
MSRREVDLFVIGAGSGGVRAARIAAQHGARVMMAEEYRVGGTCVIRGCVPKKLFVYAGRFAHDIEDMAGFGWRVTEPEFDWLTLVANKDKEIARLEAIYRRNAENAGVEVVASRAVVVGPNSVRLLATGEEIGARYILLATGARPALGPAIPGCELAITSNEAFNLTHFPNRILVQGAGYIAVEFAGLFRALGADVTLVYRADKVLRGFDGEIRDHLEAEMTRAGIHLKPGRTLTSIEVINGGKRVTLSDGSVVEVDDVMLALGRIPNTAHLGLDTVGVKLDEVGAVVVDETGATNVPSIYAVGDVTNRINLTPVAIREGHAFADTVFGNKPWTVDHSLVATAVFSEPEIGTVGLSEEAARALGRPIDIYSTSFRPLKATLSGRETRTFMKLVVDKESDVVLGCHIMGDAASEMIQLAGVALGLKAKKADFDRTVAVHPTSAEELVTLRTPTRSV

SEQ ID NO: 15447 - protein, 629 aa, Oryza sativa Japonica Group
AWSWKPCKWNRDSQLQPLLLGFFFVRLWTAAIERVGLLRQPFTRQENTVIQTCVVAGYDIAFSGGFGNYILSMSERIAGLGTEANNAQNIKNPHLGWIIGFLFLVSFIGLFGLVPLRKVMIIDYKLTYPSGTATAFLINGFHTPHGAKIAAKQVKKLGIFFILSFFWGFFQWFYTATDDCGFHKFPSLGLQAFQHKFFFDFSPTYVGVGMICPHIVNVSVLLGGILSWGIMWPLIAKKRGDWFSADLPDGSLHGMQGYRVFIAIALILGDGLYNFLKMIILTAFSLRSQIKKKNASTLPVSDDGMVTTTAAVSYDEERRNELFVKDQIPWYVAYGGYAVVAAISIGTVPQIIPQLKWYQILVAYIVAPILAFCNAYGTGLTDWSLVTTYGKLAIFAFGAWTGASHGGVLAGLAACGVMMNIVSTAADLMQDFKTGYLTLASPRSMFVSQVIGTAMGCVIAPCVFWLFYKAFDNIGISGSDYPAPNAAVFRSIAILGVDGFSSLPKNCLNLCYAFFAAAIVVNLIRDLVPKVSRFIPIPMAMAIPFYIGSYFAIDMFIGTVILFVWQRVDRAKADTYGPAVASGMICGDGIWVLPQSVLALAKVKPPICMKFLSRRTNDKVDAFLTTLGK

SEQ ID NO: 15448 - protein, 56 aa, Nicotiana tabacum
PGFLSMANAGPGTNGSQFFICTAKTEWLDGKHVVFGQVVEGYDVIKKAEAVGSGSG

SEQ ID NO: 15449 - protein, 576 aa, Oryza sativa Japonica Group
MASHANAYGIAFSGGFGTYLFGMSETIAKQATEANNAQNVKNPHIGWMIGFLFLVSFIGLLALVPLRKIMIVDYKLTYPSGTATAYLINGFHTPEGAKLAKKQVKELGKFFLFSFVWGFFQWFYTAGDGCGFQSFPTLGLQAYKNRFYFDFSPTYVGVGMICPHIVNVSVLLGGILSWGIMWPLIRNKKGSWYAASLSETSLHGLQGYRVFISIALILGDGLYNFVKVLIRTTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 15450 - protein, 494 aa, Bacillus pumilus SAFR-032
MGKATGFMDYKREKPNERDPLTRQNDWKEYSAPYTNDVLKKQGARCMDCGTPFCQIGMEIRGGVSGCPIYNLIPEWNDLVYRGRWKEALERLQKTNNFPEFTGRVCPAPCEGSCTVAINDPAVSIKNIERTIIDKGFENGWITPRIPSSRTGKKIAIVGSGPAGLASADQLNQAGHAVTVFERSDRLGGLLTYGIPNMKLDKEVVERRVKLLRQEGIDFVTNTEIGVDVTADELKEQFDAVILCTGAQKQRDLLIEGREAKGIHLAMDYLTLATKSMLDSGFKDKNFIDAKGKDVIVIGGGDTGADCVATALRQKAKSVVQFGKHPKLPDTRVGDNMWPEQPYVFSLDYAYEEAQAKFGEDPRQYSIQTTKIVADKNGKLKELHTIQMEKMKNEHGKFEFHEIPGTEKVWPAQLVFIAIGFEGTEQPLVKHFGVDSKNNRIDAKYGEYTTNVEGVFAAGDARRGQSLIVWAINEGRQVAHEVDRYLMGSSVLPK

SEQ ID NO: 15451 - protein, 335 aa, Cytophaga hutchinsonii ATCC 33406
MSKIKVGINGFGRIGRLVFRAAVNNPNIQIVGINDLIDVDYMAYMLKYDSTHGRFSGTVDVTDGKLVVNGNAIRVTAERDPANLKWNEVGAEYVVESTGLFLTMDTADKHIAAGAKRVVLSAPAKDDTPTFVMGVNNKSYTKDMTIVSNASCTTNCLAPVAKVLNDNFGILEGLMTTVHAATATQKTVDGPSAKDWRGGRGAYQNIIPSSTGAAKAVGLVIPQLKGKLTGMSFRVPTPDVSVVDLTCRLEKAASYETIKAAMKAASEGDMKGILGYTEDEVVSTDFLGDARTSIFDAKAGISLNDNFVKVVSWYDNEWGYSNKLVDLIVHMDTVK

SEQ ID NO: 15452 - protein, 882 aa, Oryza sativa Japonica Group
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPFTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKTPETDMLRMMQVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFNIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGCKFALTILSSQIADLLLRSSYLVFDGSEYLSTPFGLGHLHASNRKNAGNNNVRSLFLEGVKTYLPPQLRSSVLPPSTGVPDLRPFRWGFPPSAATASICPRARSQLGCDARRSEWEREMGADRRRIAGWSLGGGRGMVASPISAPAPARRPGGRWPACEL

SEQ ID NO: 15453 - protein, 385 aa, Ascophyllum nodosum
MAPVINAVAAMAFAGSASAFVAPSAFNGAAVSTNSATSSTKLSMATDCGINGFGRIGRLVARSMVKNPETNLKLINTGAAPEYMAYQFKYDTVHGKFGGTVEVDGMDLILDGQRVPTSHTRNPEEIPFVATGAEYVCESTGAFLTEEKVQPHLKAGAKKIVFSAPAKDDSHTIVMGVNAETYESSMNLVSCASCTTNGLAPTVKVINDNFVIKDALMTTVHAMTATQMVVDGTSKKDWRGGRCASSNIIPSSTGAAKAVTKVIPQLKGKLTGMAFRVPTPNVSVVDLTCTLEKSTSYEEICAAVKSASESGPMAGIIGYTEEPLVSTDFISDSRSSIFDAGAGIMLNPNFVKVVAWYDNEWGYSQRVMDLMCHMSTVDAKAGVKA

SEQ ID NO: 15454 - protein, 535 aa, Oryza sativa Japonica Group
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 15455 - protein, 431 aa, Bacillus thuringiensis serovar konkukian str. 97-27
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFHFEFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAVLVIILNIFLLYQTFVG

SEQ ID NO: 15456 - protein, 431 aa, Desulfovibrio desulfuricans G20
MSTIVSVWAREILDSRGNPTVEVEVSLESGHSGRAAVPSGASTGSREALELRDGDKGRYLGKGVEKAVDNVMGEIAENIVGMDALRQVAVDNALIDLDGTDNKDRLGANAMLGVSLATARAAANFIGMPLYQYLGGINSKVLPVPMMNIINGGEHAPNNLDIQEFMIMPVGAPTFSEALRMGAEIFHNLKALLAADGHVTSVGDEGGFAPNLKSHDEAFRYIMRAIETAGYIPGSEVALAIDAAASEFYKDGKYHLKGENKVLSSSEMIDWLMDFTQRYPLISIEDGMAEGDWEGWQEMTVKMGDSVQIVGDDVFVTNPDILAQGIDEGVANSILIKLNQIGTLTETLDTVEMAKGAGYTTVISHRSGETEDHFIADLAVALNAGQIKTGSLCRSDRLAKYNQLLRIEEDLDDEGIYFGPYMASHFGLGEE

SEQ ID NO: 15457 - protein, 340 aa, Ascophyllum nodosum
MPINVGINGFGRIGRMVFRACFENPDATVVAINDPFMDPEYMKYLLTHDSVHGRFPASVEVKDGHLVVDGFTVYVFTSKDPAQIPWDSKSADYVCESTGVFTTTEKAKPHIAGGAKKVFISAPPKDDTPMYVMGVNHDKYEKGGADVMSNASCTTNCLAPITKVLNDKFGIVEGLMTTVHAMTINQLAVDGPSKGGKDWRAGRCASANIIPASTGAAKAVGKVIPEVSGKLTGMAFRVPVPDVSVVDLTAKLAKETTYEEICEAMKEASEGCMKGVLGYETEDTVSQDYVHDPRSSIFDSKAGIMLNPTFVKVVSWYDNEWGYSNRMVDLMIHVHKVESS

SEQ ID NO: 15458 - protein, 544 aa, Zea mays
MPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSRRHLNVRGKSATLPSITDKDWDDIKFGVDNQVDYYAVSFVKDAQVVHELKDYLKSCNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGKEVALVQSGKHPIWRSQSTHNIQVRKI

SEQ ID NO: 15459 - protein, 285 aa, Bradyrhizobium sp. ORS278
MIGENTAMPTLPFFQVDVFSKVAFKGNPLAVIAEADGLDDAAMQTIANWTNLSETTFLSRAQDPGADYRVRIFTPQRELPFAGHPTLGSAHAWLALGGRPKGEHVVQECFAGLVRIKRDGDRLAFAAPPLRRTGAVDAELTAKIAAALGIKAEAMRAVQWADNGPGWIAVLMDSRQDLLNIKFNVLALSQQPVGVVAPWDPATDGRDAHYEVRAFTWSGAEDPVTGSLNASLAQWLIGAGIAPKHYIASQGAALGRAGRVHVAQDGGTIWIGGDVAPVVKGTISL

SEQ ID NO: 15460 - protein, 403 aa, Saccharomyces cerevisiae YJM789
MEIYIRLNADVEHDYAFQVSNEDTINNKIKKIFPSKTGLADLMVLRPSIFHEKEPVKFYKSIHPGYLSEGGCLMFHYEADNEENLEELNDSKPLIDQLWPGQLVVPEWKLSKKNIWVYTIIMLAWLYTDLPDAISPTPGICLTNQLSRLLIPVAKHMDLPEIAAKLEQEVQANYSSLVAQWLFFVMHIFKVGIITLFLKLGIANPISFNPYKLWSLRDLTSPSANGAKNSGGNNNTTDLKTRLRSLGWIGAKRATYDDYQTNYYNYVIDKMGGAVAAYRAGAIRKAAAPGIQLVAGEGFQSPLEDRFTASTFTAIKTERKFILSEEYFVELENNLKKILEEYDGDIGKMNAEIRRFRRFGIYEPDEKLASLVKLRREIADEKEKASNSDATFGIKKNDLKKSN

SEQ ID NO: 15461 - protein, 348 aa, Salmonella enterica subsp. arizonae serovar 62:z4,z23:--
MEFFRKTALAALVMGFSGAAFALPNITILATGGTIAGGGDSATKSNYTAGKVGVENLVNAVPQLKDIAMVKGEQVVNIGSQDMNDEVWLTLAKKINIECDSTDGFVITHGTDTMEETAYFLDLTVKCNKPVVLVGAMRPSTSMSADGPFNLYNAVVTAADKQSANRGVLVVMNDTVMDGRDVTKTNTTDVATFKSVNYGPLGYIHNGKIDYQRTPQRKHTSSTPFDVAKLTALPKVGIIYNYANASDLPAKVLVDAGYDGIVSAGVGNGNLYKTIFDTLATAAHNGTVVVRSSRVPTGATTQDAEVDDAKYGFVASGTLNPQKARVLLQLALTQTKDPKQIQTIFNQY

SEQ ID NO: 15462 - protein, 120 aa, Streptococcus agalactiae NEM316
MDKIYLNKCRFYGYHGAFSEEQTLGQVFQVDAVLSLDLAKASQTDDLIDTVHYGEVFDCIKNHVENEQYQLIEKLAGVIVEDIFLQFHPVQAITLKITKDNPPINGHYESVGIELERKRV

SEQ ID NO: 15463 - protein, 136 aa, Glycine max
MSNSSAGTSSKPRTASSQPSETSSKRKRGVFQKELQHMMYGFGDDPNPLPESVALMEDIVVEYVTELVHKAQDIGSQRGKLSVEDFLYLIRKDSPKLNRCTELLSMNEELKQARKVFESDEEKLRKVFEVDDSVEG

SEQ ID NO: 15464 - protein, 496 aa, Vitis vinifera
MPQASPELSSSVKLKYVKLGYQYLVNHILTLLLIPIMVGVLIEVLRLGPDEILNLWNSLHFDLVQILCSSFLIIFATTVYFMSKPRSIYLVDYACYKPPVMLRVPFATFMEHARLVLSSQPKSVEFQTRILERSGLGEETCLPLTVHYIPPRPTMEAARDEAQLVIFSAMDSLLNKTGLKPKDIDILIVNCSIFSPTPSLSAMVINKYKMRSNIKSFNLSGMGCSAGLISIDLARDLLQVHPNSNAVVVSTEIITPNCYQGNQRAMLVPNCLFRMGGAAILLTNRRWEHRRAKYRLVHVVRTHKGADDKAYRCVMEEEDPEGKVGISLSKDLMVIAGEALKTNITTTGPLVLPASEQLLFLLTLIGRKIFKQNWKPYIPDFKLAFEHFCIHAGGRAVIDELQQNLQLSAEHVEASRMALHRFGNTSSSSLWYELSYIEAKGRMKKGDRIWQIAFGSGFKCNSAIWKCNRSIEPPRDGPWLDCIHRYPVHIPEVVKL

SEQ ID NO: 15465 - protein, 335 aa, Solibacter usitatus Ellin6076
MAIKVGINGFGRIGRNVVRAGLHNSDVEFVAVNDLTDTATLAHLLKYDSVLGTLPETVTHDATSITVGGKTIKVFATKDPAELDWASVGAQIVIESTGRFTDGKDAAKHMRGTVKKVIISAPAKNEDVTLVLGVNDAAYDAKKHNIISNASCTTNCLAPVVKVLNEKFGVEKGSMTTIHSYTNDQNVLDFPHKDLRRARAAALNMIPTTTGAAKAIGLVLPELKGKLDGYSMRVPTPDVSVVDFVCILKKPSTTEAVNAALKAASEGELKGILGYTEDPVVSTDMLRNPNSSIVDAQLTKVLDGNLLKVVAWYDNEWGYSSRVVDLVGFLAAKGL

SEQ ID NO: 15466 - protein, 239 aa, Zea mays
  misc_feature (167)..(167): Xaa can be any naturally occurring amino acid
  misc_feature (215)..(215): Xaa can be any naturally occurring amino acid
MYAAAPSSSRVAAAAAAFFIVISLSPQLLVRPFGASTTVHWAAAQELDEEDFSYRRNAGNGPARWGLIRREWATCNVGLLQSPIGLSDTLAGLADRSGRLGRSYRPAAASLVNRGHSIMVRFNSNPGGVVIDGVAYRLRQMHWHAPSEHAINGRRYALELQMVHQSXHQQLERYIRRIIARRKNHEELIDEEVDPRRPVSRSTAYYKYTGSFTTXPPCTEGVTWVVAPQVNKRKISSFQ

SEQ ID NO: 15467 - protein, 358 aa, Dehalococcoides sp. BAV1
MNLSDLRKQIDNLDTELVKLMAKRLEVSDQIGKIKEETNSPVQDLSRESEVLNRVQSLAQSLGLDPQDIESLYQEILFISKKQQRFTVSFQGAAGAYSEETALKIFGPNTLTLPCEQLDATFEAVEKGMARFAVVPVENSLEGSISRTYDLLLDSNLMVAAEHELRVSHCLIANPATNLEAVKTIYSHPQALGQCQSFLKHLRAELIPTYDTAGSVKMIKEKGLLNGAAIASERAAVIYNMKVLEREIEDNINNYTRFFVLAKQDSAPTGSDKTSVVFAVKHQAGALYDFIKELASRGINMTKLESRPTRLKPWEYNFYLDIEGHRQDENVKQALAKADDHVIFMKVLGSYPKMKKHI

SEQ ID NO: 15468 - protein, 525 aa, Legionella pneumophila str. Paris
MNDLKKSPLLILDFGSQYTQLIARRVREMGVYCEIYPYNINHEQFKKLNPCGVILSGGPSTVTHDANPRAPQWLFESDLPLLGICYGMQTMAVQLGGQVHSSTLREFGYAELRLHGHSQLLSNIEDRTAMDGSALLDVWMSHGDKVTELPPGFKVICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTDIKWLAQGTIYPDVIESAATSTNDAAVVIKSHHNVGGLPDTLNLKLLEPIRELFKDEVRHVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 15469 - protein, 150 aa, Brassica napus
  misc_feature (144)..(144): Xaa can be any naturally occurring amino acid
VFVWLDMEHKRWVFLLAIFACLLFFSRGRVAVLKWKTDDDSPVYNHTLALTLVEYTSAVYMSDLTELFTWTCERCNGLTKGFQVIEIIVDIEHCLQGYVGVAKDLNAIVIAFRGTQEHSIQNWVSDLFWKQLDLNYPDMPDAMXHHGFYS

SEQ ID NO: 15470 - protein, 354 aa, Bacillus anthracis str. Ames
MVMKEQVVEALEGIVDPFLHKTLKETGAIKEVTVKPEKKHVSVKIAIVKTGTAEQMQLQSGIVKLVKELGAATVGLRFAEFTEEELAQFAPEQEEQTESLLSPNSKTTFLAVASGKGGVGKSTVSVNLAIALARLGKKVGIIDADIYGFSVPDMMGIEKRPVVRGDKIIPVERLGVKVISMGFFVEDNAPVIWRGPMLGKMLNHFFTEVEWGDLDYLVLDLPPGTGDVALDLHSMLPACKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAETVIDKTAFAQK

SEQ ID NO: 15471 - protein, 594 aa, Zea mays
MGSFLWKQPSYLFILIILHLVAHEARTLSSDGEALLAFKKAVTNSDGVFLNWREQDADPCNWKGVRCDSHSKRVIDLILAYHRLVGPIPPEIGKLNQLQTLSLQGNSLYGSLPPELGNCTKLQQLYLQGNYLSGYIPSEFGDLVELEALDLSSNTLSGSVPHSLDKLSKLTLFNVSMNFLTGAIPSSGSLVNFNETSFVGNLGLCGKQINLVCKDALQSSSNGLQSPSPDDMINKRNGKNSTRLVISAVATVGALLLVALMCFWGCFLYKNFGKKDMRGFRVELCGGSSVVMFHGDLPYSSKDILKKLETIDEENIIGAGGFGTVYKLAMDDGNVFALKRIVKTNEGLDRFFDRELEILGSVKHRYLVNLRGYCNSPSSKLLIYDYLQGGSLDEVLHEKSEQLDWDARINIILGAAKGLSYLHHDCSPRIIHRDIKSSNILLDGSFEARVSDFGLAKLLEDEESHITTIVAGTFGYLAPEYMQFGRATEKTDVYSFGVLVLEILSGKRPTDASFIEKGLNIVGWLNFLASENREREIVDLNCEGVQTETLDALLSLAKQCVSSSPEERPTMHRVVHMLESDVITPCPSDFYDSE

SEQ ID NO: 15472 - protein, 364 aa, Zea mays
MRSSEASSRLVQELVLYAASAALSCLVLFAGLRHLDPNRAASQKAQQQKKEIAKRLGRPLVSTTPYEDVIACDVINPDSIDVEFDSIGGLDQIKQALYELVILPLRRPELFTFGKLLSPQKGVLLYGPPGTGKTMLAKAIARESGAVFINVRISNLMSKWFGDAQKLVAAVFSLAHKLQPAIIFIDEVDSFLGQRRTTDHEAMTNMKTEFMSLWDGFTTDQNARVMVLAATNRPSELDEAILRRFTQIFEIGIPVQSERSKILQVVLKGENVEHNIDYDHIASLCEGFTGSDILELCKQAAFYPIRELLDDEKKGRKLDKPRPLRQSDLERALSVSRKGKKAASSALQSPLWVRPTDSEDDQIS

SEQ ID NO: 15473 - protein, 205 aa, Glycine max
MKVSSFHSFGLKFLFCLWFAGGHINPAVTFGLFLARKVSLIRAIMYMVAQCLGAICGVGLVKAFQKSYFNKYGGGANSLAAGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 15474 - protein, 265 aa, Bacillus pumilus SAFR-032
MAEGMIAGIVRSGQMPPGQIYATNRQNQLRLNELTTRYGIQTATMDSFPFEEMDMLILAMKPKDAETALESLKPHIQRDQLILSVLAGVKQSYIEDMLHEGQPVMRVMPNTSSTIGASATALCAGRYVKDDHISMSQALLSEMGEVYTIQEEQMDIFTGIAGSGPAYFYFLMERIEEAGEEAGLSKELSRQIGAQTLLGAAKMLQETEEDPSALREKITSPNGTTAAGLNALDDFGGGEAIKQAVKHAANRSKEISKQQKQKVSI

SEQ ID NO: 15475 - protein, 756 aa, Burkholderia thailandensis E264
MDEQLKQSALAYHQNPKPGKISVTPTKPLSNQLDLSLAYSPGVAAACEAIHADPLDAQKYTSRGNLVGVVTNGTAVLGLGNIGPLAAKPVMEGKGCLFKKFAGIDVFDIELAESDPDKLVEAIAMLEPTLGGINLEDIKAPECFYIEQKLRERMKIPVFHDDQHGTAIIASAAILNGLKVVGKDLSSVKLVCSGAGAAAIACLDLLVKLGLSKSNVLVADSKGVIYEGRGNLDPSKQRYAAVTDARTLADAIRDADVFLGCSSAGVLKQDMVKTMADKPLILALANPEPEIRPEDAKAVRPDAIVATGRSDYPNQVNNVLCFPFIFRGALDVGATTITEEMKLACVRAIAELAQETDQSEEVAKAYEGHSLEFGPDYLIPKPFDPRLIIKIAPAVAQAAMDSGVATRPIADMDAYREQLGTTVYRTGMVMRPVFATAKTKAARIVFAEGEDERVLRAAQFVLQERIAKPIIVGRPSVVEMRLQKIGSKLKCGVDFEIVNPEDDPRYQQCWQAYHEMGARDGVTPEVAKAALRKFNTLIGAMLVHLGDADGMICGMIDTYHSHLKFIEQVLGRAKGAEHFAAMNLLMLPGRNLFMCDTYVNEQPSAEQLADMTIQAAAEIERFGITPKAALLSNSNFGSAPSASSRRMAEARKLIVERAPELEVDGEMHGDAALSEVVRKAAFPGTTLTGEANLLIMPNVEAANIAYNLLKMVGGEGVTVGPFLLGAAKPVHILTPAATVRRIINMTAVAAANVQVK

SEQ ID NO: 15476 - protein, 530 aa, Erwinia chrysanthemi
MLVTNNITMQFGSKPLFENISVKFGGGNRYGLIGANGCGKSTFMKILGSDLVPSAGNVAIDPNERIGKLRQDQFAFEQYSVLDTVIMGHAELWEVKEERDRIYALSEMSEEDGYRVADLEVKYGEMDGYSAESRAGELLLGVGIPLEQHYGPMSEVAPGWKLRVLLAQALFSNPDILLLDEPTNNLDIDTIRWLEQVLNERNSTMIIISHDRHFLNMVCTHMADLDYGELRIYPGNYDEYMTAATQARERLLSDNAKKKAQIAELQSFVSRFSANASKSRQATSRARQIEKIQLEEVKASSRQNPFIRFEQDKKLFRNALEIDGLTKGFDNGPLFSQLKMLVGQFKTLLSAHTNGIGKSTLLKTLGGELAPESGTVKWSENVRIGYYAQDHEYEFGGDLTVFDWMSQWKQENDDEQAVRSVLGRLLFSQDDIRKKVNVLSGGEKGRMLFGKLMMEKPNVLVMDEPTNHLDMESIESLNMALELYQGTLLFVSHDREFVSSLATRIVEMMPGKVIDFSGSYEDYLRSRGIE

SEQ ID NO: 15477 - protein, 293 aa, Erwinia chrysanthemi
MPSSRRFKQVDVFSSHPAKGNPLAVILDADGLSDEQMQSIAHWTNLSETTFVLPPDNPLADYRVRIFTPSEELPFAGHPTLGTAHALLESGLTPHVPHQLIQQCGVGLVPVAISNDGQLAFHAPDVTMTELDPHYYALLDSAIGSHLRHPDHPPVNVQMGIRWLTVRMESARACLEARPNATHLQRLQQLGQTNGVAIYGPHDNGNPTDYEVRAFFMINDTVVEDPVTGSANACIARVIQHSPLPEQADHRLGYRVRQGTMLYRDGRVNVSYIDGQPWIGGYSNTLIDGQITL

SEQ ID NO: 15478 - protein, 603 aa, Hyphomonas neptunium ATCC 15444
MALAALTSLVSQRFGAPLLLVFLGIGLLAGEDGLLGIQFDSGSAAYFIGSLALAIILFDSGFETPMRSYKVAAAPALSLATFGVVLTAGLTGVAAHFLFGVGWLEAFLLGSIVASTDAAAVFFLLRAGGIRLREKVGSTLEIESGANDPMAIFLTILLIELIVADAGTDALFGFEVLMTFVQQMGLGILFGIVGGFGISWFLHKLVNVDPGLYPISGLAAALVVFSVCALLGGSGFLAAYVAGVVAGNRKVKFAHRLRRFQVGMTWLAQIGMFLALGLLATPSEFPRILVPALILAGVLIFVARPLAVWLCLLPFDFRSRETLFTGWVGLRGAVSILLAILPGLAGIENGSFYFNVVFVMVLVSLLVQGWTIQPAAKLLKMSLPSEQGLVDRVELELRGATEMELVGYKIHPDSAIAKGERVPRWARPVMVIRDGLSYSVHTIGPLQANDQVYLFASARRVRLLDQIYASPWDEMTVESDIQFRVKGATKMSDLVRQYGLEGIDTSDAVTASQFLDRSFDGKPVLGDRVTIGDVDIVVCALDDAGGVGTVGIVIGEEDPGAGALMADLVRRGGARIAGLVRRPKPISAGPAESAPAKDIGDQA

SEQ ID NO: 15479 - protein, 186 aa, Triticum aestivum
  misc_feature (162)..(163): Xaa can be any naturally occurring amino acid
MASGPASAPAHAPGSAPEPAHGPHPAVASHALFNYKDKDPTGPDKWAKLNKGWAACGDGKKQSPIDICKVEINKDMGPLDQAYKSSACTLENRGHDFILQWKGGNGKLTIEKKDYVLQQVHWHVPSEHTANGTRFDMELHMVHEDSSKARAVVSVLYSTKEXXDPDKTLTDLAPYFKRLAGKYLGA

SEQ ID NO: 15480 - protein, 313 aa, Zea mays
MAGGGSRRAGAAEQPKIGSGNVFAALETLKKKKKPADKGAKPAAREDPKPEVFWAPAPLTAKSWADVEDDDDDDYFATTAPPPRPVWGDAHRDAAKDQHDAPALEEEIESEDDGLDDEVDDDADEDHEDKADDAVPAEPTVKNATAPPAPPKDTERQLSKKELKKKELAELDAVLAELGLGTSNNSIQEEPNGKKGADQVADGEKKEDAPAPLESKNSKKKKSKKEKSSKELKEAQDQANGLEAAAVAEPDEDTASVDVKERIKKVASMKKKKSSKEMDAAAKIAASEAAARSARLAAAKKKEKSHYNQQPVR

SEQ ID NO: 15481 - protein, 278 aa, Haemophilus influenzae
  misc_feature (24)..(24): Xaa can be any naturally occurring amino acid
  misc_feature (56)..(56): Xaa can be any naturally occurring amino acid
  misc_feature (153)..(153): Xaa can be any naturally occurring amino acid
  misc_feature (199)..(199): Xaa can be any naturally occurring amino acid
MSLTLDVWQHIRQEAKELAENEPXLASFFHSTILKHQNLGGALSYLLANKLANPIXPAISLREIIEEAYQSNPSIIDCAACDIQAVRHRDPAVELWSTPLLYLKGFHAIQSYRITHYLWNQNRKSLALYLQNQISVAFDVDIHPAAKIGHGIXFDHATGIVVGETSVIENDVSILQGVTLGGTGKESGDRHPKVREGVXIGAGAKILGNIEVGKYAKIGANSVVLNPVPEYATAAGVPARIVSQDKAAKPAFDMNQYFIGIDDGMNLNEGGSHHHHHH

SEQ ID NO: 15482 - protein, 234 aa, Physcomitrella patens subsp. patens
MRGILVDWLVDVAEEYMLMPDTLYLAVSYIDRFLSFNTVTRQRLQLLGVSCMLIAAKYEEICAPHVEQFCYITDYTYQREEVLEMERKVLIELKFELTTPTTKSFLRRFIRAAQTNCKASTLVLESLGNFLAELTLTEYSFLGFLPSMVAASAVYVAKLTLDPSTCPWDATLQHYTGYRASELEKCVRIIHDLQRNTKNCTLPAIREKYRHHKFKCVATLTPPLVLTPEFFKDA

SEQ ID NO: 15483 - protein, 595 aa, Magnaporthe grisea 70-15
MGIMQGMASRAAGDVKMLAAALSQDATNGKSKLGTFMAPMLPFFLANNAAMQHGKPWGDRTVEGTNPYRQAPTTGSIRSYDWTISRGTIAPDGYEVPALLINGQYPGPMIEANWGDTVQVTVHNNITGPEEGTAMHWHGLLQRGTPYQDGVPGVTQCAIAPGQSYTYSFLADQFGSSWYHSHYSAQYSSGVVGPMVFYGPGRQFYDVDIGPVMLSDWNHQNYQDIIEKMLQPAAKGGNLKVTSDNNLINGKGVFDCSTMAKGDKTRCTPNAGYSKFKFQSGKVHRLRLMNTGSDGIQRFSIDEHMMTVIANDYVPIRPYQTKVVTLGVGQRADVLVKADQAPGSGFWMRSTLAACSEARQPNALAVVYYDEDGDTTPASKPWDVADPKTCANDDISESVPIFRMPVAQPTTTQEFVAEIFTNSSGVSLFKFGGVSARVDMNAPPLLLANVGNTSFPAEWNVHNFGGSKVVRLVVTNKTPGAHPMHLHGANVQVLAEGSGAWDGSTITNSDNPIRRDTQLVRPNGHVVLQFDADNAGVWPFHCHIAWHASAGYFSSVLTQPDLVKGMSMPMTIAQTCRDWAAYTQTNIPDQIDSGV

SEQ ID NO: 15484 - protein, 333 aa, Legionella pneumophila str. Paris
MHSYLKKDLILHYIQINNPGPHSELTLVEGPNPGFNESQILVRVKATALNRADLMQKYGKYPPPPGESDIPGLEVAGEVIITGSKVKQFKPGDKIYGLVGSGGYAEICPVDASLAHHIPSHWNYSLAAALPEALTTVYATLYDLGALSAGQTLLIHGAGSGIASLAIQMAKLTTTKVITTVGDSSKIEKALALGADQVIHYKEQDFELLIEDNSVDLIIDFVGGDYFNKHLHLLKPQGKLIQIACLKGSKVECSLALLMQKRLHIIGFVLRSQSIKEKARLWKLAHDHWFNAFENDKIKPVIDSEFDLNQIETALQRMQQGSHFGKIVIRVGK

SEQ ID NO: 15485 - protein, 509 aa, Xanthobacter autotrophicus Py2
MPLAAAQPVSGPLAIPHFIAGRKVSGTSGRTAPVFNPATGVQSGEVALASEAEVRAAVEAANAAAPGWAATTPLRRARILNAFLRLLEERIDTLAEVISAEHGKVFSDAKGEIQRGMEVVEFATGAPQLLKGEITEDVGTRVDSHAVRQPLGVVAGITPFNFPAMVPMWMFPVALACGNCFILKPSERDPSASLLLAEWLKEAGLPDGVFTVVQGDKVAVDALLTDPGVEAISFVGSTPIARYIYETAARTGKRCQALGGAKNHMIIMPDADMDQAVDALMGAAYGSAGERCMAVSVAVPVGEGTAEALMEKLEPRVRALKVGPGTDPEAEMGPLVTKQHLEKVSGYVDSGVAEGAKLVVDGRGLKLQGYEGGYFIGGTLFDHVTSDMRIYREEIFGPVLAVVRADSYATAARLINTHEFGNGTAIFTRDGDAAREFAHQIKVGMVGINVPIPVPMAFHSFGGWKASLFGDHHMHGPEGVRFYTRLKTITTRWPTGIRAGADFVMPTMK

SEQ ID NO: 15486 - protein, 162 aa, Burkholderia thailandensis E264
MDFRIGQGYDVHQLVPGRPLIIGGVTIPYERGLLGHSDADVLLHAITDALFGAAALGDIGRHFSDTDPRFKGADSRALLRECAARVAQAGFSIRNVDSTIIAQAPKLAPHIDAMRANIAADLGLPLDRVNVKAKTNEKLGYLGRGEGIEAQAAALVVREAAA

SEQ ID NO: 15487 - protein, 98 aa, Arthrospira platensis
ATYKVTLINEAEGINETIDCDDDTYILDAAEEAGLDLPYSCRAGACSTCAGTITSGTIDQSDQSFLDDDQIEAGYVLTCVAYPTSDCTIKTHQEEGLY

SEQ ID NO: 15488 - protein, 390 aa, Clostridium thermocellum ATCC 27405
MPKLSSKIEGFTDSVIRRMTRIANSYGAINLSQGFPDFDPPVELKNALSRVASGSIHQYAVTWGAKNFRESLAKKQSRFMGIPIDPETQIVVTCGSTEAMMAAMMTVCNPGDKVVVFSPFYENYAADAILSGAEPIYVHLRPPGFNFDVDELEEAFKQRPKALILCNPSNPSGKVFTLEELKTIAYFAEKYDTFVITDEVYEHIVYPPHHHIYFASLPGMFERTISCSSLSKTYSITGWRLGYLIAPSYIVDGARKVHDFLTVGAAAPLQEAAVVALNFGDDYYENLKRIYTEKRDFFLDGLDRLGLAYTVPQGAYYVMVDISEFGAKSDLEFCEWMAREVGVAAVPGSSFFRDNVNHLIRFHFAKKKETLAEAVKRLEKLKDKARERWR

SEQ ID NO: 15489 - protein, 569 aa, Xanthobacter autotrophicus Py2
MREALRRWAPGLAALLAYRRADLGPDLRAGLAVAAVAIPVGIAYAELAGFRPEVGLYSCVFPLVAYAIFGSSRQLVLGPDAATCAVIASAVAPLAAGDGAAYAALSAELALLTGIICILARFLRLGVLADFLSKPILIGFLNGIAITIVLGQLAKITRIEAEGDHVLHATFDLVVRLGETHPPTLLIALGAFGLMIASGRLLPAFPAAVLAMAGAALAVFLLGLDLSGVKTLGVVPAGLPGVMLVRLDPDALAALVPAAGGLALVSFTSMMLTSRSFASKNGYEVDPDKDFAALGAANVVSALTHGFAVSGADSRTAMADAAGGRTHAAALVAAVAVALVLMFLTAPLRYVPVAALGAVLVMAGLSLVDLATLRLIARADRTEAVISLLATLGVVVLGATQGILVAVVLALLRFLHISARPRVEILGRVAGMPGFHALSRHESATAPHGLVIFRFNGPLVFFNAGHFRHALMAATSAEQGAPKAVILDLLPVTEVDVTGLFTLKEVSDALRQRGIALVGAGRQTEWRNWMVTHGFNPDGIVMHPTLRHAVKALAAADTDHADADDTKVS

SEQ ID NO: 15490 - protein, 251 aa, Arabidopsis thaliana
MATFGAPATANSNPNKSYEVTPSPADSISSLSFSPRADILVATSWDNQVRCWEISRSGASLASAPKASISHDQPVLCSAWKDDGTTVFSGGCDKQAKMWPLLSGGQPVTVAMHEGPIAAMAWIPGMNLLATGSWDKTLKYWDTRQQNPVHTQQLPDKCYTLSVKHPLMVVGTADRNLIVFNLQNPQTEFKRIQSPLKYQTRCVTAFPDQQGFLELACSLDAYILDGAFNFWDKDSKQRLKVFSSCIDFLFC

SEQ ID NO: 15491 - protein, 451 aa, Vitis vinifera
  misc_feature (266)..(266): Xaa can be any naturally occurring amino acid
  misc_feature (389)..(389): Xaa can be any naturally occurring amino acid
MAADSSQKWILMTTAQTPTNIAVIKYWGKRDEGLILAVNDSISVTLDPQHLCTTTTVAVSPMFQSDRMWLNGKEISLSGGRYQNCLREIRSRASKIEDEKKGIKITKKDWEKLHVHIASYNNFPTAAGLASSAAGFACLVFSLAKLMNVQEDQGKLSAIARQGSGSACRSLYGGFVKWVMGNEENGSDSIAVQLQDEKHWDELVIIIAVVSSRQKETSSTSGMRDSVETSLLLQHRAKEVVPKRIIEMEEAIKNRDFPSFARLTCXDSNQFHAVCLDTSPPIFYMNDTSHRQVAYTFDAGPNAVLIARDRKVAANLLQRLLYYFPPHSDTDLNSYVIGDKSILGDVGVEEMKDVEALPPPPETKDQIPAQKQRGAVSYFICTRPGKGPXLLSDESQALLNPESGLPKIVWKLDAEGVEGKWRVTAPTSQSKGRDDWNSVIQIIAYANSPFI

SEQ ID NO: 15492 - protein, 279 aa, Bradyrhizobium sp. ORS278
MTAIDKAAAAITGAASGIGRALALEMAARGCDLALADRDEAGLASVAAELAASGRKVTMHRLDVSDASAIAQFAADATAAHPALNIVVNNAGVALFGAFHEIEQAEIEWLFNINFWGVVHGTRAFLPHLSRQPEAHIVNLSSIFGIIAPPGQSAYAAAKFAVRGFSESLRHELATANSPVKLSVVHPGGVATAIARNARAGTGMTDNARRVQAIERFERLAKTSPRDAALRIIQGIERNEPRILIGGDARFMDLLQRFMPGTYWKVMAKRLEKAAAKEG

SEQ ID NO: 15493 - protein, 261 aa, Prosthecochloris aestuarii DSM 271
MKRELEKAIQAAREAGSIILAKFGELSEQDIHPKEFKDFVTGADKESEKRIAEILTAAFPEDSLLCEEGSSANGTSGRKWIVDPLDGTLNFIHSFPVFCVSIALSDSNNELLVAVVYQPVLDELFTAEKGKGTKLNGKPVRISDRQDTRQLLIATGIPFKEYHYLESYVSMLKDVIHDSAGIRRAGSAAIDLAYTACGRFDAFWEYKLYPWDYAAGVLLVREAGGIVTGFDGNPDVFAHHSIIAGNPETHAMIAAKAQKHF

SEQ ID NO: 15494 - protein, 515 aa, Arabidopsis thaliana
MDLSLIQGMSLPLYFLLTLFFFFFATAKTRRSSSTGTLPPGPPILPLVGNIFQLGFNPHRSLAAFSKTYGPIMSLKLGRLTAVVISSPEAAKEALRTHDHVMSARTFNDALRAFDHHKHSIVWIPPSARWRFLKKTITKYLLSPQNLDAIQSLRMRKVEELVSLVNEFRERGEAIDLARASFVTSFNIISNALFSVDLATYDSNSSSYEFHNTVVHLTDIAGIPNVGDYFQYMRFLDLQGTRKKAVLCIEKLFRVFQEFIDARLAKRFSRTEKEPKEASSIDMLDSLLDLTQQNEAELTMNDLKHLLLDVFVAGTDTNSSTMEWAMTELFRSTEKMVKAQSEIRQVIGQNGFVQESDIPSLPYLQAIVKETLRLHPAAPLIPRKSESDVQIMGFLVPKNTQVVVNVWAIGRDASVWENPMKFEPERFLLRETDVKGRAFELIPFGSGRRMCPGISMALKTMHMVLASLLYSFDWKLQNGVVPGNIDMSETFGLTLHKAKSLCAVPVKKPTISSSY

SEQ ID NO: 15495 - protein, 337 aa, Bordetella bronchiseptica RB50
MNSPDWRLCVAPMIDVTDRHCRYFHRLLAPRARLYTEMITTGALLHGDVARHLDFDAAEHPVALQLGGSEPDALAQAARLGRQWGYDEINLNCGCPSERVQRGAFGACLMAEPGLVADCMKAMQDAVDIPVTVKHRLGLDYDESYGFVRDFVGQIYDTGCRVFVVHARNAVLKGLSPKDNREIPPLRYDVARQLKRDFPDCVIVLNGGLADAQAARAVAGEFDGVMLGRAAWHTPRVLSEVSLQWWPAIRLPSDAQVVDAMMQYAATQIARGVPLRVMTRPLLGLVNGQAGARRWRRLLSDPVRLAANDPSLLYEAWRSLQGAPRERDACADPLPAV

SEQ ID NO: 15496 - protein, 125 aa, Glycine max
  misc_feature (99)..(99): Xaa can be any naturally occurring amino acid
ASSLISSPAVISVNPAGAGMVAPLTGLKCMAGFPTRKTNNDLPFIATNGGRVECMRVWPPVGKKKFETLSYLPYLDDARLAKEIKFLLRKGWIPCLEFXMEHCFSYREHSQSPGYYDGTYWTMRN

SEQ ID NO: 15497 - protein, 265 aa, Triticum aestivum
  misc_feature (238)..(238): Xaa can be any naturally occurring amino acid
MAQAQATRGSGDPMKAQQEQPEPIQYGHVFAVTGDLAVQAIAPRDAEAMRTAEESVQGVQVPQASGGGFSAAVAMETAATYNQAVGAVRPGQASDAATKQGITVTQTAVPGGRIVTEFVAGQVVGQYSVADQAMMQQQQVEEDTSKVTIGEAMEAAALSAGDRPLEEADAAAIRAAETQAQGADEVMPGGLADQAWAAASANAWAERDDVHITVSDVLSYATTKLADDKTAEREDTAXVVHADTYSDAGAPTGRRGGGSITRRGA

SEQ ID NO: 15498 - protein, 198 aa, Zea mays
  misc_feature (32)..(32): Xaa can be any naturally occurring amino acid
  misc_feature (86)..(86): Xaa can be any naturally occurring amino acid
NKAKIAGRLSGVASRIMGGNGVVARSAASSLXQRAGMGLPVGKHIVPDKPAFGNDELMWDNGTAFPEPCIDRIADTRRKYEAWGWXCGASKLLLRSGMLAGLNDKAQKSIYTRVIPMIPERELEESRKRLSVIYSSKLGVFSHCFVLKMFNFLPDVKTTIKELAFHYRGGSGITGTLGDHEEKNSVSKKKKKVIEPAT

SEQ ID NO: 15499 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKISPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAAAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 15500 - protein, 263 aa, Nocardia farcinica IFM 10152
MILDRFRIAGQVAVVTGAGRGLGRAIAVAFAEAGADVLIAARTKQQLDEVAEQITAAGRQAHVVAADLSDPETAAGLAEAAVQRFGRLDIVVNNVGGAMPSPLLDTTPQAMIEAFTFNVANAHALIRAAVPHMLATADGGSIVNITSTMGRLPGRAFAAYGTAKAALAHYTKLAALDLNPRIRVNAIAPGSILTSSLEVVAGNEQLRTELETKTPLHTIGEPADIAAAALYLVSPAGKYLTGKVLEPDGGLIQPNLAIPIPDL

SEQ ID NO: 15501 - protein, 469 aa, Bacillus anthracis str. Ames
MENLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYNWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 15502 - protein, 112 aa, Brassica napus
  misc_feature (18)..(18): Xaa can be any naturally occurring amino acid
  misc_feature (24)..(24): Xaa can be any naturally occurring amino acid
  misc_feature (39)..(39): Xaa can be any naturally occurring amino acid
  misc_feature (77)..(77): Xaa can be any naturally occurring amino acid
  misc_feature (95)..(95): Xaa can be any naturally occurring amino acid
  misc_feature (102)..(102): Xaa can be any naturally occurring amino acid
EAGQAYNINADTVAGELXAALGAXKLILLTDVAGILEDXEDVGSLVKEIDIKGVKRMIDDGKVGGGMIPKVKCCIRXLAQGVKTASIIDGRRQHXLLHEIMXDEGAGTMITG

SEQ ID NO: 15503 - protein, 238 aa, Triticum aestivum
HASRTRGPPRGRAPGRDRKRREPSAMGGGVMRTAAAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSTDSVESPEKFEEASPEYALPTDSPCRNWRTMRRRDDG

SEQ ID NO: 15504 - protein, 387 aa, Legionella pneumophila str. Paris
MAIKPIYFDYMATTPVDPRVVEQMIKYLGPEGDFGNPASATHEYGRAASMAVEQARSQIAETINASPQEIVFTSGATEADNLAILGAARFYKNKGMHLVTMSTEHKAVLDSFHQLEKEGFQVTYLHPESDGLLDLGKLESALRPDTILVSVMHVNNEIGVIQDIASIGELLRNRGIIFHVDAAQSAGKLPIDLSQLSVDLMSFSAHKNYGPKGVGALYVRHKPRIRLQPLSYGGGHEGGLRSGTLPTHQIVGMGEAFAIAETDRIPEQTRILNLRKQLWDGIRHLPAIKLNGHEHRRIAGNLNVSFVGLNGDSLLFALSELAISTTSACSSASIQPSYVLRAIGLTDTEAQSTIRLSIGRFTSEVQIKKAIDIICRQVSRLHELSPL

SEQ ID NO: 15505 - protein, 122 aa, Triticum aestivum
MAARLAQLRTKAAQTAEFASKHGGTYYKEAMEKNKQYVVQPPSVEKCQELSKQLFYTRLASLPGRYEALWKEVDGVKQLWKNRKELRVEDLGIATLFGVELYAWFCIGEIAGRGFTLTGYKV

SEQ ID NO: 15506 - protein, 377 aa, Bacillus thuringiensis serovar konkukian str. 97-27
MKAVTYQGPNKVQVKQVDDAKLEKKDDIIVKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKRGDTVIVLGCGPVGLMTQKFAWMQGAKRVIAVDYLDYRIHYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFKKITNKEFDPKEIITHKIPLEEASYGYQIFNNREDDCIKVILKP

SEQ ID NO: 15507 - protein, 449 aa, Bacillus thuringiensis serovar konkukian str. 97-27
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYTQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVIGTLKTAMERI

SEQ ID NO: 15508 - protein, 491 aa, Desulfovibrio desulfuricans G20
MSTKAQSTSFDWKRLCFMLLGVTAFLVIYYSPAWPDAVDPLGERFPLSKEAKGALAVFMFAGLWWVFEVVPIGITSLGIGVLQVLFFVRPPEKAFKDFMDPSVLFIFASIMIGLVFTKTGLTKRLAYKMLMVVGEKTSRIYLGVFVVTALLTHIMAHTAVAATVYPLLLAIYALYDDTGSKTRFGKGLFIGMAYVAGAGSIITLLGAARGAVAVGFFKEIVGTEVSFFELTYYMAPIGWLMVFLLWGFFMIFCKPERDTIPGLREKARELNKQMGPLTRKEIMAALIVGIVILVMSLRSFFPMLKMLDKTAIILISSIAFFVFKILDIKDLEDVPWNIILLFAGAMSIGYCLWETGAAKWLAVNWLVMFEKAHWFVFVMSICFFVLMMTNFIMNVAAIAISLPVALVIAPYLGVSPEVILFGALVVAGMPFLLLVGAAPNAIAYDSGQFTSGEFFKYGLVASALLLVVVGVFVLVVWPLMGMPITVPRVGM

SEQ ID NO: 15509 - protein, 201 aa, Zea mays
MAGPAVLNERILSSMSQKHVAAHPWHDLEIGPGAPEFFNCVVEIPRGSKVKYELDKASGLIKVDRVLYSSVVYPHNYGFIPRTLCEDNDPLDVLILMQEQVVPGCFLRARAIGLMPMIDQGEKDDKIIAVCADDPEFRHYTDITDLPPHRLQEIRRFFEDYKKNENKEVAVNEFLPAKDAINAIKYSMDLYGSYVIESLRK

SEQ ID NO: 15510 - protein, 1064 aa, Saccharomyces cerevisiae [sequence omitted]

SEQ ID NO: 15511 - protein, 328 aa, Neptuniibacter caesariensis
MSSTTDTLNRRFTVAPMMDWTDRHCRYFHRILSQNAVLYTEMVTTGALIHAEADRFLRYNREEQPVALQLGGSNPEDLAQCTKMAEDYGYNEVNLNVGCPSDRVQNNMIGACLMAHPQLVSECLEKMQAAVDIPVTVKHRQGIDDMDSYEELVQFVDTVRQSGCKVFIIHARKAILQGLSPKENRDIPPLKYEWVYQIKQEFPELEVHINGGIKTIDECHTHLQHVDGVMLGREAYQNPYLLADVDREFYGADSEKISRKAAALAMVPYIEQQMEQGVPLNHVVRHMLGLFHAQRGGKQFRRFISENAHKPGAGIEVLLNALERVADE

SEQ ID NO: 15512 - protein, 463 aa, Shewanella sp. MR-7
MSTGTVVQVIGAVVDVEFPQDAVPQVYDALKITGEGSCNGLVLEVQQQLGGGVVRTIAMGTSDGLRRGLEVVNSGSPISVPVGTATLGRIMNVLGEPIDEAGAIGEEERYVIHRSAPSYEDQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDDDKMTVSRARKIERFLSQPFHVAEVFTGSPGKYVSLKDTIRGFKGILSGEFDHIPEQAFYMVGSIDEAVEKANKKK

SEQ ID NO: 15513 - protein, 342 aa, Salmonella enterica subsp. arizonae serovar 62:z4,z23:--
MTVRVAINGFGRIGRNVVRALYESGRRAEITVVAINELADAAGMAHLLKYDTSHGRFAWEVRHEREQLFVGDDVIRILHEQTLADLPWRELGVDVVLDCTGVYGNREHGEAHIAAGAKKVLFSHPGSNDLDATVVFGVNQNQLRAEHRIVSNASCTTNCIIPVIKLLDDAYGIESGTVTTIHSAMNDQQVIDAYHPDLRRTRAASQSIIPVDTKLAAGITRIFPQFNDRFEAIAVRVPTINVTAIDLSVTVKKPIKASEVNQLLQKAAQGAFHGIVDYTESPLVSIDFNHDPHSAIVDGTQTRVSGAHLIKTLVWCDNEWGFANRMLDTTLAMAAVGFRLDT

SEQ ID NO: 15514 - protein, 231 aa, Oryza sativa Japonica Group
MEDWDSEDFQPAVPSAKAEPLKSKWADEDVEEDDVKESWEEEEEEKPKPPPVEKTAPKPSGKGAAKKGKQQASTSSEVVQDEALDDPALEKLRQQRLVEEADFKSTTELFGKKDGSEKSLDTFIPKSESDFAEYAELIANKLRPYEKSFHYMGLLKNVMRLSMASLKGADAKDISSSIAAIANEKIKAEKEAAAGKKKQGAKKKQLHIENKDDDFIPGKGNFDDPDEYDFM

SEQ ID NO: 15515 - protein, 414 aa, Escherichia coli
SKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDQCALFEATHGTAPKYAGQDKVNPGSIILSAEMMLRHMGWTEAADLIVKGMEGAINAKTVTYDFERLMDGAKLLKCSEFGDAIIENM

SEQ ID NO: 15516 - protein, 208 aa, Triticum aestivum
  misc_feature (76)..(76): Xaa can be any naturally occurring amino acid
  misc_feature (97)..(97): Xaa can be any naturally occurring amino acid
  misc_feature (113)..(113): Xaa can be any naturally occurring amino acid
  misc_feature (129)..(129): Xaa can be any naturally occurring amino acid
  misc_feature (136)..(136): Xaa can be any naturally occurring amino acid
  misc_feature (189)..(189): Xaa can be any naturally occurring amino acid
MLPMRPLPYRPTIYLHRNTSHAQTSIGGLGQHGRVDLVRTTKGVVCRSVDRPAQNHGEPEVDIPWKLNDARIVLEXAPCRNAKSFIASETQVLDVVXIPPLTGYHVSLTVSNXSAQFDLMSNPHIGNTXVNSVYKXSIKCSNGRLIIRNISICITNWRCTKTLDEYMTKRNIMCIYDLYKLVKRPKLIXDGSFIGMLSTDKYSKRGWI

SEQ ID NO: 15517 - protein, 462 aa, Zea mays
MDRLPESTRSMRKYASEAGGLRAARQGPHGRSLTARTAHSMSTTALRTKSKSAASLLRRVPFAPLRPVLANLQEVFLGTKLAVLFPAVPLAIAAQCAHFGQVWVFSLSLLGLIPLAERVSFLTEQIAIYTGPTVGGLLNATCGNATELIIALFALMGGQIEVVKCSLLGSVLSNLLLVLGTSLFCGGVVNLGSDQPYDRTQADVSTGLLILGVLCQSLPLMLRYAVGAGEHSVAAATTVLDLSRACSVVMLLAYVAYLFFQLKTHAQLFEPQEVDDGCEAEEDEQAVIGFASGFFWLAFNTVLIAILSEYVVGTIEPTSKSWGLSVSFISIILLPIVGNAAEHAGAIIFALKNKLDITLGVALGSATQISMFVVPLSVIVAWIAGIQMDLDFKLIETGSLFVSVIVTAFTLQDGSSHYLKGILLLLCYIVIGACFFVTRQPASNNNGAGLSLPTGTLSAQAA

SEQ ID NO: 15518 - protein, 329 aa, Burkholderia thailandensis E264
MARIVRIHQTGGPDVLRLDEIDPAPPGPGEIALQVKALGLNRAESMFRSGHYVEQPVFPARLGYEAAGVVSALGPGVTGFAIGDAVSIVPPLSISRWGTYGEVATVPADVAVKHPASLGWTEAAAVWMQYVTAWGALIDLAQIKRGDAVVITAASSSVGLAAIQVARMAGAVAIATTRTDAKAQALREFGADHVIVTQREDLAARVREITGGAGARVAFDPVAGPALPQLADALAFGGIVIEYGALAAEQAPFPLFAVLGKMLSVHGYQYKRVVGDPAKLDAAKRFVLDGLASGALKPAIDRVFPLDRIADAHRYLESNEQFGKIVVTV

SEQ ID NO: 15519 - protein, 127 aa, Oryza sativa Japonica Group
MAAAASSAVLLLPNSRAPAALSRRRAPVPRRGFVVGFEGRSRRGAAGTVRACFNPPGDERILREALKEPVAFMGGVFAGLLRLDLNEDPLKEWITRTVEASGVAEDSRTDESSEGSQNDAPQQIEIE

SEQ ID NO: 15520 - protein, 242 aa, Zymomonas mobilis subsp. mobilis ZM4
MEKVSFGFSDVSPQEKTHLVGDVFRRVASRYDLMNDAMSGGLHRLWKDDFVRLVQPKASEHILDMAGGTGDIAFRLAKYGTNVTIADINPAMLEVGKKRAIARSIENLTWKEENAEALSFNDNVFDAYTIAFGIRNVTHIQKALDEAWRVLKVGGRFFCMEFSQTKWSGFSNLYKMYSTHIVPKIGQLLANDEDSYRYLIESIERFPNIEKFSDMIKSAGFVQIRARPILGGLVAIHSGWKV

SEQ ID NO: 15521 - protein, 210 aa, Erythrobacter sp. NAP1
MARKIWDISQPLRPSLPVWPGDTAFTQARTWQMEDGSPVNVSALTLSTHSGAHADAPLHYSQEAPDIASVGLDPYLGECLVVDAREVGALIEVGDLPHINSADRVLFRTFKSFPHEEWDEQTTAIAPETIEWLAVQGVKLIGIDGPSIDPQSSKTMDAHKAVLKHDIRVLEGLVLDDVEEGRYELIALPLLIVSGDASPVRAILRELPDA

SEQ ID NO: 15522 - protein, 479 aa, Campylobacter coli RM2228
MTTYLNYIDGKFIPHNGEFIEVLNPATKEVISRVASASLEDTKRAIEAAKKAQKVWEAKPAIERANHLKEIASLIRKNANFLTEVLMQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSIYDEFVDKFVKAMSKVSVGNTLKGDFDMGPLVNQAGVDNALAMLQRATAKGAIVECGGKITDTSGYYFPASVLTNVKHEDEIMQKEIFAPILPIAKFDTLDEAIDMANDCEYGLTSSIYTQNLDIAMRASREIKFGETYINRENFEAMQGFHAGFRKSGIGGADGKHGLEEYLATHVVYLQYNTNKQ

SEQ ID NO: 15523 - protein, 141 aa, Geobacter metallireducens GS-15
MTQQGAIKTRLILIEDEPGHTRLITKNLMKSADVEILPFDTGRRALEYFEGKTAEDLRQHLVVLDINMPGIDGFEVLKRLKGNEATAAVPVIVFTTTDHPDEIRRCYHEGANLYLVKPMDYTAFQVTIDFLAATLTMMRLP

SEQ ID NO: 15524 - protein, 294 aa, Oryza sativa
MEQYEKEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMVQ

SEQ ID NO: 15525 - protein, 252 aa, Zymomonas mobilis subsp. mobilis ZM4
MILTDNQLDRYARHIVLPEIGGKGQKKLLSAHVAIVGAGGIGSPVIQYLAAAGVGRLTIVDNDEVSLSNLQRQTLFATRDIGAHKVAMAANVVQRLNPDVKVLPYDQKLDAENAKKLIGQADIIVDGSDNFGTRLVVSDVATELKIPLVSAAVIRFEAQLAVFKGYEASKPCYRCFVGDDPGEPEMTCSSQGVLGALTGTIGSLAAIETIRLITRFGSESGDKLLLIDAKDFRFRTVSLSKDPNCRCKHSAE

SEQ ID NO: 15526 - protein, 514 aa, Bradyrhizobium sp. ORS278
MHRREWERQMTKVDVNAAFQPPFAARYDNFIGGAWKAPSAGKYFDNISPITGQPVCQIARSDASDIEAALDAAHAAKDGWARTSVTERALILNRIADRMEANLAKLALAETWDNGKPIRETTAADIPLAIDHFRYFAGVIRGQEGSIAEIDHDTIAYHFHEPLGVVGQIIPWNFPILMAAWKLAPALAAGNCVVMKPAEQTPASIMVWMEIIGDLLPAGVLNVVNGFGLEAGKPLASSPRIAKIAFTGETSTGRLIMQYASQNLIPVTLELGGKSPNIFFKDVCAEDDDFLDKAIEGFVMFALNQGEVCTCPSRALIHESIYERFMERALKRVGAIVQGSPLDPATMIGAQASSEQLDKILSYIAIGRNEGAQLLIGGERNLLGGELAGGYYVKPTVFKGHNKMRVFQEEIFGPVVSVTTFKTEDEALSIANDTLYGLGAGVWSRDANTCYRFGRAIQAGRVWTNCYHAYPAHAAFGGYKQSGVGRETHKVMLDHYQQTKNMLVSYSPKKLGFF

SEQ ID NO: 15527 - protein, 516 aa, Oryza sativa
MASLMEVQVPLLGMGTTMGALALALVVVVVVHVAVNAFGRRRLPPSPASLPVIGHLHLLRPPVHRTFHELAARLGPLMHVRLGSTHCVVASSAEVAAELIRSHEAKISERPLTAVARQFAYESAGFAFAPYSPHWRFMKRLCMSELLGPRTVEQLRPVRRAGLVSLLRHVLSQPEAEAVDLTRELIRMSNTSIIRMAASTVPGSVTEEAQELVKVVAELVGAFNADDYIALCRGWDLQGLGRRAADVHKRFDALLEEMIRHKEEARMRKKTDTDVGSKDLLDILLDKAEDGAAEVKLTRDNIKAFIIDVVTAGSDTSAAMVEWMVAELMNHPEALRKVREEIEAVVGRDRIAGEGDLPRLPYLQAAYKETLRLRPAAPIAHRQSTEEIQIRGFRVPAQTAVFINVWAIGRDPAYWEEPLEFRPERFLAGGGGEGVEPRGQHFQFMPFGSGRRGCPGMGLALQSVPAVVAALLQCFDWQCMDNKLIDMEEADGLVCARKHRLLLHAHPRLHPFPPLL

SEQ ID NO: 15528 - protein, 567 aa, Physcomitrella patens subsp. patens
MAPPCFAGLALWEFRKMVQGPSGTLNGWNYSDESPCDWRGVVCDNVTNHVIRINLPRARLTGTISPRLSELSQLRRLGLHANNITGAIPSFLVNLTYLRTLYLHNNNLTETLPDVLGIMPALRILDVSGNKIEGPIPATFSAMNKLKFLNLSNNRLSGEVPGGSMLRFPASSFAGNSLLCGSSLLGLPACKPEEETKTDHKGYAWKILVLSIGIFLLLKMIIALLILCHCLRQDRKREIQLGKGCCIVTSEGKLVMFRGETVPKSKAMLQAVRKLRKRDIVGEGGYGVVYKTVLKDGRVFAVKKLKNCLEAAIDFENELEALAELKHRNLVKLRGYCVSPTSKFLIYDFIPNGTVDQLLHREKGNPVDWATRIKIARGTARALACLHHDCQPRIIHRDVSSKNILLNERFEPCLSDFGLARLMENDHTHVTASVGGTYGYIAPEYAQAGRATEKSDVYSYGVILLELLSRRKPTDSSFSAHHINMAGWLRCLREKGQELEVVEKYLRETAPHQELAIALEIACRCVSLTPEERPPMDEVVQILESLANSSESTQPTVTETTATSNET

SEQ ID NO: 15529 - protein, 197 aa, Nocardia farcinica IFM 10152
MTTTPADRILTVPNVLSVLRLIGVPVFLWLLLVERADGWAFALLVASGITDFLDGKLARLLDQSSRLGALLDPFVDRLYLVTTLVAFVARGLLPWWVALLLVGRDAVLTLTLSIYRRRELDPPEVIYLGKAATFALMSALPWLLAGQMDWPLDGFGRAFGGALLIWGTAVYLWTGVLYTGKAVAVARAIPAVRQHHP

SEQ ID NO: 15530 - protein, 449 aa, Legionella pneumophila str. Paris
MAIYQTQLHKILSGTRNKHHSGLLHCGRISRAIGLTIEAKGFNQPVGARCLVKINDEHSVQAEVVGFSNESVYLMSIGDIQGIAPGMKIIPTGRIAQVSVGHQLLGRILNGSGMFIDDGPPSEMVETYPLIGQVINPLKRAPIEVPLDVGIRAINGLLTVGRGQRIGLFAGSGVGKSVLLGMMTRFTEADVVVVGLIGERGREVKEFIECNLGLQGLKRAVVVAAPADESPLMRLHGAKVATSIAEYFRDQGKHVLLLIDSLTRFAQAQREIALSIGEAPATKGYPPSVFAKLPKLVERAGNGTSGGGSITAFYTVLTEGDDLQDPIADAARAILDGHVVLSRALAEQGQYPAIDLEASISRVMQGVVSEQHMKDMLLFKKYLSVYEKNKDLILLGAYAKGSDPLVDKAILAVNKLKDYLAQGMDEQVGYDESLLSLSKLISTLVGNDQ

SEQ ID NO: 15531 - protein, 570 aa, Salmonella enterica subsp. enterica serovar Paratyphi B str.
MSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGIKFEPIRPYEFTGRGDRIGWVKGIDNNWHLTLFIENGRILDYPGRPLKTGLLEIAKIHQGEFRITANQNLIIASVPESQKAKIEKLARDHGLMNAVSAQRENSMACVSFPTCPLAMAEAERFLPSFTDKVEAILEKHGIPDEHIVMRVTGCPNGCGRAMLAELGLVGKAPGRYNVHLGGNRMGTRIPRMYRENITESEILDSVDELVGRWAKEREAGEGFGDFTVRAGIIRPVLDPARDFWE

SEQ ID NO: 15532 - protein, 350 aa, Bacillus thuringiensis serovar konkukian str. 97-27
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 15533 - protein, 327 aa, Oryza sativa
  misc_feature (247)..(247): Xaa can be any naturally occurring amino acid
MEEGAAAAKTEQTQAPAEGRRGGRGGFGRGGARGGRGGPRGGGRGGPRGDDKDWTPLTKLGRLVKYNMIKSLEEIYTHSIPIKESQIVDELLSRAKKELSDEVMKIITVQKQTKAGQRTRFKAVVAIGDQDGHVGLGVKVAKEVQIAIKGALVAAKLSLIPVRRGYWGNKIGNVHTVPVKITGKCGSVRVRLIPAPRGTGIVGAPTSKKLLQFAGVEDCFTSSSGSTKTLENFIKATFDALSNTYGXLTPDLWPKTDFLPSPFIIYADYLKTAQRRESEAREATEKGGRGKSKRRKRRATRRQKASAPEGGRKGEKAKEGGPRPRKA

SEQ ID NO: 15534 - protein, 213 aa, Brassica napus
MGMSLDFDVDLEKGLVHCVNESPEKPLIPTSTENKPVITGEETVGSLENDVTPVQSAKPGWGRSDRKENRKKSASKPPRPPRGPSLDAADRKLIREIAELAILKRARVERMRALKKSRAAKAASAASSFGNVLATLLTVIFFFVLVLQGLSPRAAASSGRSPLVDTGKANGGFVSVQYAGTPSASEPDGGYTGPGLAQRLPNLLKPVSGLKRR

SEQ ID NO: 15535 - protein, 329 aa, Bacteroides fragilis NCTC 9343
MDKIIGLGNALVDVLATLKDDTLLDEMGLPKGSMQLIDDAKLQQINERFSRMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 15536 - protein, 219 aa, Salmonella enterica subsp. arizonae serovar 62:z4,z23:--
MTQDELKKAVGWAALQYVQPGTIVGVGTGSTAAHFIDALGTMKGQIEGAVSSSDASTEKLKGLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVYGMEILDPIALENAINAIPGVVTVGLFANRGADVALIGTPDGVKTIVK

SEQ ID NO: 15537 - protein, 531 aa, Zea mays
KNERAAGSDPEAAAAPGSGNLHGPEPPATGSTTICARARARGTGRRTEAPLSSERVRPAWRRRWRGRGAAALARWRGMCSSSASAPRSAAALSSEELMRMEQDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKHIPKNEALLVSCCGCFHGRTLGVISMSCDNDATRGFGPLVPGHLKVDFGDIDGLKKIFEELGDRICGFLFEPIQGEAGVVIPPDGYLKGVRDLCSKHNVLMIADEIQTGIARTGKMLACDWENIRPDMVILGKALGAGVVPVSAVLADRDVMLCIRPGEHGSTFGGNPLASAVAVASLKVVRDEGLVERAAKLGQEFRDQLQKVQQKFPQILREVRGRGLLNAVDLNNDALSPASAYDICIKLKERGILAKPTHDTIIRLAPPLTISPEELAEASKALSDVLEHDLPQLQLQKQIKKPESEAEKPVCDRCGRDLYG

SEQ ID NO: 15538 - protein, 557 aa, Bradyrhizobium sp. ORS278
MASSSQRIANFSCEKQPASGSRGMVVTNHPLASSAGAEMLMRDGNAIDAAVAALFALTVVEPMMVGLLGGGLSHIRLADGRHIVLDGLSTAPLRATPHMYDLVSDEIALARETRGRRNVVGALAVAVPGALKGWCEALARFGRLPLAEVMAPAIRLAEHGFIASPYLNDCVRLVASDLARDPYLAALFLPDGEPVKAGARVIQADYAASLWLIAREGPEALYGGPLGAALAAYMATSGGLIDAADLAAYAVIARAPIRGLYRGYEIIGPPPPSSSGVHIVQMLNILEGFDVAALGFGSADGAHLLAEALKIAFADRAVATADPAFVDVPIERLTSKAYAAERRAEIDMAKAGSFGPGLSPTESANTTHVTVADAEGNVVASTQTINGLFGACVQIPGTGMTANNYMYNFDPHPGRALSIAPGKRVFTSMAPMMAVRDGKLRYALGLPGGLRIFPSAFQALVNLIDHGMSLQEAVEAPRLWTQGGVLELEPGFPEHVAQALAARGHEIKREPVVAGGMNAIAFNDDGTLTGAACWRADGTPIAISGGRARAGLRFAIA

SEQ ID NO: 15539 - protein, 440 aa, Desulfovibrio desulfuricans G20
MHPKACLELLHDVQLVDTYGKVNKIVGLVAEGCGVKAPLGAVCHIIPEDGSAPLPAEVVGFRDGNILFMPYGDMRGVQSGSLIRNTSMPPLFPVGESMLGRAFDAFGAPMDGSTMPPVAGHNPIYAQPPNPLSRPRIDDPLDVGVRCINSLITLGKGQRVGIMAGSGVGKSTLMGMMARYTSADVNVIALIGERGREVVEFMEKDLGPEGMARSVLIIATSDQSPLVRMRAAYAATAVAEFFRDQGKDVLLMMDSVTRFAMAAREVGLAVGEPPTTKGYTPTVFAQLPKLLERAGRNRHGTITGIYTVLVDGDDFNEPIADAVRSILDGHIVLTRDLADMGHYPAIDVLRSISRLRTDICPQEVIAAGRTLTRHLATFRKVEDMINIGAYAQGSNPDIDQAIGMVPRINQFLQQQVQDKQAIDACYAQMLELAGQPAAAS

SEQ ID NO: 15540 - protein, 499 aa, Oryza sativa Japonica Group
MPPHEDALDAGAVDVLTFRLHPLAVLKLSHRIREFVHLHDDQYQQARMSGCVIGVRRGGTVDISDTFDILHDPDPGTFDRALLEKDQEIYKKAFPDLSVLGWYSIGTNVHATDTGIHHGDYTDMQIHQTLMDANGTAFYLLLNPAINFSHKDIPVTIYERVLCNSDGSPPVSFVQGNYTVEIVGAERISLDHADFLYPSPCVVFDVLAPPLGEKKNAFRTMLFETPSGFAMFRVSDVLFRYPEDIWSSFTDPHTAHQVVRTIGFIEVGDKSVVWDNDIGPGEDIEHFILKFPIKSLVVPDAQLKFIIEKNLNISCWFNGRIVPELIWGLNYALDEFVPREKGNLSNERHFPLSKQLHEQLKAYGFSISPQLINREFITSFGYLNYLERTSNCISGDLHQKFDRFFCGLEMSEGEFVRGVAHRLHSMEEVASTPGRREALSNAEFLLAVPKKKCNTISRLKRMEAEDRGTGLGHPWVCAAAVAVGFGVMAGLCIAMKRAN

SEQ ID NO: 15541 - protein, 274 aa, Enterococcus faecalis V583
MTLDKTKKLANGNEMPRLGLGVWRVEDGSEATNSVKWALEVGYRLIDTAAVYKNEVGVGEGIRQSGIPREEIFVTTKLWNEDQGYENAIKAFDKSLEKLGLDYVDLYLIHWPVAGKYKESWKALEEIYASGRAKAIGVSNFHQHHLEDLLTEANVVPMVDQIELHPTLTQEPLRKYLAENKIAVEAWSPLGQGNLLSEPVLVKIGEKYGKSAAQVIIRWHLQNDIIVIPKSVHEKRIQENFAVFDFELTPEEITAINQLNKDHRFGADPDNFDF

SEQ ID NO: 15542 - protein, 115 aa, Zea mays
MSTVSRASLDQKLALAKRCSREATLAGAKAAAVATIASAIPTLASVRMLPWAKANINPTGQALIVSTVAGMAYFIAADKKILSLARRHSFEEAPDHLKNTSFQGTGRPHPAFFRP

SEQ ID NO: 15543 - protein, 623 aa, Lentisphaera araneosa HTCC2155
MITRILDKIKQPDDLKQYNTEELKGLCEEIRAYLVDVCSTHGGHLGSNLGIVELTVALHKVFNSPSDKILYDISHQGYVHKILTGRKDYLNTLRSYQGCSGFLQREESSHDHFGAGHAGTALSAGLGFAAARDQRGASEKVISIVGDAALGCGVSLEALNNIAETTDDMIVILNDNKMSISPNVGALSKYLNRIITDKNYRHVRENVKQFLTKIPKFGQAIRSGVAKVEDAAKSILVPGAIFEELGFHYIGPVDGHNLDSLIPILEAIATDKKPVLLHVMTEKGHGFHEAESCPERLHGFKKKVPAEPDAVPQPSVKSFSQSFGDAACQLASKDSRVVSITAGMLSGTGMTVFKERFPDKTYDVGIAEEHAVVFAAGMAANGLRPIVAIYATFMQRAMDCVYHDVCLQELPVIFCLDRAGLVEDGPTHHGIYDIGFWRSLPHIHIMQPRDDSEMKAMMDLALILDHATVIRYPKSSSADLTCPRAKVELGKSEVLREGTDAVIWAVGRECELALQLAEDLQKKDFSIKVVNARFLKPFDKEAFLADAKAMPMITLEDHVKTGGLASIAAELFVENKISKPYLAKAYPEAEVITWGKVDKLRELYGMTSDKLIEEITQFLDDSK

SEQ ID NO: 15544 - protein, 396 aa, Escherichia coli
MFENITAAPADPILGLADLFRADERPGKINLGIGLYYDETGKIPVLTSVKKAEQYLLENETTKLYLGIDGIPEFGRCTQELLFGKGSALINDKRARTAQTPGGSGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSSPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 15545 - protein, 277 aa, Bacillus anthracis str. Ames
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSSDDMKAIQALNEDHRVGPDPDNFNF

SEQ ID NO: 15546 - protein, 577 aa, Zea mays
  misc_feature (316)..(316): Xaa can be any naturally occurring amino acid
MALEDGSPATFTPQVIANAFVKQYYQTLRYAREDAYKFYNDKSILGRTDSNGKMICVTTIDDIKEQLVSTDCADCLIEIETVDAQPSHVDGVIILVAGYFTTAVVKQKFIQSFFLAPQENSGYYVLNDTFRLTGISFEVKVVAANHDNKSTQITTLPNEPEIDSFKESEVPGVPPAGNILLNDGVISTSANVVSPVKNDPVVETSMKVVNEDVVKIPVAAPASTPVTAEEVVNKDFVKIPESAPALPSSVEKAAPAPPASVEKAAAAPPASVEKGAPAPRAPVEKADPAPSAPVEKGAPALRAPVEKADPAPRARXEVTRKTYASVVKIPREDTQPTPAARPSKPNLNIKMVQNTEKNVSSPSKPAHATVNALPGDKGVPKNKSPDEPGYSIFVKNLPFEATVEMVEQEFSKFGAIKSGGVQVKCQPDQFCFGFVEFESQQSMLAAIEASRVYFGTRESYVEEKRTKTRVVDGVITRGDDNGNGGGGRFHSGRGGGYYGDGYKRQWGGQNNGYYNGGDNMRNDYSGRVRGPQGNGHPQNGHGYYSGNGYQQRRPNSNGNGLRVERNNGFRQQGPASA

SEQ ID NO: 15547 - protein, 245 aa, Bacillus anthracis str. Ames
MLTKHRILFIGAGRMAEAIFSGLLKTSKEYIEEIIVSNRSNVEKLDQLRARYNVSTTTDWKQHVTSVDTIVLAMPPSAHEELLAELSPLLSNQLVVTVAAGISPSYLEERLPGGTPVAWIMPNTAAEIGKSISLYTMGQFVNETHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALY

SEQ ID NO: 15548 - protein, 323 aa, Solibacter usitatus Ellin6076
MKAIQVLTPGGPESLHLLDAPVPRLGPDQALVKVAASGVNFIDVYFRTGLYKADAPIAIGSEAAGTVEAVGAGVTEFKPGDRVAYAMVRGSYAEYAVVPVGMLVKIPDHVDFVTAAAAMLQGMTAHYLTHSTYLLKAGQACLVHAAAGGTGSLIVQMAKMLGARVFGTVSTEDKARIAREAGADETILYTQQEFDVEVKRLTQGRGVDVVYDSVGKTTFEKSLNSLRPRGTLALFGQSSGPVPPFDPTILNGKGSLYLTRPSLAHYMMTRDELLWRATDVLKWIDSGQLKLRIDRTYPLADAASAHRDLESRKTAGKLVLAVS

SEQ ID NO: 15549 - protein, 348 aa, Zea mays
MAIVGEFLFQRIAASHLANPLELPPLDGVSIVVTGATSGIGLEIARQLALAGAHVVMAVRRPKVAQELIQKWQNENSETGRPLNAEVMELDLLSLDSVVKFADAWNARMAPLHVLINNAGIFAIGEPQHFSKDGHEEHMQVNHLAPALLAMLLIPSLLRGSPSRIVNVNSIMHSVGFVDAEDFNLRKHKYRSWLAYSNSKLAQVKFSSMLHKRIPAEAGIGVVCASPGIVDTNVEARDLPKIVVAAYHLIPYFIFDAQEGSRSALFAASDPQVPEYCETLKSEDWPVCACINYDCSPMNASEEAHNLETSQLVWEKTLEMVGLPPDALEKLIAGESVQCRYGQQDTTF

SEQ ID NO: 15550 - protein, 450 aa, Rhodococcus sp. RHA1
MNLATPQRVSGGEHEHGHLEELRTDPIALMRRVREECGNVGVFQLADKKVVLLSGAEANEFFFRSTDEDLDQQAAYPFMKPIFGEGVVFDASPERRKEMLHNQALRGEQMKGHAATIAHEVDRMVAQWGDEGEIDLLEFFAELTIYTSSACLIGKKFREQLDGRFAHLYHELEQGTDPIAYVDAYAPIESFRRRDEARVQLVALVQEIMNGRIENPPQGKEDRDMLDVLVSIKDEDGNERFTADEITGMFISMMFAGHHTTSGTAAWTLIELLRHPDYAKQVVAELDDLYSDGSDISFGALRQIPKLEAVLKETLRLHPPLIILLRVARGEFEVGGYRIAENDLVAATPAISNRIAEDFPNPDTFDPERYIDPNQEDIVNRWTWIPFGAGRHRCVGAAFALMQLKAIFSILLQDWEFEMAQPSETYRNDHSKMVVQLQQPCTVRYRKRST

SEQ ID NO: 15551 - protein, 616 aa, Sulfolobus solfataricus P2
MTSVTNSDKLLRKELSLLDLTFLSLSAMIGSGWLLASLSVASLAGPSGVFSWTIAGIMVMFIGLAYAELGSSIPKTGGIVRYPFYSHGSYTGFVIAFLYLLSAISTPSIEALATIEYLTSVNPTLSKLLTNSTVVNGTQVTVLTLPGLLLSILLLFIYFVINYYGIKILGKTNSAITVWKLIIPVVTFILLFFAFKSNNFTNYGGIFPQSVASNYVGPVGMLYAIPSAGIIYSYLGFRQPIEYSGEAKNPEKNVWRAIILSIVIAILIYTFLQIAFIGAINWESARITPGNWSALLNSKWANSPFYSELEAEGIAVTGAWGYVLLIDAILSPTGTGLVYTGTSARTLYGLSAEEYFPSIFKKLNSYRIPIWSLVGSLIASIIFLLPFPSWYLLVGFNSSATVLTYIMGGIGLQTLRKTAPDLKRGIKIPWASLVAPVATIVSLLIVYWAGFTTLFYIVSILFIGIPIFWVNYAVKVLGLKKWVGVSLGITQLIVNIALTIFGYYNLVLNNDSPMLYFVLFILMELVPLVVAYLTINDNGKVHLRSGFWLMGLIFTIYIISYLSEFGPLGSSAPIEFPYDIAIISIVGLIFHYLAVLSGFRTKEIEEIIEDQKERRD

SEQ ID NO: 15552 - protein, 420 aa, Sulfolobus solfataricus P2
MMEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKLEDHDLRTAAMALAVDRVVRAMKARGIL

SEQ ID NO: 15553 - protein, 182 aa, Arabidopsis thaliana
  misc_feature (23)..(23): Xaa can be any naturally occurring amino acid
  misc_feature (46)..(46): Xaa can be any naturally occurring amino acid
  misc_feature (144)..(144): Xaa can be any naturally occurring amino acid
MGSSMFSSTAVVTSPAKATMVAXPFNGVEVIRFFPGHAQGNNDITXITSNGGRVSCMKVWPPIGKKKFETLSYLPDLSDVELAKEVDYLIRNKWIPCVEFELEHGFVYREHGNTPGYYDGRYWAMWKLPLFGCTDSAQVLKEVXECKKECPGAFIRIIGFDNTRQVQCISFIAYKPPSFPEG

SEQ ID NO: 15554 - protein, 239 aa, Arabidopsis thaliana
  misc_feature (171)..(171): Xaa can be any naturally occurring amino acid
MARIRRRIQKRHIHENRYIDFFGERLIVTVTHTTSTIRRWIHSIRFFSRLRSSHPLVVGLDVQWTPGGSDPPPDILQLCVGNRCLIIQLSHCKRIPEVLRSFLEDETITFVGVWNSQDQGKLERFRHQLEIWRLLDIRHYLPTRLLNSSFEKIVEECLGYKGVRKDKEICXSNWGARSLSHDQIVQASDDVYVCCKLGVKECIWKERSNVKERIWKESSNVKEHIWKESSKLYFVGVCF

SEQ ID NO: 15555 - protein, 524 aa, Acidianus brierleyi
MAITSEKSDMDKIIAQLREIKAKAFQGGGEDKIKAQHDKGKLTARERLALLFDEGSFNEIMPLATTRATEFGLDKNKFYGDGVVTGWGKIEGRTVFAFSQDFTELGGTLGETHANKIGKVYELALKVGAPVIGINDSGGARIQEGAIALEGYATVFKMNTLASGVIPQITIMAGPAAGGAVYSPALTDFIIMIKGDAYYMFVTGPEITKVVLGEEVTFQDLGGAVVHATKSGVVHFLAENEQDAISIAKRLLSYLPSNNMEDPPYMDTGDPSDRETKDVESIVPTDSAKPFDMREVIYRIVDNGEFMEVHRHWAQNIVVGFARVAGNVIGIVANNSNTLGAAIDIDAADKAARFIRFCDAFNIPLLSLVDTPGYIPGTEQEYKGIIRHGAKMLYAFSEATVPKISVIIRKSYGGAHIAMSIKNLGADLVYAWPTAEIAVTGPEGAVRILYKRDIQNSQNPDEFLKQKIAEYKKLFANPYWAAEKGLIDDVIEPKDTRRIIVNALSMLKNKREYRYPKKHGNIPL

SEQ ID NO: 15556 - protein, 535 aa, Arabidopsis thaliana
MSSELQISPAIHDPQGQEKQQQAAGVGILLQIMMLVLSFVLGHVLRRHKFYYLPEASASLLIGLSSSYSSFVSNTETSIRTWFNFHDEFFFLFLLPPIIFQSGFSLQPKPFFSNFGAIVTFSVLGTFVASMVTGLLVYLGGVMFLMYRLPFVECLMFGSLISATDPVTVLSIFQELGSDVNLYALVFGESVLNDAMAISLYRTMSLVRSHSSGQNFFMVIVRFLETFVGSMSAGVGVGFTSALLFKYAGLDVDNLQNLECCLFVLFPYFSYMLAEGLSLSGIVSILFTGIVMKHYTYSNLSANSQRFVSAFFHLISSLAETFVFIYMGFDIAMEKHSWSHLGFIFFSILFIVIARAANVFGCGYLVNLARPAHRKIPMTHQKALWYSGLRGAMAFALALQSVHDLPEGHGQTIFTATTAIVVLTVLLIGGSTGTMLEALEVVGDSHDTSLGDGFEVVNSRYMTSYDDEDTPPGSGFRTKLREFHKSAASFTELDRNYLTPFFTSNNGDYDDEGNMEQHHEERIPFTRRGNLNNRG

SEQ ID NO: 15557 - protein, 463 aa, Saccharomyces cerevisiae
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQAEPSQGVAARENSSEETASKKEAAPKKEAAPKKEVTEPKKADQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGREAVTFLKTVKELIEDPRKMLLW

SEQ ID NO: 15558 - protein, 469 aa, Yarrowia lipolytica CLIB122
MQHNMSWKEQAERFMDFMSNAPTAYHACDLLAQDFDAAGYKELYERDEWDLTTHNKFYVRRNGSAIMGFVIGENWTPGNGVGVVATHTDALCGRVKPISIKQPVDGYNLLGVAPYSGAFSSVWWDRDLGIGGRLIVRDEASKSVTSKLVHVPYPIARIPTLAPHFGAPANPPFNPETQMTPIIGLTSSKEVKAPTDEEKQSPMVGKHSIDLLRVLAKHARVPVKDILQVELELFDTQDPVIGGLNHEFIFCPRVDDKLCTYTAVQGFIAAKHDDRALNVVACYDNEEVGSGTRQGAQGDLFQCIVERVVAHGMDSSVANQAAEYTRQTYANSFLVSADVGHAVNPNFSDAYLEFHKPQLNYGMTLKVYPNAATTSDAVSMALIEEIARRTDNKTQVMHTRNDTRAGGTLGKFLASATGMRAVDAGIAQLSMHSIRGTLGSKDIALGTRFFRDFYSSWYEVDQEWKNGDI

SEQ ID NO: 15559 - protein, 161 aa, Zea mays
AKLTWADSNQFLVVCLDPSPPFFFLNDPSPRIISLVEKRNPSEGTPPVAFPFDGGPNAVFFAQNRKNAAHFLPKVLYFFPPPDNDLGSFLVGDKSILGGAGLPSLKEVGGFPAPPDRKIPDQKFKGGVSFFFFSRLGAGPKVVVGEGQALIDSVPGLPKGG

SEQ ID NO: 15560 - protein, 117 aa, Daucus carota
LDEAIIDRTEAIEVAKRKEKLLKLQKQHLDELNKEVKGEQLPVESDASDKKPVDTGFIAADSEQAIKDAADITMVGVSRKKRELYKAMQIGNERKKAKTQLLKERKRLLDEAKKSNT

SEQ ID NO: 15561 - protein, 162 aa, Saccharomyces cerevisiae
MSQVYFDVEADGQPIGRVVFKLYNDIVPKTAENFRALCTGEKGFGYAGSPFHRVIPDFMLQGGDFTAGNGTGGKSIYGGKFPDENFKKHHDRPGLLSMANAGPNTNGSQFFITTVPCPWLDGKHVVFGEVVDGYDIVKKVESLGSPSGATKARIVVAKSGEL

SEQ ID NO: 15562 - protein, 769 aa, Oryza sativa
  misc_feature (29)..(29): Xaa can be any naturally occurring amino acid
  misc_feature (67)..(67): Xaa can be any naturally occurring amino acid
  misc_feature (79)..(79): Xaa can be any naturally occurring amino acid
  misc_feature (87)..(87): Xaa can be any naturally occurring amino acid
  misc_feature (620)..(620): Xaa can be any naturally occurring amino acid
  misc_feature (632)..(632): Xaa can be any naturally occurring amino acid
  misc_feature (737)..(737): Xaa can be any naturally occurring amino acid
MWRHGERCVILAVAAVALVAAATATAAAXAVGGERRTYIVHMSRSAKPNDFVEHGEWYAASLQSVSXAATVLYTYDTIXHGYSARPXRRAEAEALESQPGVLLVNPEVRYELHTTRTPEFLGLDRTDALFPQSNTGSDVIVGVLDTGVWPERPSYDDAGLGPVPAGWKGKCEEGNDFNASACNKKLIGARFFLTGYEAAKGPVDTSKESRSPRDNDGHGTHTSSTAAGSAVRGADLLGYAAGTAKGMAPHARVATYKVCWVGGCFSSDILKAMEVAVNDGVDVLSLSLGGGTADYYRDSIAVGAYSAMERGIFVSCSAGNAGPGSATLSNGAPWITTVGAGTLDRDFPAHVVLGNGKNYSGVSLYSGKQLPTTPVPFIYAGNASNSSMGALCMSGSLIPEKVAGKIVLCDRGTNARVQKGFVVKDAGGAGMVLANTAANGEELVADAHVLPGAGVGQKAGDTMRAYALSDPNPTASIVFAGTQVGIQPSPVVAAFSSRGPNTVTPGILKPDLIAPGVNILAAWSGSVGPSGLAGDSRRVGFNIISGTSMSCPHVSGLAALLRAAHQDWSPAAIRSALMTTSYNGYPNGNGILDVATGLPATPLDVGAGHVDPSKAVDPGXLVYDIAAADYVXDFLCAISYGPMQIAALTKHTTDACSGNRTYAVTALNYPSFSVTFPATGGTEKHTRTVTNVGQPGTYKVTASAAAGSTPVTVSVEPSTLTFTKSGEKQSYTVSFAXAAAMPSGTNGFGRLVWSSDHHVVSSPIAVTWT

SEQ ID NO: 15563 - protein, 833 aa, Magnaporthe grisea 70-15
MGDLASKLKAKFKRRNSSTPPSIASSTRSNDRTRSLTGQRPPSFEVTARNRSKKTDKSDVEAVPMTPESESARQSSPLSKVEPEEISETATRKSSATETTATTIATPSDSLRTSPDSTAASTTTKDEHLNEGELKPQAKEDQGAGEETPEKSSGSAGSSAESAPENPPNSKFSEPVASNLADANTKMGKDPQSSALPSINEYPQDSSTTTDSPHTTTDEDDLITHTPSQVVDHSGSGEPTPRAGLGLGIPATANSAQTSAANTNPRPHPSSTHSSPIAARRPNAAFPAPSSSSSSQAGVQAQISAQLLRTLLGSANPDELQNLGGGPLQSLTGPTMTRRRKIWVRRPGASPTLITINEDDMVDDVRDMILRKYANSLGRQFDSPDLTLRIVPRENQRERQLGPDEHMCKTIDAYFPGGQTVDDALIIDVPLRRTPRPSPRAGPPHAPQLASVYFAPASTDDVHRPPEAGTDYFGPAVLATTSHLPNGTSGQPHSIGVLTTGQIPQIPSPGGTRRTTAYTSRPERPRLGRQHTSSPTILNLVNSGHAAQMPAGTVMVEQASGPPPSAPPMPTPPPVEAPAPHVATPPALAPPCVASPRPAARPRKKKPLDGLNLPPGILSGGVPPINVLIVEDNPINLRLLEVFVKRLKVRWQTAVNGREAVDKWRQGGFHLVLMDIQLPVMSGLEATREIRRLERVNSIGVFSSSADSAPDEVLGEPSEEDKLGNTDMFKSPVIIVALTASSLQSDRHEALAAGCNDFLTKPVNFVWFEKKIMEWGCMQALIDFDGWRKWKDFSQNRDEQDAAKKAAAAKAKTKKNRSSLTTAAYNGGTTVAA

SEQ ID NO: 15564 - protein, 609 aa, Magnaporthe grisea 70-15
MKVTSFFRGLGMFVGLAVAAPHASNSDQALGLFPREPGVSPAFDLSKRQSCHTPTNRACWSPGFDINTDYEDKIPDTGVTRQYTLTLTEQWNWLGPDGQRKEVAMLINGGYPGPTIRASWGDWIEVTVVNNLEINGTSFHWHGIRMLNNCVNDGANGITECPIAPNKSRKYRFRAQQYGTSWYHSHFSGQYANGVVGHILIDGPASTPYEEDLGILSITDWYYKGADRIQYELIPSPGRAPPSDNILFNGKGISPPGRPAGGSYQRTVLKPGRRHRLRIVNPSVDNVFKVRLAGHPFTVIQTDFVPVQAFTTNELLVGIGQRYDVTIEANQSVGNYWFNVTVTCGGATNALTPASIFQYEGASSTALPTNPGPALDTTCLDIINFSPVVRKDFPEAVFRASSDNTLNTAVTTKNWEGVQRVYWTVNNVDMNITWDEPTLEYVAKGNTNIPQRYNLFRVPRGNEWSVWIINNPIPAPHPMHLHGHDFYVLGRSANMPTATVFDPARDTAGLTWTNPTRRDVTMLPGNGWLAVAFRTDNPGAWLFHCHIAWHVAQGLSVQFLERVDEIPATVNLAELEPTCRDWTAYYETSPNKQHDSGLRTGGNSTARAV

SEQ ID NO: 15565 - protein, 157 aa, Prosthecochloris aestuarii DSM 271
MRVGIGIDVHQFVENRKLIIGGIEIPHTMGLKGHSDADVLLHAISDALLGAAALGDIGKHFPDTSPDFKDIDSRILLRHVGKLIADEGYTIVNIDSMLLMERPKVAPYIVAMRESIAECLDIETSRVSVKATTNEKLGYIGRQEGAAAHAVCLIEEK

SEQ ID NO: 15566 - protein, 350 aa, Nocardia farcinica IFM 10152
MKALTYAGPQAISCTEVDDPALPGPDGAIVRVTAAGICGSDLHIYGGHGFTPGTGYGVGHEAVGQVVELGPQAHGLSVGDRVLVPASAGCDRCGNCRAGVVAACARQPLPVDACYGLGGALAGAQAQLLAVPHAGGNLVRLPDAIGDEAAVVLTDNAPTAWYGARRARIAPGDTVVVIGLGPVGLMAVQAAFVMGAARVLGVDLVADRRARAAALGAEPVEDDDPKQAVREMLGGGGADVAVEAVGADATIALATAVVGHRGRVAVVGVSQNRAFPFHLPLAQVKELEFHIGLCSVQYELPALLSLTAAGRLRPEVVVSHRLPMSAGARAYRMFADRADDVCKVVLDPWR

SEQ ID NO: 15567 - protein, 319 aa, Physcomitrella patens subsp. patens
MSSQVFVPAANEKTFASFMTDFLMGGVSAAVSKTAAAPIERVKLLIQNQDEMLKSGRLSHPYKGIGECFSRTIKDEGMMSLWRGNTANVIRYFPTQALNFAFKDYFKALFGYKKDKDGYWKWFAGNLASGGAAGASSLLFVYSLDYARTRLANDAKSSKKGGGERQFNGLVDVYKKTLATDGIAGLYRGFAISCAGIIVYRGLYFGIYDSLKPVVLVGNLEGNFLASFLLGWGITIGAGLASYPIDTVRRRMMMTSGEAVKYNGSMDAFRQILAKEGAKSLFKGAGANILRAVAGAGVLSGYDQLQILLLGKAYSGGSG

SEQ ID NO: 15568 - protein, 339 aa, Enterococcus faecalis
MNSVFQGRSLLAEKDFTRAELEYLVDFSIHLKELKKKGIPHHYLEGKNIALLFEKTSTRTRSAFTTAAIDLGAHPEYLGANDIQLGKKESVEDTAIVLGSMFDGIEFRGFSQEVVEDLAKYSGVPVWNGLTDQWHPTQMIADFMTVKENFGRLEGITLVYVGDGRNNMANSLLVTGAILGVNVRICAPKELFPSDEVVNYAKEFAKESGAELMITDDVAKGVKGANVLYTDVWVSMGEEDKFEERVNLLKPYQINMAMLEKTENMDGDLIVLHCLPAFHDTKTQYGEMVAEKFGITEMEITDEVFRSKYGRQFEEAENRMHSIKAIMAATLGNLFIPRV

SEQ ID NO: 15569 - protein, 95 aa, Arachis hypogaea
ASKQQNRQELDERAKQGETVVPGGTGGKSLEAQEHLAEGRSKGGQTRREQLGTEGYQEMGRKGGFSTMEKSGEERAEEEGVEIDESKFATKNQNK

SEQ ID NO: 15570 - protein, 104 aa, Zea mays
NILCVYSIYCFVSQGLALAGSGSIFETLRLGKPLIVVVNEDLMDNHQSELAEELAERKHLFCARPQTLGETIRAMDLETLVPYEPGDAKPVVALINRFLGFPVA

SEQ ID NO: 15571 - protein, 165 aa, Lentisphaera araneosa HTCC2155
MKEFQNHTISVYIRNNPGALMRMCQIFSRRGYNIDSLVVSPAMDGRFSRVSISAKGASDSLKQINLQLEKLVDVVHCIEHKDTEAIVREMVLVKVAANAVNRGEILQITKHFGGKTVDFTDNSLVIECSGASTKLDAMIALLSNYEIVEMVRSGQMLMARGEKPT

SEQ ID NO: 15572 - protein, 186 aa, Streptococcus pyogenes MGAS10394
MSLIGKEIAEFSAQAYHDGKFITVTNEDVKGKWAVFCFYPADFSFVCPTELGDLQEQYETLKSLGVEVYSVSTDTHFVHKAWHDDSDVVGTITYPMIGDPSHLISQAFEVLGEDGLAQRGTFIVDPDCIIQMMEINADGIGRDASTLIDKIHAAQYVRKHPGEVCPAKWKEGAETLTPSLDLVGKI

SEQ ID NO: 15573 - protein, 404 aa, Oryza sativa Japonica Group
MGFPVVGETFQFFRASPSVDMPSYYKQRLERYGPLFKTSLVGQPLVVSLDPEVNRFIFQQEEPHHVQWNRSQVHPELCVQALWAENLKESLLPELENSMRESFASWASKPRIEVQDGVSDMIFDLVAKKLIGLNVTQSRELRKNFQEFFQGMVSFPIYFPGTSFYRCMQGRKNVRNTLTDVMKERLSAPEKKYGDLVDLIVEELQSEKPVIDENFAIDALAALLFTSFATLSSTLTVALKFLNDNPKIVEELKEEHDVILKKREVMNSGFTWEEYKSLKFTTQVTNEITRISNVAPGVFRKTLTDVQVNGYTIPSGWLVMISPMAVHLNPELFEDPLKFDPWRWTEEKRSSLLRNYMPFGGGIRLCLGADFSKLFIALFLHILVTEYRYIRMLVFTHCLLSSLK

SEQ ID NO: 15574 - protein, 1625 aa, Bdellovibrio bacteriovorus HD100
MNYSGRLGSTGTLLLLLSLILTGCNISAKLQDLLSSEPVQAELKISDIDPYIIVNAGNVSAKLISGTCGNNETSLQIKLDSTVVASTTCDNNQWSVTYDFSAVPDSSALILEVQETLTTGETRTESATILKDTVLPQLSNLNNIIIPAEPQSAAWSCLDPADLCQFRYLDSTSPAFVFITENFTATNNTTLATPGIRYLYVQAADKAQNLSAPQQVQIYVGTPQIFIGTLIKSTTLNGVEDLNILAPASLPEMALFNNQTCTGTPSWVSTATFIDNWNLDAGAQGGTAYVSVKFRTATLDESPCYHDSIQWPTYTTHTMCTNTTSSLSRGRIVDSGGLAGVYQNDELCTLDLTLTGPAKFYIDLLDTENGYDFVRIYDNGTEVFSESGVVTPMLVNTTSSTVRVEFESDGSVTDNGFDIRWEATGADPAPAPIMTLNGGDPIAVSATVSVALSAPSPMSQTYLTEDPSCSAGGAWASFSATTNWTFSDATSGPKELYVKFRDAFNSETFCSVATVTLEVPEIFIDYPATSDQIGNSLELGGYCSVPNKQVQLSGTLSATTTCTVDQEWYYTLDTSNLANSSTVNVTATLKDNDITLASDSKTFTITRTLSIQSPANGAIIGPSTQFSGSCNVNGATINITSPVTTSTTCSGGTWSSAISVPGADGAAITFTAQLMQNAIVQETKTASYTLSTTPPTIQITGAPSGVSVLNSVSVNFGGATVSAFRYKVGNSVDCSSLSGYTAEAAAPASRTLDLSGASNGDITVCAIGKSSVNGLWQDFAAATSVSWTKDSEVVASITSKNISINEGTTNNAVTFTLSGTKTYDVKVYYNYFGDQIYMVDHNLAPGFVTIPAGSLSASISYDTFDNGLTENDRNLRVFISHTDQAAVRIGTSSLVYHLIKDDDAVFTTATKIVSARYNQCAIYSDGRMFCWGDNYNGQLGVGHKNRVGTKVEPLAGFTVLDVSITDQYACAVTTAKKIKCWGYNYYGQLGNGNTTEQTSPVDVDSGENYVKISTGAQGACALTELGKVKCWGRNNSGNVGDGTTTDRYSPVLIDGTVNYTSIHRKSSTTCGITDTQELKCWGGNNQQQIIPGSTTNVLSPTVVDAGTSYLSVAGGATLCGVTTGQKLKCWGWNGNSVVGAMTGTNPVVTRTTIDAATDYLSVSDESGYRCAITAANDLKCWGEVRGTVSSEQTTILNTPTLVNDGIKYSQIAAASYGACGISTDGQIVCMGDNYNNWFEPLPLFDMATLDPNTTIAHYGVGSAGACAIKSNGQAVCVGSYAGSGYTVSTPAVVDNGSDFTGGKASPSNNGSCVINGSGRMMCAGANGFGAVGNESMDSSVQYMSMVAPSVSFAMTARETFYCGYGLSTAGKLYAWGAESNCPSRTPTMVDAGTSYRTDSLVVASSLACAITTGDQIKCYGYDDGKGHLGGVSRTTPTVLDGGTLYKSIAVSYAHICGLTSADKLKCWGANNQGKVGNGTTTNTSVPYTVDSTENFTKLSVGTNAVCAITSGQVLKCWGYWGDYTGNMTVTSPTVVNGSETYLDIQVGSNSALGLTTGGKLHYWPSARFDQAPLAIASSQNFTSIKGHGEGNTYCAMNASGHLWCSKNRWDGNFVSTPRYMPYRRQ

SEQ ID NO: 15575 - protein, 447 aa, Streptococcus pyogenes MGAS10394
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFENLAKLSVVFRFFQYIPTALAVMKLRKDAPDANVIFRVPFGPIIPILAVIVSLVMIWGDNPMNFVYGAVGVIIASSVYYLMHGRSHQMDQMPPKEQI

SEQ ID NO: 15576 - protein, 577 aa, Streptococcus thermophilus CNRZ1066
MTKMLKGIAASDGVAVAKAYLLVQPDLSFETVTVEDISAEEARLDAALAASQDELSVIREKAVESLGEEAAAVFDAHLMVLADPEMTGQIKETIRAKQVNVEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIAAVLGINNITELVKDGDILAVSGITGEVVINPTEEQIAEFKAAGEAYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKELPYFDLPKEMNPFLGYRALRISISETGNQMFRTQLRALLRASVHGKMRIMFPMVALLTEFRTAKGILEEEKAKLVAEGVAVADDIEVGIMIEIPAAAMLADQFAKEVDFLSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 15577 - protein, 470 aa, Burkholderia thailandensis E264
MTRSPSSLQCSRALFASPARDRRVAAAPENASGCRANIRRRLPEGRRPAIPPRRRRSRRRPSGQRGRPSRRVRLKPAARGVKYALSLPPDPFMTLASTPDIIAELKAGRMVILVDEEDRENEGDLVLAAEFVTPEAINFMARYGRGLICLTLTQERCKQLNLPLMTYRNGTQYGTAFTVSIEAAEGVTTGISAADRARTIATAVAHDVRPEHIVQPGHVFPIMAQPGGVLVRAGHTEAGCDLTALAGLTPAAVICEIIKDDGTMARLPDLIEFGKEHGLKIGTIADLIHYRSRTESIVERVAERTMQTAHGPFKAVLYRDHPTGSPHIALVRGTPAPHDETPVRVHEPLSVLDLLETGVSTHSWTLDAAMKEIAARELGVVVLLNCGDTKEHLVDVFLAFDEKEKAAELKRRPVDFKTFGIGAQILRDVGVGKMQVLSNPRKLGSMSGYGLEVTGFAPMPGSATSASDAA

SEQ ID NO: 15578 - protein, 413 aa, Triticum aestivum
  misc_feature (206)..(206): Xaa can be any naturally occurring amino acid
  misc_feature (285)..(285): Xaa can be any naturally occurring amino acid
  misc_feature (340)..(340): Xaa can be any naturally occurring amino acid
  misc_feature (344)..(344): Xaa can be any naturally occurring amino acid
YCWLIYLADELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAXCYKALNDQHVLLEGTLLKPNMVTPGSDSKKVAPEVIAEYTARTLQRTVPAAVPAIVFLSGGQSEEEATLNLNAMNKLQXQEAMEPVLLLRACPPAEHPQGLVRQDGERGEGQGGVPGEVQGQLRGHPRHLQGRXHPRXGRLREPPRQGLQLLIDLPSVLWPVWAPAYYHCHCLVPDPDIPRISNTFLIIWNFGGPVPFYIVYLTGFF

SEQ ID NO: 15579 - protein, 737 aa, Parvularcula bermudensis HTCC2503
MSYNTFSFDVDSDGIALLTIDLPGQSMNVWNQDLVEDFEKMADDFISNDEIKGLVIQSGKDTGFLAGADLNMISMIPPDADPQFIFDQNYRLQTILRKLETGGKPAKELEKNLAKAKPVAVAVDGLALGGGMELVLAGHYKVASDSGKTQFGQPEVLVGLIPGAGGTQRIMRLAGVQNAIEICTQGKNMDAEKAKRLGLIDEIAPKDEIVAKAKEWVKANPKVVQPWDQKSFKIPNGGGGAMNPKIVPIFAGASAMTAGVTNHNYPAARRILSAVYEGSIVPMDVALRIESKYFTQCLMEPQSRNMIRTLFKNKTAAEKGMARPEGVEKTDLKKIGVLGAGMMGAGIAYVSAKAGLEVVLIDREQEYAEKGKAYSEKLNEKGVKRGKLSKEKSEEMLARITPTTDYDHLKDVDLIIEAVFEDPDVKAETIKKTEAIIPDSTVFATNTSTIPIGDLAEYSSRADKFIGIHFFSPVDKMPLVEIIPHANGGDKALAVALDYVGKIKKTPIVVADARGFYCNSCVVPYLNEAARMVMEGINPALIDNGALHMGMPVGPLALMDETSQELGLNIARSRQKAEGENYKREPTEDLLELFVEELGRKGKKVGKGFYEYPEDGSKKYFWPGLKEHYPLAEEQPTVEEVQERLLYVNLVAAARMYAQGVVHDPQSADLGAIFGWGFCPWTGGPMSYIDMIGLDKFVETADKLATKHGWLYEPPEMFRELAKKGTTLYGEYDKKAA

SEQ ID NO: 15580 - protein, 750 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCDGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 15581 - protein, 567 aa, Legionella pneumophila subsp. pneumophila str. Philadelphia 1
MNTITESYRAGLFQKKYWLQNIISGLIVGVVALPLAMAFAIASGAKPEQGLYTAIVAGLIVSIMGGSRVQIAGPTGAFIVVLSGITAQYGISGLQIATLMAGFILVLFGFARLGSIIKFIPSPVIIGFTSGIAVVIWVGQWQYFFGLPAAGSGHFHEKFWHLLLSFPHMNIATTFLGICALFIVLYSSKLPGLKRIPGPLIALVLVTIIQSVWHFEGVATIGSLFGGIPQGLPAFTWPEITMGRLIELIGPAFAIAMLGAIESLLSAVVADGMSGTRHNSNRELVGQGIANIVAPLFGGFAATGAIARTATNIRNGGNSPLSGIIHSITLILVLLFLAPLAVDVPLAALAAILFVVSWNMSEARHFIKLIRVAPRADVVILLVTFCLTVFVDLVVAVNVGVIIAVLHFLRRMVNSIQIQRMSEGQLSQELAQEKNYDLPEGVMVYVIEGPFFFGAVETFQSALANTHTDPKVLIIRMRWVPFIDVTGLQAMEEIILNLQKRGVRVLLSEANPLVDAKLRKMGIVQLIGEQNYYKEFSQALDVCRINDSDRKSQPPFEVAKPLASVTQ

SEQ ID NO: 15582 - protein, 269 aa, Rhizomucor miehei
SINGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALDLYQREEGLSSSNLFLYTQGQPRVGNPAFANYVVSTGIPYRRTVNERDIVPHLPPAAFGFLHAGSEYWITDNSPETVQVCTSDLETSDCSNSIVPFTSVLDHLSYFGINTGLCT

SEQ ID NO: 15583 - protein, 182 aa, Shewanella sp. ANA-3
MSGPLRTYQGIHPQLGDNVYVDSASVLVGDIALDTDASIWPMVAARGDVNHIRIGKRSNVQDGSILHVTRKFASRPDGHPLIIGDDVTIGHKAMLHGCKVGNRVLVGMGAIILDGAILEDDVILGAGSLVPPGKVLQSGYLYVGSPAKQARPLTEAELKFLPESADNYVRLKNEYLAEPQPE

SEQ ID NO: 15584 - protein, 337 aa, Aspergillus nidulans FGSC A4
MSISSTSPPYPLHPSVKDLLDPEYVAFYNAHVIDKQQVHLQPVETSRTSGILIPGGGPLVDVGKTVDITIKRRATEGPEILLRAFTPIGEAPEGGWPVMLYFHGGGWVLGNIDTENVVCTNLCSRGGCVVVTVDYRLAPENPWPAAVHDCWESFLWLLSDGPANLNINISKIATGGSSAGGNLAAIITHKALTLSPPVRFLAQLLSVPVMDNTATVSNNESYRRYEFVPALPAAKMLWYRNHYLPNEKDWSHPEASPLFYTGDWSALPRALIMVGELDVLRSEGEQYAEKLKQAEVEVDLQVMKGMPHPFLAMDGVLKEGKRSITLMCDLLKEVFSS

SEQ ID NO: 15585 - protein, 205 aa, Glycine max
MQGGMRSFLSHGNVIRNAVLQRVRMVNPLLQTIASSRFESVTPARIEEHGFESTTISDILNDKGKGADGSWLWCTTDDTVYDAVKSMTQNNVGALVVVKSDANKAIAGIITERDYLRKIIVQGRSSKSTKVGDIMTEENKLITVTPDTKVLQAMQLMTDNRIRHIPVIDEKGMIGMVSIGDVVRAVVREHRQEVERLNAFIQGGY

SEQ ID NO: 15586 - protein, 518 aa, Oryza sativa Japonica Group
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 15587 - protein, 183 aa, Brassica napus
TNRPDIIDSALLRPGRLDQLIYIPLPDEDSRLNIFKACLRKSPVAKDVDINALAKYTQGFSGADITEICQRSCKYAIRENIEKDIEREKRRSLNPEAMEEDGVDEVSEIKAAHFEESMKYARRSVSDADIRKYQAFAQTLQQSRGFGSEFRFETNAGSGATTGVADPFATSAAAAADDDDLYN

SEQ ID NO: 15588 - protein, 321 aa, Oryza sativa Japonica Group
MGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 15589 - protein, 172 aa, Kandelia candel
MANPRVYFDMSVGGSPAGRIVMELFADVVPRTTENFRALCTGEKGKGRSGKPLHYKGSTFHLVIPNFMCQGGDFTAGNETGGESIYGSKFADENFVKKHTGPGILSMANAGPGTNGSQFFICTAKTEWLDGKHVVFGQVVYGMDVVKAIEKVGSGNGRTSKPVVIADCGQLS

SEQ ID NO: 15590 - protein, 730 aa, Oryza sativa Japonica Group
MAKRGSKKKTTASTRALPLLRRSAGETGTAESKEETGAASPIKNAIKNAAAGEMAEEEKLAGAASPLLRLRSARGETGTAIKNAAAAGEMGEEETAAMGITRTRGDQETPRKKKGRSWKESKAMDDGAAALRRKAREITKEEEDDERLRGEMVSRVRARIRKQQPDETNDEEIQAHETYLLHDAGRGAGDTSDHPAAIARPQDVTTFHIVGVVDTDGARVRLLFRDSDLYFVAFKTGSCWFRFNDEHIPTFLTPTVPIAYTSGYMNIAQVRVGYHCLYDIFNVISRYTPESAQEKTNERQRILQCAALMLSESQRFGHVQLLVKRQIHKMMSKKITAKQNKKIHSWGSIARYCISHECKEDVLHHLSTLIVLFNPDQNKYENYKIVGRRKLLSRAAAAAAEAAARAAEAAARPSQAAAAEAEEEEEDDDDDEDEYPWQCQTRAGQELLILLYDKRLPPPVTPMVVTQQKNHKKTQAEEVDEKKNQENPNTDATIGAPSGGENHQNRSLISCDGINLYESDLDSLRGPHWVTDAILGYALAKFSRAYSDDGLLLVQPTNAALLNNKHYVAAEADHLLLASRRLVLIPVNDNLDFNQAGDGKHWSLLVIHKTSNDGVIQFIHHDSVRSGDNSYNLHAAQKLANVLRGVLPTAGDVINAETPQQTNGNDCAIHVLAAVQVICRWWRANANKSGPADWIRKLDKRISEGNITQMRASLLQDIERDCQKKKSKDQ

SEQ ID NO: 15591 - protein, 268 aa, Oryza sativa Japonica Group
MMAAAGLESAWEYLITHFSEFQLASIGTFLLHESVFFLSGLPSLLFERLGLFSKYKIQKKSNTPDYQNRCVVRLVLYHVCVNLPLTILSYRTFKFMGLRSTLPLPHWTVVVSQVLFFFVLEDFIFYWGHRALHTKWLYQHVHSVHHEYATPFGLTSEYAHPAEILFLGFATVAGPALTGPHLFTLWVWMVLRVLETVEAHSGYHFPWSPSNFLPLYGGAEFHDYHHRVLYTKSGNYSSTFIYMDWLFGTDKDYRKTKALEEKERTKHL

SEQ ID NO: 15592 - protein, 321 aa, Enterococcus faecalis V583
MKTILVLHTGGTISMSKVAGGSVAPNEKNPLMEQEALFSGKVHLVVEDIFNIPSPHMTLERMFQLKERIQKAYSEPIDGVVITHGTDTLEETAYFLDITLEKKIPIVLTGAMRSSNEIGSDGLYNFISAIWTACSDESYDKGVLVVMNDEIHTARYVTKTHTTNVATFRTPTFGPIGTIAKERAFFAKEVLPQEVCDVSSVKGNVHVVKAYAGMGERMFELLNTPETDGLVIEALGAGNLPPETLPALQKMLDNGIPVVLVSRCSNGIAEDIYDYAGGGVGLKKMGVVFARGLNGPKARIRLIVGLNSEKNPAELKEFLEQ

SEQ ID NO: 15593 - protein, 516 aa, Physcomitrella patens subsp. patens
MEALISVPFSTESAVTFVIIATLSWLWIFRWQQRHRLAPKEWPVIGAAVETIRNFDDLHDWVLSYFQKGIKTFRVKFPGTMYTYTVDPKNIEYILKTNFANFPKGDLYHKNMETLLGDGIFNADGEVWRQQRKTASFEFASRVLRDYSTVIFRENALKVGDIVVGASQTHNAVDMQDLFMRLTLEGICKVGFGVEIGTLSPSLPAIPFASNFDNANEAVTYRFFDPFWRLKQLFNIGNEAVLSRSVKVVDDFTYNVIRTRRVELQSTEGENKVRKADLLSRFILLGEDPEQNFTDKTLRDIILNFIIAGRDTTAATLSWFFYLLGNHPRVADKIYDELHALDDDANVNKSQSLNQEMSEYATQLTYDVLLKLQYLHAAITETIRLYPAVPQDPKGILADDVLPDGTVLKKGGLITYVPYSQGRMKDIWGEDAEDFRPERWIKDGVFTPLSPFKFSAFQAGPRICLGKDSAYLQMKMASALLCRFFKFELAPGHPVKYRTMATLSMQRGVKMYVTRR

SEQ ID NO: 15594 - protein, 903 aa, Bdellovibrio bacteriovorus HD100
MHQNVNSDKQASKTAVPQKFVYFFAAGDSEGNAGMKNILGGKGANLAEMTSLGIPVPPGFTISTEICAHFYEAGGKLPDWVRPAVQESMNKVESKIGKKFGDVNNPLLVSVRSGARASMPGMMDTILNLGLNDQTVEGLAKSSNNPRFAWDSYRRFIQMYSDVVMGMNSSLLEVTLEDMKEEKHYKLDTEMTVDDLKLLVKKFKDLVHQMTGQSFPADPWEQLWGAISAVFHSWNTPRAITYRELHSIPAAWGTAVNVQSMVFGNMGDDSATGVAFTRNPSTGEKAFYGEFLINAQGEDVVAGIRTPQPITKIAAAAAGVMSLEEALPQAYGQLVEIYKKLEGHYRDMQDIEFTIERGVLWMLQTRNGKRTAAAALKIACDMIDEKLITQDEAILRLDPSSLDQLLHPTLDPKAAKTTLAKGLPASPGGVNGQIVFTSEEAVEWREQGKKVILVRIETSPEDIAGMVAAQGILTTRGGMTSHAAVVARGMGKCCVAGCGDIEVDYRNETMKVKGYVLKKGDVITLDGSTGEVYLGEVKTIEPKLDGNFERIMKIADGIRRLKVRTNADTPKDAQTARNFGAEGIGLCRTEHMFFGADRIDAVREMIIADNKMDREKALAKLLPMQREDFYQLFKIMDGLPVTIRLLDPPLHEFVPHTDEETKELAKRLNTDYERLRSKVKSLHEFNPMLGHRGCRLAITYPEIYQMQVRAIAEAAAQLMAEGKTLAPEIMIPLVATDKELDTLRGQAVAEVNKVQSEKNVKFEYTVGTMIELPRAAITADAIAEHADFFSFGTNDLTQTTLGLSRDDSGRFLGTYVSHGILPKDPFMSIDQVGVGSLVKMGVDLGRRTKPDLKVGVCGEHGGDPESIEFFHKVGLDYVSCSPFRVPIARLAAARAALIGKKIH

SEQ ID NO: 15595 - protein, 795 aa, Legionella pneumophila subsp. pneumophila str. Philadelphia 1
MTVKRHTIDLAHLGMRDLDQVGGKNSSLGEMISHLSSAGVSVPGGFATTADSFREFLSQNDLDKKIYDKLTALDTDDVCQLAVVGKQIREMIIDTPFTPEFEQSVRSSYQKLAQEIGHDNFSVAVRSSATAEDLPDASFAGQQETFLNVKGEEAVLAAIKQVYASLFNDRAIAYRVHHNFAHNEVALSAGIQQMIRSDLAVSGVMFTMDTESGFDQVVFITSSYGLGEMVVQGAVNPDEFYVHKPCLEAGKPAIIRRNLGSKALKMVYCDDPSLERRVKTVDVDPAERLLFSLSKEEVEQLANQALIIEKHYGRPMDIEWAKDGVNGKLYILQARPETVKSRDNKQVLERYTLQKRGDVLAEGRSIGQRIGQGKAKVIKDINEMHRVQPGDVLISDMTDPDWEPVMKRASAIVTNRGGRTCHAAIIARELGIPAVVGCGDATKTIKDGDVVTVSCAEGDTGFVYSGLLPYEQERLDVETMPELPMKVMLNVGNPERAFAFQSIPNSGVGLARLEFLISNTIGIHPKALLEFDTLKDEELKRYIKEKTIAYDSPVEYYIERLKEGIATIAAAFYPKPVIVRLSDFKSNEYANLVGGSLYEPQEENPMLGFRGASRYVSSNFSECFALECKAVRRVREEMGLDNVEVMIPFVRTVSEAGNVIEVLKKHGLERGKCGLRVIMMCELPSNALLASEFLQYFDGFSIGSNDLTQLTLGLDRDSGLVASQFDERNDAVKALLHMAISACKKEGKYIGICGQGPSDHQDFAQWLMKEGIESVSLNPDSVLQTCLFLAKQSMN

SEQ ID NO: 15596 - protein, 479 aa, Legionella pneumophila subsp. pneumophila str. Philadelphia 1
MSNSKWWFLLVCFIPAITFASEGGEHSDPVTSVLLGVTTILFLAIIGRYLARLLNQPGVLGELLIGMIVGNLSYFFGSELVVILREGSAIYDVVKEMLAGISLNQAVTHVIHNSYYANQVIHALSGAEGTEYLKIAYVVDIFSRYGVIFLLFMVGLETSLSDLKKTGKESILVAVIGIVAPMILGFVVACFIIPNSNYKINLFIGATLSATSIGITASVLKEMNKLSTREARTILGAATLDDILGLIILAVVSSIVISGAVSIMVVMKIIILALLFFIGTLFMGPFVLRKAVDLFRFLEPWESKLFISFLFIMALAWLASFIQLAAIIGAFAAGVILHDDYFGEQKAHHKDHRSIHHLVSPLETILAPMFFTLIGIQVKLETFYDWNVIVLAGGLSVAAILGKLLSGLGANRRDDRLLIGIGMLPRGEVGLVFASIGRTIGVISDNLFTAIVLMIMITTFIAPPLLKMRYAKPKEDRNA

SEQ ID NO: 15597 - protein, 493 aa, Zea mays
MRALAPRPSQSRSLQQPRNLCRALHTGVQAAPGPALMNLAAFSSTLATLPWYEMPSINSSATFSSSLLRRSLCASLRTISHMASAAAPTSAPVATTENGAAKAIEQRPVQVAERLEKFKTTIFTQMSMLAIKHGAINLGQGFPNFDGPDFVKEAAIQAINAGKNQYARGFGVPELNSAIAERFLKDSGLQVDPDKEVTVTSGCTEAIAATILGLINPGDEVILFAPFYDSYEATLSMAGANVKAITLRAPDFAVPLEELEAAVSKDTKAIMINTPHNPTGKMFTREELESIAALCKENDVLLFSDEVYDKLVFEADHISMASIPGMYERTVTMNSLGKTFSLTGWKIGWAIAPPHLTWGLRQAHSFLTFATCTPMQAAAAAALRAPDSYYDELKRDYSAKKAILLEGLEAAGFIVYPSSGTYYIMVDHTPFGFDSDVEFCEYLIREVGVCAIPPSVFYLDPEEGKKLVRFTFSKDEGTLRAAVERLKAKLRRK

SEQ ID NO: 15598 - protein, 309 aa, Nostoc sp. PCC 7120
MVAADNLRKMSEEAKFNLVAYLKERQKLCEAALDAAIPIIYPEKIYESMRYSLLAGGKRLRPILCLATSEMMGGTIEIAMPTACAVEMIHTMSLIHDDLPAMDNDDYRRGMLTNHKVYGEDIAILAGDGLLAYAFEFVAIRTPESVPRDRVLQVVARLGRALGAAGLVGGQVVDLDSEGKSDTSLETLNFIHNHKTAALLEACVVCGGILAGASSENVQRLSRYSQNIGLAFQIIDDILDITSTQEQLGKTAGKDLLAKKVTYPSLWGIEQSRVKAQQLIEAACTELEPFGEDAQPLKAIAHFITSRNH

SEQ ID NO: 15599 - protein, 603 aa, Phanerochaete chrysosporium
MPSSIDFPDRLVLRVIAYELVFLFYPAVPAAAGLVLLRRLTDIWLPTWAIVLLSVCSLPVVHGLSIWRNHWRAARKAARMGAVLPPRLKGRWPGSIDLLMRLTDAFETGFMSDLLWEYMHTIGQTFEVYVLWDSNYVTSDANVVKAILATDFTSFVKGKKFDVCMRSVLGTGVFNSDGDMWKFHRTMTRPFFTRERISHFDLFDRHADDAMAKMKARFAEGYAVDFQDLISRFTLDSATEFLFGQCVHSLASVLPYPHNAPAHLQTTSASAAEDFARAFAEAQTVLNFRIRMGWLWPWFELFGSRTKAPMAVVDAFLDPILKAAVERADKIKHANGGKVPEAKEEIDEDETLLDHLVKYTNDPKILHDEVLNIMIAGRDTTAGTLTSAVYFLSQYPEVLRRLREEILEKVGPTRRPTYDDIREMKYLRAFINETLRLYPAVPWNVRYPVKDTTIPGPEPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWAKAHLTLYAKGGLWVKMREAPTSEAV

SEQ ID NO: 15600 - protein, 514 aa, Shewanella sp. ANA-3
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDAAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYELITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 15601 - protein, 313 aa, Erythrobacter sp. NAP1
MTVARHFLDLGDAGADAIAAMISDALDRKEARRDWPKGKTDADEPLKGRVLALVFEKNSTRTRVSFDVAMRQLGGTVLILEAGSSQLGRGETIADTARVLSRMVDAIMLRTDDHAKIEEMARHASVPVINGLTDRSHPCQIVADLLTIIEHKKPLPGLEVAWFGDGNNVLHSVLEAAGLLKFNVRVATPEGYEPAAEFVEIARSGGASVTLTHNAQQAADGADVLVTDTWISMGQADADDKRKAMAPYQVNGDLMARAKPEAIFLHCLPAHVGEEVSEDVFESSQSVVFDEAENRIHAQKSVLLWSFGLLANG

SEQ ID NO: 15602 - protein, 399 aa, Erythrobacter sp. NAP1
MSISPLMPVYPRCGVRPVRGEHCHLIDEDGTRYLDFASGIAVNLLGHSHPGLTKAIQDQAATLMHVSNLYGSPQGEKLAQQLVDKTFADTVFFTNSGAEAVEGAIKAARAYHQNAGEHGDKDRFELITFSNAFHGRTMATISASNQTKMHHGFSPMLEGFKYAEFDNLESAKEFIGPRTAGFLVEPIQGEGGIRPASDSFMKGLRELADQHDLMLVLDEVQCGVARTGKMYAYQHYGIEPDILATAKGLGGGFPIGAVLATEKAARGMTFGTHGSTYGGNPLAMAAGGAVMDAVANEEFLAEVTEKGERIRARLEQFIGNYPELFELVRGKGLMLGIKMKVESRPFFVHLRDNHQLLTVAAGDQTLRVLPPLVIGDAEIDEFFEKLSAGAASFKVPEAA

SEQ ID NO: 15603 - protein, 206 aa, Saccharomyces cerevisiae
MDFEEDYDAEFDDNQEGQLETPFPSVAGADDGDNDNDDSVAENMKKKQKREAVVDDGSENAFGIPEFTRKDKTLEEILEMMDSTPPIIPDAVIDYYLTKNGFNVADVRVKRLLALATQKFVSDIAKDAYEYSRIRSSVAVSNANNSQARARQLLQGQQQPGVQQISQQQHQQNEKTTASKVVLTVNDLSSAVAEYGLNIGRPDFYR

SEQ ID NO: 15604 - protein, 643 aa, Synechococcus sp. WH 8102
MHLGDLTHPNELHGLKLSELEDVARQIRDRHLQVVSTSGGHLGPGLGVVELTLALYQTLDLDRDRVIWDVGHQAYPHKLITGRFNDFHTLRQQNGVAGYLKRSESNFDHFGAGHASTSISAALGMAMARDNRGEDFKCVAVIGDGALTGGMALEAINHAGHLPETPLLVVLNDNDMSISPPVGALSNVLNRARLSPPMQFLSGSVEESVRHLPFMGGELPAELNRLKGSMRRLAVPKVGAVFEELGFTYMGPIDGHDIGEMMRTFQAAHRDGGPVLVHVVTKKGKGYPYAEADQVGYHAQSAFDLTTGKAIPSKKPKPASYSKVFGQTLVKLCEQNSRVVGITAAMATGTGLDLLQKAVPNQYVDVGIAEQHAVTLAAGMACEGLRPVVAIYSTFLQRAYDQLIHDVGIQNLPVTFVLDRAGIVGADGPTHQGQYDISYMRSIPNFTVMAPKDEAELQRMLVTCLNHDGPTALRIPRGSGVGMPLMEEGWEALPIGRGELLREGDDLLIVAYGSMVHPALDTATLLEEAGLSTTVINARFLRPLDQALIHPLARRIRRVVTMEEGALAGGFGAAVLESLSDQDISIPLLRIGIPDKMVDHATPQQSKESLEMIPVQMAERIRRRFDLGGRDFAGAASVPAIQS

SEQ ID NO: 15605 - protein, 327 aa, Zea mays
MATAMGAMAATCMASMPAAATFPGDLGVGRRRAAVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLR

SEQ ID NO: 15606 - protein, 509 aa, Synechococcus sp. WH 8102
MTDYLQRILRARVYDVARETPLDPAPNLSRRLGNEVLLKREDLQPVFSFKLRGAYNRMAQLTPEELSRGVIASSAGNHAQGVALSAKKLGCRAVIVMPATTPEVKVRAVRTIGGEVVLHGETYDECSAEARQRCADEGLTYIHPFDDPEVIAGQGTIGLEIMRQSPEPPDAIYVAVGGGGLIAGIAAYVKQLWPSTEIVGVEPVDADAMTQSLEKGVRVELAQVGLFADGVAVRRVGEHTFALAQQFVDRMVRVDTDAICAAIKDVFEDTRSILEPAGALAVAGLKQDVADCQMTDRRLVAVACGANMNFDRLRFIAERSELGEEREAMLAVEIPEQPGSLRTLCDHLRSRSLTEFSYRMSEGASAHIFIGVQVNGAQDRYQLVDGLQQQGFSCLDLSDNELSKVHLRHMVGGRLPSTSQDSCAGGCLELLYRFEFPERPGALMRFVSALNPGWSISIFHYRNHGADVGRIVVGVLIPVEEQPQWTAFLNELGYPYWNETDNPAYTLFL

SEQ ID NO: 15607 - protein, 383 aa, Wolbachia endosymbiont of Drosophila ananassae
MNIHEYQAKEVLHKFNVSVPKGFVATSAEEVKTQVSQLKSDVFVVKAQIHAGGRGKAGGVKLAKSAEEAQQFVKDMIGMTLVTHQTGPSGQQVRKVYVEEGSSIKKEYYLSLVIDPKLSRPIFIFSSEGGMDIEEVAKNSPAKIVKFDIDSATSFDSSKLSSSFHLSPEQIEKITNVAKNIYDAFIATDASQIEINPLVETSSGDFIALDAKINFDDNALYRHPEIMELRDYDEEVKEEIEASKYGLSYIKMDGSIGCMVNGAGLAMATMDIIKYYGAEPANFLDVGGGASKETVTEAFKIILSDSNVKGILVNIFGGIMRCDIIASGIVAAAKEMSIKVPLVVRLSGTNFEEGKKILEESGLNIIAADELGDAAQKIVKEVK

SEQ ID NO: 15608 - protein, 359 aa, Marinobacter sp. ELB17
MNKFYSLALKEVRPETRNAVSLSFDLPTDVAEKFKYKQGQHLVVRTKVDGEEVRRTYSICSSVNDQELRIAIKRVPGGVFSSFANDLLKPGSVLDVMPPQGHFSVELDPERKGNYLAVAAGSGITPILSIIKTTLETEPRSEFTLFYGNKGTSSTMFRDHLQDLKNEYMTRFNLVYIFTREEQDIDLYNGRIDSDKCDRLFDHWIDAKNLTAAFLCGPQMMTETVRDSLARHGMDKSKVHYELFTPAGGVPKARKDRAETKVDLQAVSVVTVKADGRSLTFDLVRDTKSILQAGNDEGADLPYSCQAGVCSTCRAKVIEGEVEMDQNFALEDYEVAAGYVLSCQCYPVSDKVVLDYDEM

SEQ ID NO: 15609 - protein, 199 aa, Oryza sativa Japonica Group
MSDAQAQPIRPGDVYPPSAADHHQARRERDKAVAADQGGGGGDLRVMAQFTVPVPSAEEETTDAVTIGEALQAAGSDDNEPVGLADAAAVQAAEMRTTGLAGVVPGGVAAAAQQAAEANMRRRPDGDDGENKATTTTLMKDVVGGAAEALPADMVATREDADRVAAAAARNAARRGGGGGKGVAEAVAAAAEMNEGRMV

SEQ ID NO: 15610 - protein, 503 aa, Escherichia coli
METKDLIVIGGGINGAGIAADAGGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLNVYNTHFKKQLSRDDIVWTYSGVRPLCDDESDSPHVLPVITPLIFMMKMAKHRCCRYSAAKLTTYRKLAEHALEKLTPYYQGIGPAWTKESVLPGGAIEGDRDDYAARLRRRYPFLTESLARHYARTYGSNSELLLGNAGTVSDLGEDFGHEFYEAELKYLVDHEWVRRAARRPVASHKTRHVAKCGSTISCESVAGGVYAAEVIAGVVN

SEQ ID NO: 15611 - protein, 434 aa, Sulfolobus solfataricus P2
MSWNNFLFLKYLIKAMEELLTSNLFVQQVKKLYKVGELLGLDIDTLEALSQPERVIQVKIQIRGSDGKLRTFVGWRSQHNSALGPYKGGVRYSPNVTQEEVIALSMIMTWKNSLLLLPYGGGKGGIRVDPKKLTLKELEDLSRKYIQLIHNYLGSNVDIPAPDINTNPQTMAWFLDEYIKITGEVDFAVFTGKPYELGGIGVRLYSTGLGVATIAREAANKFIGGIEGSRVIIQGFGNVGSFTAKFLSEMGAKIIGVSDIGGGVINENGIDVNKALEVVQRTGSVVNYPEGKKVTNEELLISDCDILIPAAVENVINKFNAPKVKAKLIVEGANGPLTADADDVIKQSGIVVIPDILANAGGVVGSYVEWANNKSGGIISDEEAKKLIIDRMTNAFNTLYDFHKRKFADQDLRTVAMALAVDRVVKAMKARGLL

SEQ ID NO: 15612 - protein, 122 aa, Glycine max
MAARLAQLRTKAAQAAEFASKHGGAYYKEAMEKNKQYVVQPPSVEKCQELSKQLFYTRLASLPGRYEALWKEVDGVKQLWKNRKELKVEDLGIATLCGVELYAWFCVGEIAGRGFTLTGYKV

SEQ ID NO: 15613 - protein, 498 aa, Melanophylla alnifolia
  misc_feature (1)..(4): Xaa can be any naturally occurring amino acid
XXXXPTTSGSGVSTLEKKNLGRIAQIIGPVLDVAFPPGKMPNIYNALVVKGRDNVGQQINVTCEVQQLLGNNRVRAVAMSATDGLMRGMEVIDTGAPLSVPVGGATLGRIFNVLGEPVDNLGPVNTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKAGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 15614 - protein, 489 aa, Rumex palustris
MAEIQANNLLSKIASGDGHGEESAYFDGWKAYDKDPFHSSKNPLGVIQMGLAENQLCVDLVQDWVVKNPSASICTPGGVDGFKEMANFQDYHGLPEFRNAVARFMEKVRGDRVNSDPTRIVMSGGATGAHELMAFCLADPGEAFLVPTPYYPGFDRDLRWRTGIQLLPIETLSSNGFKITKAALEEAYNKAMEAGIRVKGVLITNPSNPLGTVLDKDTLVLLLTFINHYQIHLVCDEIYSATVFSDMPNRFTSIAELLEDGEVPCNRNLIHLVYSLSKDMGFPGFRVGIVYSYNDAVVNCARKMSSFGLVSSQTQHLIASMLSDDQFVDKYLSESKKRLATRYKFFTWGLSMVGISSLKSNGGLFLWMDLRRLLQEPTVEAELSLWRVIINEVKLNVSPGSSFHCSEAGWFRFAFANMDDKTVDVALRRIRSFMVKGEEAAAGDKPTVVAKKKKCWQMDLQLRLSARRLEEVMSPHSPLPLSPLVRTRT

SEQ ID NO: 15615 - protein, 422 aa, Legionella pneumophila subsp. pneumophila str. Philadelphia 1
MESSMTYDKIKVPAQGEAITVAADHSLHVPDNPIIPFIEGDGIGVDVTPPMIRVVDAAVQKAYGNKRKISWMEVYAGEKATKVYGGDQWLPKETLDAMKKYVVSIKGPLTTPVGGGIRSLNVAIRQDMDLYVCLRPIRYFNGVPSPVREPWKTDMVIFRENSEDIYAGIEWQADTPEAKKVIQFLTKEMGVKKIRFPEHCGIGVKPVSREGTTRLVKAAIQYAIDNDRSTVTLVHKGNIMKFTEGAFKDWGYQVARDSFGAKEYQGGPWMEFKNPKTGKQIIINDVIADAFLQQILLRPEDYSVIATLNLNGDYISDALAAQVGGIGIAPGANISDQMAVFEATHGTAPKYAGQNKVNPGSIILSAEMMLRHMGWYEAADLIIRGMEGAIEAKTVTYDFERGMQGATLVSSSGFADAMIKHM

SEQ ID NO: 15616 - protein, 751 aa, Parvularcula bermudensis HTCC2503
MGSTFFPVILSGGSGTRLWPISRSYSPKQLETLFGDASLLVHTARRLRAHPGAGPVNILCSSRYGQRIVDQLEADGLNWSTLIEEPMGRDTAAAAGIAASWARATHGDEAVVVLLPADHYVDDLNAFHDALTKAVEAAAHGRIALIGITPDGPNTGYGYIRREQDKLDGLTCYPIRAFVEKPDLTKARAYVESGDYLWNSGIYAMRADVFLEELVRYEPKIAQGVAAAFDGRTVTDRSGRQILRFSADQFSAIPKTSIDYAVAERTHKGAVARGHFPWSDIGNWQSLRELTADPETGNSLKGQVVLHNSRECLVYGHNKPIAVVGLEKVTVVDTEDALLVCADDSVQSVKDVHTILAEEANACALHRSGDLDGALIRHRAWASDWLMRQAFPRWASDGIDPRHGGSVETLDEAGRPATDAPTRCRVQARQIYAYAKALELGWSGAAPILEGLVSFYTTNCRGEQGGYIYATHPDGTPADETIDTYDQAFSLFAFAWAYKATGDLRFRKLGEEAFSFLEEHLDHPQGGYREGVDVGGPRRANPHMHLLEAGLAWADLHGEERGLRLANEMVGLYKERFRVDGVLREYFEDDLSPILSHDNDALTEIMPGHLYEWSWLLKEYERVTGTPAPSPAVPIAFAEQFGHVKTLGLVADAIGADGRQAEGATSRLWPQTEFIRWHLSFGSAPQKLAALAMLDRMKEAFLFEGEAKAGLWRDQLRADGTIIKNVSPASTFYHLVGCLTVPDLILSRPRS

SEQ ID NO: 15617 - protein, 484 aa, Synechococcus sp. WH 8102
MGQFDQNRRTKIVATIGPATESSERIKELVQAGATTFRLNFSHGDHSEHAARISTIRQVSEELGINIGILQDLQGPKIRLGRFAEGPITLANGDSFSLTSRPVSCNQSIATVTYDKLADEVTAGSRILLDDGRVEMKVEQVDQAEQTLHCTVTVGGVLSNNKGVNFPDVQLSVRALTDKDKVDLEFGLSQGVDWVALSFVRNPSDMEEIRGLIREHGHETPVVAKIEKFEAIDQIDAILPLCDGVMVARGDLGVEMPAEEVPLLQKELIRKANSLGIPIITATQMLDSMASSPRPTRAEVSDVANAILDGTDAVMLSNETAVGDFPVEAVQTMATIACRIEKDYPQRSVDSHLASTVPNALSGAVSTIASQLNASAILPLTKSGATAKNVSKFRPASPILAITPDPTVACRLQLVWGVKPLVIPQHELTTHTFLAAMTQAKTMGLLKEGDLVVQTAGTHTGVSGSTDLVKVGIVSSEEAPVNMI

SEQ ID NO: 15618 - protein, 314 aa, Geobacter metallireducens GS-15
MSTMIATRDAYGQTLAELGEENSSIVVLDADLSGSTKTSTFAKKFPERFFNMGIAEANMVGTAAGLAAAGKIPFVSTFAIFAVGRAWEQVRQSAAYPKANVKIVATHGGITVGEDGGSHQSVEDIAIMRAVPNMTVIVPADGPETAKAIRAAAAYKGPVYVRLGRNKVPTVTAADAPFEIGKGVQLADGTDLTFVTTGLMTAQALAAAETLKGEGISARVVHLATVKPLDGDILLKAARETGAIVTAEEHSIVGGLGGAVAEFLAENSPVPLKRVGINDRFGTSGKAEELLKYFGLMPIDLVEAARGVVARKGK

SEQ ID NO: 15619 - protein, 482 aa, Shewanella sp. ANA-3
MTPASASSQHEPLPTSVFLAIFSAVFLPMFLAAVDQTLLATATPAIVEDLGGLRQASWITIGYMLAMAASVPIYGWLGDNFGRAKILMIALVVFALGSIVSASASTMDHMIAGRILQGLGGGGLMSLSQSLVGELVPIRQRARFQGYFAAMFTLASVGGPVIGGFVVHAYSWHWLFWANIPLVMLAVWRLNRLHKQSVKPVRQGRFDLLGVLLFPTIITALLYWLSVAGQDFAWLSATSLGFMGFICVGALVLLWWERRRESPFLPLDLLANKAIYMPLFTAALFAACLFAMIFFLPIYLQVGLHTNPAKTGLLLMPMTFGIVTGSTIAGRLLSRDVAPKWLPTFGMGLAFIGLLLIGLVPPNANLIGALGVLVGIGLGTVMPSVQLVVQSVSGKARLSQITAMVSLSRSMGAAIGTALFSLLLYGLLPLDGAQVGIAAIKQLPIEVVHHAFQWGFIAAALVALSSAIVGYLSPATALRDHE

SEQ ID NO: 15620 - protein, 457 aa, Geobacter metallireducens GS-15
MRKTKILVVDDEHLIRWSLEQNLKKQGYEVVSAGNGEDALRLVRDEQPDLVLLDIQLPGISGLDVLEKIKEHDEEIIVIMVTAHGALETAVHAMRLGAFDYINKPFNLDEMAIVIRKALETSDLRREVQRLRGEQAKKFGTPDIIGASRHMKNVLDMMEKVAKSDASTVLVQGESGTGKELVAKWIHYKSARAERPFVAINCAAVPATLLESELFGHEKGAFTDAKAMKKGLFELADGGTVFLDEIGDMELGMQAKLLRFLEERTFRRIGGTKSFSVDVRIISATNRDLIKAIEEKSFRNDLYYRLQVIPIYLPPLRERREDILTLTSHFIELFNAEFNKHVTGISKMAEKLLLDYTWPGNIRELKNVIERAIILGNDETLLLEHLPLEIVAKASSQSVGLTTFKLPPEGIDIEEVEKELIRQALEISDWNQSKAARKLNLGIDAFRYRMKKFGYLK

SEQ ID NO: 15621 - protein, 980 aa, Aspergillus nidulans FGSC A4
MKRLNRLLRHVHARAKPQQPSSSNDSQVLPLVHSQPPIAFAQDVPQTPIASSEPLSVFAHFLVGVAGSMSPAEWEHNIIAAQEAHIDGFALNIAPQDDYTDQVLQTAYEAAERIGDFSLFISFDYESGGAWPVDRVISTINRYKGRPAQYLYKGKPLVSTFEGSKSSDDWPAIKQATGCVFVPSWTSLSPSRLYTVHGTIDGAFSWDAWPVGAQEKDTSSDKAWMNALSGKPYMMAVSPWFYTNLPQWNKNWLWRGDDLWHYRWQQVIDLQPAMVQILSWNDYGEAHYIGPIYEPGIPEGASWFVKGCPHDAWREFLPHYIDAYRRRSAMFRERASNPATVTSFAPRRPLSYTDKIVYWYRLNPSHSGSADGTTGNNPNMGQPGLDPGEVSQDRVFVSVLVTEPSQVHIQIGPAASRVLIAKESGVNHYSVPFDGHSGPVRIAIVRHGREVKTATGPAITEECTDGKKILSDIHHHESNLAYRQYAQLPETLHLNYQPPTATATPAAHTSPIPEAINPDDYSQAYCDFMTEHPTIFHAVDGFSKQLESKGYKYLSERELWTPQLKRGGKYYTTRNGSSLIAFSVGPEYKSGNGLAIIAGHIDALTAKLKPVSKLPNKAGYIQMGVAPYAGGLGKTWWDRDLSIGGKVLVRNASTGKVESKLVKLNWPIARIPTLAEHFGAPSQGPFNKETQMVPIIGVDNSDLFQSTTPAADEGIEPGTFASTQPPKLIKVISKELGITNYSSILSWELELYDSQPARIGGIDKDFIFAGRIDDKLCCYAAQEALMATSDHTSPSSIKMVGYFDDEEIGSLLRQGARSNFMSSVIERIAQSFATSYGPDLLAQTVAKSFLISSDVIHAVNPNFLNVYLENHAPRLNVGVSVSADSNGHMTTDSVSYGFIKRVAEKCGSQLQVFQIRNDSRSGGTIGPMTSSRIGMRAIDVGIPQLSMHSIRATTGSRDPGLGVKLFKGFFDYFEEVDHNI

SEQ ID NO: 15622 - protein, 611 aa, Yarrowia lipolytica CLIB122
MQSFKHYLQVVFNPQVERAHDEDDTNVTDGVKEMEHLNKIFSKTELVFAWCSLLLVSVCIALESQTVNVYSTFATSHFNELSLLSALAVVKSVMYTASRPTVAKLADVLGRFEALVISVVFFTVGFIMLAACQNIGTYFAAHIFYVSGQVGIQFMEQVFAADTSSLKNRMFFVSLPNFAYLFAPWIAAPITNAITKHSTWRWGYGMWCIVMPVVAIPVCGIMLRLKFKARRLGLEYGKSVRNFKETMRQFDFIGLILFTGGLTLLFLAVTLATGPKSWSQAHILAMIVIGPILLVVFPFWEMVPKYPFMPFYIIKNRTMFTCCFLICCYSIAYFLYGTYYMPWLMVCKNLSVTAATNTSVCFVVASTVSSFVGAAYTKLTNKVKPVVCAGAAIYLLGLGLTYHYRQPHHHLGQFIVAQCVEGVGSGMMQMPMLVMLQSVVSHKNVVSSTAIYLSIMTVGTIIGEAIAGSMYRQSYPKQLAIFAPFLTPAQNHLVANNIGAALKYKWQTPERMMIVTAFNDVYRRMLYPPIIVASFIFVGTLTLPDVNVSLMDDAQNNTDGENAMPHIKGDSESESMDDGMGVHHDSEDIEALAGTTSSEEASFGAEEEKKI

SEQ ID NO: 15623 - protein, 319 aa, Shewanella sp. ANA-3
MTVLLSFGEVLVDLLPTDISGKSHQAIAGGAPANVAVGYAKLGGKSYFAGGISTDDYGAMLKQALANEGVVTDYLTQVPEAPTATVVVNLDEHGERTFEFNRQGTADLCYSPRHFDAIPWQQMDIFHLCSNTFTEASIFNASLYGACCANSFNKIVSFDVNLRLSLWPDTALLAERVEQCFRYTQVLKMSREEAEYLALTRNKSFEDYLQFCLAHGVEVILITDGANPVQCITVNERFSVPVPQIKAVDTTAAGDSFMAGFLFALGFELAFDLEHLTLKHRLACQAQLRKAIEFAVRCGAVTCGQKGAFPALPTLSQVS

SEQ ID NO: 15624 - protein, 406 aa, Campylobacter coli RM2228
MLNNTLFFKESEIRTISSYANRINDEVESGDIGYYHLIDTSLTLIDESLNFIQDKEHVKNIVLVGMGGSSCGVKALRDMLFDEKNNQRELFILDNTSSHSFSRTLEKIKLEESLFLIISKTGSTIEVVSLFKLLIEHFKLDMQELKKYFIFITDKDSKLHKEGENLGIKCFFIPANVGGRFSILSAVGIVPLCFCGYNAKALLEGAKACFEDFFIHKKDEILQKAYHYCTHKSANINVLFSYSDAFKGFNEWYIQLIAESLGKKQGYKRIGLTPIALIGARDQHSFLQLIMDGPKNKTITFLKIKDSQKAPVIPDIHFKFLDDLSNKVNLHDLLNAQCDATMHALIAENLSVDMIELEKLDAWHAGYLMYYYELFTSACGVMLGINTYDQPGVEVGKLILKNILRS

SEQ ID NO: 15625 - protein, 499 aa, Zea mays
MEQHLNTFALVAGMGVAMAMDVDRRKGHPMLARVAEARLGLLIAILMLIPGYKWIKAEIGYPDYVLKEGEGGTIISDEVFGMSSILIFSPQELDYLICGQQEIWEEYVVWHTDGKKGSPSPTKAKWQASQTEEKNRATSPKKKSVASPGRGILAIDESNATCGKRLSSIGLDNTEVNRQAYRQLLLTTVGLGEYISGAILFEETLYKSTTDGKKFVDCLKDQNIMPGIKVDKGLVPLPGSNNESWCQGLDGLASSWVDVVCEDGVSVLALPAFRPAVPLDRFMPLADRIRDLEVGVAFSKPTLLPSPSGSGLFADRLLNDGFSTNITMPECQVAEPALNQKEEVMKECRPPAPAVHSRPAPYWICPVSFIEFSKTTFPSPLIVSSMDVFKTFLLFGEVEVTFFQQGTIPCVCHDGRFIMETPYKVRVADPTFLGYFIDRGVSAVAKVVRKAYPQEKVGVFVQRGKGGPLSVVEYSEMDAAMTTEINQTTGRLRYCWSNV

SEQ ID NO: 15626 - protein, 582 aa, Zea mays
MNELCDLEVHINGHHTLHLHQSVMCAFSGRLRTLVKQEKKKKKGGGRKEAVSINLAGGFPGGADGFELVARFCYNDGRVLLCTSNLPLLHCAAVSLEMTEEVCACNLLAQAEAFVNGLYYWTWGDVLAAVRSCEPFAAAADASGLLDRLISALFSKITGATPGPGPGTPNRSSSSCSSSPDTAGLRRSSSSANKTPDSMRPCAGREWWFDDMTSLSPPTVEKVMRVLGCYGVENKNLILTRFLLHYLRAATRRPPALEREGAALAGLADTAVHGVALVGGTAFSCRGLFWVLRIVSAVGLSRECRHKLERLMGLMLDQATLDDLLVSGDDGGGVYDVNLVMRLVRVFVASEEEADAPSERMRKVGRLVDKYLGEISPDQGLKVSKFLAVAESLPDSARDCYDGVYRALDIYLESHPALSLEERTTLCRCLNYEKLTLEACKDLAKNRRIPPGVAVQALASQQCKLHISEPGPGGSATAAAGKERRPDPSSCSQSQTPRRRVARRATRSVDLGRRSGGDDDEKELLRLNLQRMQSRVVELERACKEMKGQMSRMAKGKSLSLSFGSGAASCHQTGGRGLPRLC

SEQ ID NO: 15627 - protein, 401 aa, Glycine max
MATKRSVGTLKEGDLKGKRVFVRVDLNVPLDDNLNITDDTRVRAAVPTIKYLTGHGAKVILSSHLGRPKGVTPKYSLKPLVPRLSQLLGIEVTMANDSIGEEVEKLVAQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDKTQTVIWNGPMGVFEFDKFATGTEAIAKKLAELSGKGVTTIIGGGDSVAAVEKVGLADKMSHISTGGGASLELLEGKQLPGVLALDDA

SEQ ID NO: 15628 - protein, 209 aa, Brassica napus
MASSMLSLGSTSLLPREINKDKLKLGTSGSNPFLKAKCFSRVTMSVAVKPSRFEGITMAPPDPILGVSEAFKADTNELKLNLGVGAYRTEELQPYVLNVVKKAENLMLERGDNKEYLPIEGLAAFNKATAELLFGAGHPVIKEQKVATIQGLSGTGSLRLAAALIERYFPGAKVLISAPTWGNHKNIFNDAKVPWSEYRYYDPKTIGWT

SEQ ID NO: 15629 - protein, 393 aa, Cryptococcus neoformans var. neoformans
MSAPSTAPSSPEVVQQFSDLDIGSTVTTPAVTRPSSPSPPSLPPSPLSSGKHKIAVIGSGSWGTALAKIAAENAWRRKDEFHSEVRMWVREKIVNGKPLTHIINKTHLNSRYLPDVVLPRNLVAVPHLKDVVKDATLIVFVVPHQFLHTVLNELARPGVLLRGAKAVSAIKGVEVNGTDIQTFASLIEAKVGLPCSALSGANIALEVAMGQFCETTIGCPTSDQSLLWHAVFNAPSFRVNAVEDVSGVSLAGALKNIVALAAGMVDGLGLGGNTKAAIMRIGLKEMTQFCLEFFEGSQPETFSNESAGVADLTVTCFSGRNRKCAEEFVKSGQPFDVIERKLLNGQKLQGTATAEEVNAFLVARKRAHAYPLFEKVYKIAFEGMPPKNLVVGL

SEQ ID NO: 15630 - protein, 172 aa, Streptococcus pyogenes str. Manfredo
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELKGLNGRHAIRNYDYKVLMQFPG

SEQ ID NO: 15631 - protein, 567 aa, Helicobacter pylori
MRRSFLKTIGLGVIALSLGVVSPLSAASYPPIKNTKVGLPLSSHPLASEIGQKVLEDGGNAIDAAVAIGFALAVVHPAAGNIGGGGFAVIHLANGENVALDFREKAPLKATKNMFLDKQGNVVPKLSEDGYLAAGVPGTVAGMEAMLKKYGTKKLSQLIDPAIKLAENGYAISQRQAETLKEARERFLKYSSSKKYFFKKGHLDYQEGDLFVQKDLAKTLNQIKTLGAKGFYQGQVAELIEKDMKKNGGIITKEDLASYNVKWRKPVVGSYRGYKIVSMSPPSSGGTHLIQILNVMENADLSTLGYGASKNIHIAAEAMRQAYADRSVYMGDSDFVSVPVDKLINKAYAKKIFDTIQPDTVTPSSQIKPGMGQLHEGSNTTHYSVADRWGNAVSVTYTINASYGSAASIDGAGFLLNNEMDDFSIKPGNPNLYGLVGGDANAIEANKRPLSSMSPTIVLKNNKVFMVVGSPGGSRIITTVLQVISNVIDYNMNISEAVSAPRFHMQWLPDELRIEKFGMPADVKDNLTKMGYQIVTKPVMGDVNAIQVLPKTKGSVFYGSTDPRKEF

SEQ ID NO: 15632 - protein, 365 aa, Cryptococcus neoformans var. neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAGDIWSTGCIFAEMLEGKPLFPGKDHVNQFSIITELLGTPPDDVIQTIASENTIRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 15633 - protein, 327 aa, Parvularcula bermudensis HTCC2503
MKILVCGGAGYIGAHMCKALAAEGYEPVVFDNLSSGHRHAVKWGPLVVGDIRDRRALDDCFAAHRPAAVIQFAASIEVGEGEANPLKFWNNNVGGTVTLLEAMAGAGVTALVFSSTCATYGIPDRMPIGESEPQRPFSVYGETKLAVEKALAATAKISPLRYASLRYFNAAGASPDGEIGEEHNPETHLIPNALKAAAGIGSAMKLFGTDYDTPDGTCVRDYIHVMDLAAAHLAALRLLLDGADSFICNLGTGTGLTVREILSTVEAVTGRPVPVEESPRRPGDVPRLVADPSFAQEHLGFFPQYSDVGTVIRDAWNFHKTRWSLAP

SEQ ID NO: 15634 - protein, 1242 aa, Oryza sativa Japonica Group
MPPHEDTLDAGGGDVLTFRLHPLAVLKLSDRIREFQYQAAAAARVSYSSSSSSSSGTAAPEDPPPPPTRMSGCVIGVRRGGTVDVSDILDILILHGPDPATFDRALLEKDQEIYKKAFPDLSVLGWYSIGTNVHATDMGIHHGDYTDMQIHQTAEVIDMLRKHSYLKELVVELATTWRRRQQGELVAGAPVAVATAVRGPRRWRRQPSAGAPGGGAVGGGGCRRRPRYPERPQRLTAGLGVAECWSASNVCWRQRRRCGRGSWRRRLLAAWWWRATAQRRFAEAVARVGGSGDGGHDCGGSGDVGGGDGDGEVAERSAAAAAVVVTVSAVIRGMAASDGLPRAWETAATGRRGIVWWRGRRPAWRREAQPMAAEAGSAREARAAEMEAGLAREARPMEGGRIGARDASGRGGWPGADRYGRRWRRRPRCEEELPVGVEQSLAHEGWPPGGAGAGVPHVGRASVVVEHWCVSRGFAGGERTSHRLVRVVQKKNKCAFTSISHHLFDKMVIPKQPDPEEATSPPATAVGTGVAHGTRPAQERRQWRCRRREGGEVGLPLRLPSAEPFWPKLRVIAAGFDFGIRRHRRSLSEIEVSLIFSMPNSLLPLSSPCRPAVGAHRQGCIQSLTFEDTMFTPVRMKTEIFDELMDANGTAFYLLLNPAINFSQKDIPVTIYERVTNTTYKHYKHVLLKIVGVERISLDHADFVYPSPCVVFDVLAPPLGKEFSVLGCVAQPHHLARVGIALCSPFLNANKRCCRYYLILRKYHMIRDRNRLIPYRYQVILARYQMISIRYHAILTTYQVITSEVSDDTYQVSCDSTTYQVSDDSYHVSGDTRKVSCDTYQILGAGHRGVVAGGRVLPCPRSTPNPNLVAGSRILPRPRSTSELIAGDRILRRELVTGGRVRRPRLSRRPRPPRRSSSPVPLPSPHRILHRPRPTSELVAGAIFITNRILCRPCDHAPRRSSPAAASAPPVSASSALLPRRPALSRLREVERERSRWDSIPTGFRKNAFRTMLFETPSGFVMFRVSDVLFRYPEDIWSSFTDPRTAHQAVRTIGFIENIGCWFNGRIVPELIWGLNYALDEFVPQEKGNLSNECHFPLSKQLHEQLKAYGFSISPQLINREFITSFGYLNYLERTSKNISGDLHQKFDRFFCGLEMSEGVFVKVVADRLCSMEEVASTPGRREALSNAEFLLTVPKKKYNTLSRLKRMEAEVRGSGPWVFVAVFAVAFGVMEGLRIAMKRAN

SEQ ID NO: 15635 - protein, 634 aa, Burkholderia thailandensis E264
MFAGVDSARWDGKRGRQIRIVRAVRAESPGTRRASPRTRADLGLDSIHVVHASIHVTNEFAGGAQSRWNVCFDPVYHVPAMTLHSNISGVPFSWRNPYLTTRVPVFARNVVSTSHPLAAQAGLRMLWKGGNAVDAAIAAAAAITVVEPVSCGLGGDAFALVWDGAKLHGLNASGVAPAAWSVDYFRRRHGDAGNGLARQPTRGWDTVTVPGVIAGWEALHAKFGSLPFADLLEPAIELAERGHAVAAVVAHKWAAAVPELNGQPGFAETFMPRGRAPEVSELVRLPGHAKTLRTIAAEGARAFYEGSIAESIAGFFRDGGGALTADDLRAYRPEWVEPIGKDFRGYTVHEIPPNGQGIAALIALGIVERFGLDDLPLDSAEAQHVQIEAMKLAFADVYRYVADPRAMALTPAQMLDDAYLDARAKLIDVTRATHFSFGMPRAGGTIYLSAADERGMMVSFIQSNYMGFGSGLVVPGMGIALQNRGCGFSMDPTSPNVVEGGKRPFHTIIPAFVTQQAGGARHAVMSFGVMGGDMQPQGHLQTIVRMLGYGQQPQAACDAPRWKVSRSFTLDVEAALGASVVDALAARGHTIQAIDDPYMDFGSGQFIWRLDRDEPDRGYVAASDSRRDGLAAGF

SEQ ID NO: 15636 - protein, 367 aa, Arabidopsis thaliana
MSRQSFSLLKNLRSIASGSKIQTRSVTYMPRPGDGKPRPVTLIPGDGVGPLVTNAVQQVMEAMHAPVYFEPFEVHGDMKSLPEGLLESIKKNKVCLKGGLKTPVGGGVSSLNVNLRKELDLFASLVNCFNLPGLASRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGNCRTEDLGGNSTTQEVVDAVIANLD

SEQ ID NO: 15637 - protein, 187 aa, Xylella fastidiosa 9a5c
MNPIRPFLDKTPQLGCAVYIDPTSTVIGDVILGDDVSVWPQTVIRGDVNHIRIGARTNIQDGTIIHVSHHSPYNTAGYPTLIGTDVTIGHGTIIHACTIEKLCLIGMGACILDGATIKKYGFVGAGAVISPNKVVGEAELWLGNPARLVRKLSDKEIESLHYSAQHYVKLKNGYLSLSAETTSTPSP

SEQ ID NO: 15638 - protein, 182 aa, Mesembryanthemum crystallinum
MASSMVSSAAVATVNRTPAQASMVVPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELREAKKAYPEAFIRIIGFDNVRQVQCISFIAYKPASYDA

SEQ ID NO: 15639 - protein, 332 aa, Parvularcula bermudensis HTCC2503
MRVLVTGAAGFIGSYTCHALLDRGWTVTGVDCLNAYYDPALKQDRLRFLEARDGFTFTKVDLSDAAAVANIGSAFDIVIHLAAQAGVRYSLENPLSYVDSNVRAHLNVLELVRHAETPPFLIYASSSSVYGDTTPAPFQETARADQPVSLYAATKRSCELLSESYTAVFDLAQVGLRFFTVYGPWGRPDMAYWSFAERMAKGEPIDVFNNGKLGRDFTWIDDVIDGIVRIAEGGPTPGEARGRHRVYNIGNSRPEPLMHFIEVLERAMGMTATKVMLPMQPGDVHQTAADTGHLAEDYGFAATTSIETGLPIFADWFNSWRSGKAVSTWRHW

SEQ ID NO: 15640 - protein, 307 aa, Erythrobacter sp. NAP1
MTTSGITDWTPDELPDLTDKRFLITGGNSGIGFEAAKILASKNGDVVIACRSEEKGKQALAKLVNEGEGRCELLRMDLADMSSIRAAADEAKDRFGAIWGLVNNAGVMQTPKFKTKDGFELQLGTNHLGHFLWTALMMDQVDGRGGRVVTVASIAHKFGRIDFDNLMMERGYDRSRAYLRSKLANLLFAMELHRRLDAAGSKVKSVACHPGYSSTPLLSKTQNPLSRIVNGVSSAVFAQSPVRGSWPTALAAADDRAESGGYYGPTGFFDARGPVGDSDVEARALDETVAKRLWGVSEELVGETFSI

SEQ ID NO: 15641 - protein, 295 aa, Legionella pneumophila subsp. pneumophila str. Philadelphia 1
MKKRALNFCKVFYMNVVIITGAASGIGHALSQVCLSNGKTIVMVDKNQDKLHTEAQSFMTKFSPEHVICFACDVTQPSEVERLAEYSCKQLGQVDWIFNNAGIIGNLLPAWELQENDINQVMQVNLHGMLNIIRSFMPYLFKQNFRSHIINMASLYALCTGSQMAAYSMSKHAVLALSESLYFDLNRLKKPVDVSVVFPSFTDTSLLASSGKLNHSPIHNQLNNLLAHSRPAIEVAEHIVREVEQKRFYILPDKEVKGYCEDRTKAILLQENPHRNSVEQLMCSLLKRQSSEANL

SEQ ID NO: 15642 - protein, 641 aa, Malus x domestica
  misc_feature (224)..(224): Xaa can be any naturally occurring amino acid
MMSLNRSCFLGNPAVAGSSSPSSQSQKRQPASLKVVALIPKARTGDRNGSVVMESTLQEVKTESEVVELKSTVHGGVEDVYGEDTATEDQLVTPWSVSVASGYMLIRSPHHNKGLAFTEKERDAHYLRGLLPPVVISQELQVKKMINSIRQYQVPLQKYIAMMDLQGRNEKLFYKLLIEHAEELLPVVYTPTVGEACQKYGSIFTQPQGLFISLKEKGKILEVXRNWPEQNIQVIVVTDGERILGLGDLGSHGMGIPVGKLALYTALGGVRPSACLPITIDVGTNNEKLLNDEFYIGLRQKRATGQEYAELLNEFMTAVKQNYGEKVLVQFEDFANHNAFDLLAKYASTHLVFNDDIQGTASVVLAGLLAALKLVKGSLSEHRFLFLGAGEAGTGIAELIALEISKQTNTPVEETRKNIWLVDSKGLIVSSRLDSLQHFKKPWAHEHEPVGELVDAVKSIKPTVLIGTSGVGRTFTKEVVEAMASMNERPIILALSNPTSQSECTAEEAYTRTEGRAIYCSGSPFPPVEYNGKVYCPGQANNAYIFPGFGLGLIMSGTIRVHDDMLLAASEALASMVTQEDFDKGLIYPPFTNIRKISAHIAAKVAAKSYELGLATRLPEPRDLVKYAESCMYSPIYRNYR

SEQ ID NO: 15643 - protein, 439 aa, Bacteroides fragilis YCH46
MKVLKFGGTSVGSAQRMKEVAKLITDGERKIVVLSAMSGTTNTLVEISDYLYKKNPEGANEIINKLEAKYKQHVDELYATEEYKQKGLEVIKSHFDYIRSYTKDLFTLFEEKVVLAQGELISTAMVNYYLQECGVKSVLLPALEYMRTDKNAEPDPVYIKDKLQAQLDLYPDAEIYITQGFICRNAYGEIDNLQRGGSDYTASLVGAAIHASEIQIWTDIDGMHNNDPRIVDKTAPVRQLHFEEAAELAYFGAKILHPTCIQPAKYANIPVRLLNTMDPHAPGTLISNDTEKGKIKAVAAKGNITAIKIKSSRMLLAHGFLRKVFEIFESYQTSIDMICTSEVGVSVSVDNTKHLNEILDDLKKYGTVTVDKDMCIICVVGDLEWENVGFEAKALDAMRDIPVRMISFGGSNYNISFLIRECDKKVALQSLSDMLFNGK

SEQ ID NO: 15644 - protein, 1796 aa, Gibberella zeae PH-1
MAVPSKPVNDNSAVERHNSIETETPPADGFVPEQTDVENHVDDISSKILDIIFDYALNKFNDSKERLESGRPKFLAVVSKFVAAGTRVDMCLPAFPFKSANKAYKVFGILPDKAEELSLGRLNTMCVRISEIYPPGAQCIIISDGIVYNDLLSISDRDTWAYGQALRKMASAKDFKHIGFSRIKDLIDFPMPPDLREIAYVANCTNFRRAFLNRFGKDDIDIDKEIKDNPDTMMTYLGYRRFLESDLKHIFPVGNGRTANDYRRDVRYLAKQMLIRGYAFAGAVKNGFPNHLRLSIHHSTGEHKISMSLLDTKTGFTTPWHCCVARMANGEWTSAPMGEYLKDSNMKVVHENGRPSYFQETIDGAGIEEVSAAQPVHMPRIKSRDTSPDTKSTILSPFTGEEEERLKVLAKSISTQLKQQDNKPINPFSTSENPALDPHSSEFSIAAWLQAVMSITSRDPEKYPRGVAGVAYKDLSAHGVGEATDYQKTFGNYPLELVKFAKKLMSQGESAKIQILRDFDGLIRSGEMLLVLGRPGSGCSTFLKTISGETSGFKIGEESYLNYQGIPKETMHKDFRGECIYQAETDAHFPQLTVGQTLDFAGRARTYVTHLRDVVMAAFDCFQLTSPKVGNDFVRGVSGGERKRVSIAEVAIGGSAVQCWDNSTRGLDSATALEFVRTLRTSTKLTGATALVSVYQASQSIYNVFDKVSLLYEGRQIYFGNIHAAKEFFINMGFECAPRQVTADFLTSLTNPLERRVRPGFQAAWKRSKDRDRLLQEIDEFNKEYPIGGPSLDSFKKFRKTVKATSQRAKSPYNLSIPQQVALCVRRGFQSLRSNATLVIIGSLFNSIMALVVGSIFYDLPNTTDALYSRGALLFFGILLAAFASALEVGIIMTLYAQRPIVEKHTKYAFYHPFTEAVASMICDLPNKILTSITFNLVLYFMTNLRRTPGHFFVFLLFTFTCTLTMSMYFRSIGALSRSLPEALAPASIFSLALAIYTGFSIPIKDMVPWFQWLNYLNFHGRTIECSRFVPQGPTYERVSSGERICATTGAAAGADFVDGDVYLDVNFGYHHSHLWRNFGIMIALMLFGCAVYLVATEYISAKRPKGEVLVFRRSHMPYLQSRMDEEAASSGNGFDILPNHKTALDPPVGLEKQTAIFQWSDVTYDIKVKKETRRLLHQVDGWVQPGTLTALMGITGAGKTTLLDVLANRTSVGIVDGEFLVNGQARDTGFQRKTGYVQQQDLHLSTTTVREALTFSALLRQPRTTSRKDKLQYVEHVIDTLEMRSYADAIVGIPGEGLNIEQRKRLTIGVELAAKPALLLFLDEPTSGLDSQTAWSICQLLRRLADNGQAILCTIHQPSAHLFQVFDRLLFLAMGGRTMYFGDIGPHSKTMTSYFERNGARTCGPDENPAEWMLEITGSLSEQDWPAIWNESPERKAVRAELATKKAELSQRAIAITVPSDVDVLRPFAAPFTTQLHVVLKRVFQQYWRTPSYLYSKVALCLSSNQMYAIFMLLVIFANVCSQIMPHYDAQRALYQSRESPSKTYSWQVFVLSNLLVEIPWNSLSALLIFVSWYYPIGLRHNALEVNEGPEREALMFLFILAFMNFAGTFTNMVLSAVGSAEAAGNLTNLLHSLSLIFCGILVSPDAMPGFWIFMYRVSPFTYFFSGVLSVGLGNSHISCSTEEYLHFSPPPSMNCSAYLEPYIEAFDGYLTSESMGSTTECVFCSGNDTNIFLETVSANYDDRWRNFGIFWVYIIFNMAAAPLLFWLTKVPKDKMSIGKKGKGPEVKSDNVSAE

SEQ ID NO: 15645 - protein, 196 aa, Marinobacter sp. ELB17
MPCYQIDGVTPVVHSSAYVHPTAVLIGDVHVGANCYVGPCASLRGDFGRIVMEAGSNLQDSCVIHAFPGRDAIVRRNGHVGHGAILHGCTIEEDAMVGMNSVIMDEAVIAARSIVGACAFVKAGFECEPASLIVGSPAKVLRQLSDKEVCWKQSGTREYQVLTERCLETIKECAPLTEIDESRPQLRVGSHSLKDR

SEQ ID NO: 15646 - protein, 311 aa, Erythrobacter sp. NAP1
MKIMSGNSNLPLARAIAAYLEIPLTDASVRRFADEEIFVEIHENVRGEDVFLVQPTGYPANDNLMELLICIDALRRASAKRITAVIPYFGYARQDRKPGPRTPISAKLVANLITEAGADRVLAVDLHAGQIQGFFDIPTDNLYAAPVMAADIQARYGDQDLMVVSPDVGGVVRARALAKRLDNAPLAIVDKRRDRPGESEVMNIIGDVEGRHCIMIDDIVDSGGTLCNAADALLEGGAKSVAAYITHGVLSGGAVARIDGSQLKELVISDSIRPTEAAEASEKIRILTMAPLVGEAIRRIADESSVSSLFD

SEQ ID NO: 15647 - protein, 406 aa, Marinobacter sp. ELB17
MNKDRVSRELFDDVMVPNYAPGTIVPVRGKGSRIWDQEGREFIDLQGGIAVNCLGHSHPGLLSALQEQSQKIWHLSNVMTNEPALRLAKTLCDHTFAERVFFANSGAEANEAAFKLVRRYAWEHTGAEKHEIIAFKNAFHGRTLFTVSVGGQPKYLEGFEPAPGGIQHAEFNDLESVRKLISKEKTCAIVVEPIQGEGGVMPATKEFLQGLRQLCDENDALLVFDEVQSGAGRTGYVFAYEMYDVVPDILTSAKGLGGGFPVAAMLTTAKVAASLPVGTHGSTYGGNALACAVAQKVMDTITQPEILKGVRLRSDHLRKGMMDIGERYGVFSEVRGAGLLLGCVLTEKWQGRAKDFLNAGLDEGVMVLIAGANVVRLAPSLIIPEADIDEALKRFEAAVQKLTANQ

SEQ ID NO: 15648 - protein, 502 aa, Thermus thermophilus HB8
MVEPKIYKETVERLEALGFPFRLPLEVTHYIGGEFVRGENFFPVVYPATGEVIGTAPEGREKEVEQAVAAAKEAFKKWSKMPPSQRRPYLRRFAEKIREYKPVFEVLETLDVGRPIHENRLGYVDRMANNIEFFADFAVTHGSEAYPMENGYINYVLRFPVGVAALITPWNMPSMLATWKIGPTLAFGNTAVLKPAEFTPLGAWLLAKCAHEAGLPPGVFNVVHGFGPDSAGELLTKHPDVRLISFTGETTTGKIIMKNASDTLKRLSMELGGKAPNLIFESADLDRAVEVTMRASFFNQGEVCLAGSRLLVQRSVYEPFLERLVKAARSLKVGDPLDPETRMGALIAEEHLNKVMSYVEIARETATILTGGRRPELPHPFDKGYFLEPTVVVDVKPSDKVCQEEIFGPMVVVMPFDTEEEAIELANNTPYGLNAIVQTRDVGQAVRVSEALEVGTVWVNDWFVRDLRVPFGGAKQSGIGREGGHYGYEFYYETKNVCIANR

SEQ ID NO: 15649 - protein, 267 aa, Zea mays
  misc_feature (189)..(189): Xaa can be any naturally occurring amino acid
  misc_feature (228)..(229): Xaa can be any naturally occurring amino acid
MAGLARHVDTEELLTTLKDHPMHKAGGRHSENRATSHITPYSSRYAAGTELSKFKIPQDGAPADVVHQLLKDELDLDGRPSLNLASFVGTYMEREGEQLMIENISKNLSDADEYPAMMDMHARCVSIIAHMWGVQKGEKAIGSATTGSSEAIHLGGLAMKRRWQEKRIAEGKDTSKPNIIMGANAQVAXLEKFARYFEVEARILPVSEDSSYRLDPKLVKENIDETLXXVFVILGSHYTGHYEPGEEISEILDEFEKETGVEIPIHV

SEQ ID NO: 15650 - protein, 366 aa, Yarrowia lipolytica CLIB122
KRYIVHRVNMSVDLKPKTLKRKNFKKLSLNADAGVAPQATASPPPSQPFTLDKPTLQRAPSAGNLISQMASLELGVEFKIDIRAQDLRTIQELGAGNGGSVSRVEHIPTGAVMAKKVIHIEAKEAVRRQILRELHIMHECDSPYIVSFYGAFINESSGDVVMCMEFMDCGSLDRIYKKAGPLTEEIVGHITVAVVEGLTYLYNEHRIVHRDVKPSNILVNSHGQIKLCDFGVSGELINSIADTFVGTSTYMSPERIQGGNYTVKSDVWSLGISLLELLLGKFPFDMANGAVGPMGILDLLQRIVNEPPPTLPAEDTRFSPVCRRFVDRCLYKEAERPSPQQLINDAFIITSRAKQVDMKAWAMSVQ

SEQ ID NO: 15651 - protein, 280 aa, Chlamydomonas reinhardtii
MPPQTSFGLQDPHYFLGRAEILGWINDTLGLRLTKVEDTCNGAVACQLLDVLHPGAVPMAKVDYNANSEYQMINNYKVLQDCFNKLKIDKYVEVARLVKGRPLDNMEFMQWFKAYWDQIIPPGSAPAPYDGPSRRALCKTGDMKHSGGGPAPPKAGGIKAGPPAVSAAPRAAPAAAPRVAAGPKGSPGDRDQMDKLNHQLEDLRLKADGYEKEKDFYYSKLRDVELLCQTPTVCELPIMKRVQEILYAATAEDGGRIMRETQVEFAGREYTEEELSAADG

SEQ ID NO: 15652 - protein, 406 aa, Aspergillus niger
MAAELTSTRLNAENHLLLDQPLLRLPHELARRNFKSVQRLVEREKEYVLPALKETANASLSNEQTPDQALAALDAMISRMQGLKRKMENLHQEERKIQEQSRKRIQHLEKLHQIPSLADVQYDQWARVRLDRLMIDHMLRSGYIKSAQQLAREKGIEDLVDLNVFVQCQRIAESLRTGETKDALQWCGENKAALKKSQYNLEFELRLQQYIEMVRAGHKERFNDAMIHAKRYLAPYLETQSVEIHRAAGLLAFPPDTKAEPYKSMYAHERWAYLSDLFVRTHHELLSLSSRPLLHIALSAGLSALKTPSCHSAYTSSSSNSLSTTTSVCPICSTELNELARNMPYAHHTKSYVENDPIVLPNGRIYGQQRLLEMSKKVGCVEVGKVKDPTTGEVFNEGDMKKVYIM

SEQ ID NO: 15653 - protein, 358 aa, Cicer arietinum
VLGHGDRENISYPREVESLSGLRTVAGACGVWHTAAIVEVIVAQSSASISSGKLFTWGDGDKNRLGHGDKDARLEPTCVSALIDYNFHRIACGHSLTVGLTTSGHVFTMGSTVYGQLGNPQSDGKLPCLVEDKLAGECVEEIACGAYHVTVLTSKNEVYTWGKGANGRLGHGDIEDRKMPTLVEALKDRHVKYIACGSNYSAAICLHKWVSGAEQSQCSTCRQAFGFTRKRHNCYNCGLVHCHSCSSRKAFRAALAPNPGKPYRVCDSCYTKLIKIAESSNNNRRNGMPRFPGENKDRLEKSELRLLKPAVPSNMDLIKQLDSKAAKQGKKADTFSLVRTSQPPSMLQLKDVVLSTAM

SEQ ID NO: 15654 - protein, 366 aa, Candida albicans
MTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGALKNVIACSVGFVEGAGWGDNAKAAIMRIGIKETIRFASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPNY

SEQ ID NO: 15655 - protein, 429 aa, Pyrococcus furiosus DSM 3638
MTIAVYGLGKMGLPLAAVFADHGANVIGVDINERVVEMVNKGENHVKEEPGLDELVRRNVEEGRLRATTDGVWAAKSADVMIILVPTLADDRGNLKLEPVYDVANKIAKGLEKGDIVITEATMPPGTTESLIPILEKSGLKLGEFGLAHAPERTMTGTAIRDITGQYPKIVGASDERTLEAVIGLYETINRKGVIPMSSIKAAEAVKVFEGVYRDVNIALANELALWCEEHGLDALEIFNAANTQPYCHLHMPGAGVGGHCIPVYPWFVISLAKKTNPRLIKTAREINDSMPHHIVELTIRGLNEVGKPLKGSNVLVLGLTFRGGVREFTKSPAIDVIKELKEWGARVFTYDPLCNEEDAKRFGAEWKEDFKDVDAIVIVTDHKEFKDLNLEEIAKQVRNRVIVDGRNILDPRKAEKLGFVYLRVGRVF

SEQ ID NO: 15656 - protein, 491 aa, Pseudomonas fluorescens PfO-1
MNKTSKFLPEELWSNCVFDGTWINISPDVSQVIEPATGASLGCIGMANAASVSAAARVANEVQADWFLTAYEERAAIMRKAAEIAELHFGDIVEWLVRESGSTQLKAAFETRVTIKALQESAMMPGKSQGDVLPNAPGSGRLSLARRRPLGVVGIISPFNFPLYLAMRSVAPALAVGNSVVLKPDPRTAVSGGLVIGRLFELAGLPKGVLHVLPGGGDAGAALVESPDVAMIQFTGSTAAGRKVGEAAGRNLKKVSLELGGKNSLIILDDANLDLAVANAIWGTFLHQGQICMATGRILVQRSLYPAFLKALTAKVGKLSVGDPATTKVSLGPLINAHQRDQVAKIVREAQQAGAKLEVGGRYEELFFQPTVLSDVKPDNPAFREEIFGPVAVVVPFNSDEEAIRLANDTEYGLAAGIISSNIGRAMKVGDKLRTGMLHINDQTVNDEVVNPFGGWGASGNGTSVGGAANWEEFTQWQWLTIKDEATPYAL

SEQ ID NO: 15657 - protein, 430 aa, Coccidioides immitis RS
MAPMQPDSQFSQLTTAPHDEVFALMGAFSADPFPDKVSLGAGVYRDNEARSWRLPTVELQLLDDPTFDHEYLPIAGYPPFIELSRDLVFGGADSPVDKDQIASLQTVSGTGANHIGARFLADFLPPLVHGKKRKVWISDPTWVNHHLIWELVSSGTTGSPVERRTYPYYHAPTRTLDFDGMINVLEKDASKGDVVLLHACAHNPTGIDPTRAQWHKIADLCERKGLFPFFDSAYQGFASGDLNNDAWPIREFASRGMELCVAQSFSKNLGLYGQRVGAFHLVCRSADAAAKARSQAMEIQRGEISTPPAYGARIAAAVLSDPALRDTWKQDLITMSSRIKSMRRALYDELKRLHTPGTWEHIINQIGMFSYTGLTKEQVRVLRQKYHIYILDSGRISISGLNTSNVKYVAQAFDTVVRECPAANGKPHDP

SEQ ID NO: 15658 - protein, 211 aa, Prochlorococcus marinus str. MIT 9301
MNPANYLEIKNKIPSNVNILAVSKGFKSQEIKTIQNIGQNDFGESKVQEALEKQLTLKDHKQINWHFIGRIQSNKIRKIVQNFKYIHSVDSFEKLQKISNISREEKKNPLIMLQVKLSDDPTKGGFNPEFLIMKWREIQELKNISLTGLMTINPKGLSSKENSGLFKKCRALADSLQLPDCSMGMSGDWEEAIDAGSTWLRLGSLIFGGRF

SEQ ID NO: 15659 - protein, 273 aa, Dioscorea alata
MSSPTLLHLLLLSSLLFSCLPNAKPQQAEDEFSYIEGSPNGPENWGSLKPEWKTCGNGMEQSPIQLRDNRVILDQTLGKLRRNYRATDARLRNSGHDVLVEFKNNAGSLSINRVAYQLKRIHFHSPAEHEMNGERFDLEAQLVHESQDQKRAVVSILFRFGPADPFLSDLEDFIRQLSNSQKNEINAGVVDPNQLQIDDSAYYRYMGSYTAPPCTEDITWTVIKKLGTVSPKQVLMLKQAVNENSINNARPLQPTNFRSVFYFEQLKSKLGVI

SEQ ID NO: 15660 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 15661 - protein, 270 aa, Prochlorococcus marinus str. MIT 9301
MTDKIAVIGFGNIASAIVTPLLDKKLIQPENVFCVVNTEKSLEKIKNNYKHNINVYKSGSKESKIIWDCQYKLLSIKPQQLNYISEAYHIKNKDNLIVSILAGVSINRLAQKFPNHKCVRVVTNIPITIGKGLTGISWGKEITEDQKQFTKKLFENTSKIYEFTEDYLDIFLALTSSGPAIIALIIEALSDGGLSGGLPKIISEELVMEMILGTICLIKEKKLTTSELKNLVTSPGGTTISALRVLEKKSVRSALIESIVSASNRSKEFR

SEQ ID NO: 15662 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLIKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 15663 - protein, 192 aa, Legionella pneumophila subsp. pneumophila str. Philadelphia 1
MLLIIDNYDSFTYNLVQYFQSLNQKVEVFKNDEIQIDTIRQSAPQYLVISPGPNSPDESGISIEVIKEFHKHIPILGICLGHQCIAQAFGGKIIPAPEIMHGKTSEITHHYQGLFTGIPNHFQATRYHSLAVDIMSLPNCFSIDAWADDTIMAISHRQFPLFGLQFHPEAILSQFGLQILENFLRYETQTSI

SEQ ID NO: 15664 - protein, 400 aa, Pseudomonas sp. ADP
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVSVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 15665 - protein, 535 aa, Rhodotorula sp. CBS 8446
MLALVCVGLFLYLLCKYRSHAIATSDRTDLAGPKGWPLMGVFKFPLPTLSVTYVVVDVTEKTLSGNLIFYATQSSTRGLEWGVRFVKTYGHAWTLSVPGLRLIDISTRPDWIEYVQKTNYHNYVKGSAFRNRLSDIIGNGIFVTDGRVWQFQRKVTSHIFTGRSFQDAICPAIAEELRSLNKLLDNYADTGETVDLQDVFYRFTFQAFGRFAFNLDLRNLEIDHKPVPFTTAFDQCQKPSLDASSTRSGAFASALPLPAVEYQTPPSCFRLCLRNDDKRAALLAKKDAKVPSDLLTMFMTARYDDSRPLSRVEIRDAIINLLLAGRDTTAQSLTWALYRLVDNPAHQRLVREEICGQLAGGTEPVTLENVKNLVQTQAAHLESLRLHPPVPRIVKQAVKDDALPNGGPLIKAGEFIRLSDWALGRNEEVWGADAKEWKPSRWIDDEGRPIQYSQWKAHFFNGGPRICLGKSLATLEGVAVIANLLHRYNIAFAPGWWENVEKTGRIAGDLEETPLYGPALTLPMKSPFWVTISRR

SEQ ID NO: 15666 - protein, 398 aa, Xylella fastidiosa 9a5c
MNTPTHTHPHPFGSTATIRCERAAAELRTGRPVLLIDAHTRRHAVMALDSMTAQSFTTFANAVGNTHYLFLTPARSNVLGLEAPQGARIPLATLSYDSLVKLAYLRQPTHPTTWVPGDIMDAAATEITRLALLLPAIVAAPLTHHTEHAFADCQTLDLTDLDTAAAGASTTEYELVTRTPVPLRDLGMSEFIVFRGGIAQRDQVAILIGQPDLSSAVPVRVHSSCLTGDLFGSLKCDCGDQLRHGLATLKALGGGVLLYLDQEGRGNGIAAKIRAYGYQHVGLDTIDADAQLGFGPDERRYTGAVMMLRALGITRIQLLSNNPTKVERLRAAGIIVEQRIPVIGQITEQNEYYLRTKVSRAGHDLDIDALIMTSQRPQDPSETVDGETVKSIPKTGHA

SEQ ID NO: 15667 - protein, 175 aa, Triticum aestivum
MAAAGDAGEKKMITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDQATLFDLILAANYLNIKGLPDLTCQTVADMIKGKTPEEIRKTFNIKNDFTPEEEEEIRRENQWAFE

SEQ ID NO: 15668 - protein, 437 aa, Arabidopsis thaliana
  misc_feature (34)..(34): Xaa can be any naturally occurring amino acid
  misc_feature (63)..(63): Xaa can be any naturally occurring amino acid
MSKPEETSDPNPTGPDPSRSSSDEVTVTVADRAXPSDLNHVSEELSDQLRNVGLDDSAKELSXVPISVPQGNVETDSRALFGSDQKEEEEGSEKRMMMVYPVRPDSEDCSFYMRTGSCKYGSSCKFNHPVRRKLQIGRERVRERDEDVENPKLMECKYYFRTGGCKYGESCRFSHMKEHNSPASVPELNFLGLPIRPGEKECPFYMRNGSCKFGSDCKFNHPDPTAIGGVDSPLYRGNNGGSFSPKAPSQASSTSWSSTRHMNGTGTAPFIPSMFPHSRGVTPQASDWNGYQASSAYPPERSPLAPSSYQVNNSLAETSSFSQYQHQMSVEEFPERPDQPECTYYLKTGDCKFKYKCKYHHPKNRLPKQAAFSFNDKGLPLRPDQSMCTHYSRYGICKFGPACRFDHSIPPTFSPSSSQTVEARQVGANGNEDDSWH

SEQ ID NO: 15669 - protein, 181 aa, Magnetospirillum magnetotacticum MS-1
MEARRHSALKDSVRSIPDYPKPGIIFRDITTLLSDPRSFRRAVDSLVHPFAGGRIDQVAGIEARGFILGGAVAHQLSSGFVPIRKKGKLPHKTVSTAYALEYGTDEIEIHVDAIRPGDRVILVDDLIATGGTATAAVNLLRQLGAEVVAACFVIDLPEIGGAQRLRDLGVTVRTLMEFEGH

SEQ ID NO: 15670 - protein, 264 aa, Magnetospirillum magnetotacticum MS-1
MINSPLMTVMVDAVRKAARGLKRDFGEVENLQVSRKGPGNFVSAADRKAEEVLRDALMKARPGYSLVMEESGNIEGTDKSHTWHVDPLDGTTNFLHGIPHFAISVGLERDGQIVAGVIYDPAKDELFVAERGKGAYLNNRRLRVSGRQDFADALVAYGTPYLGRGSHGRLLKEVAAVMAVSGGTRRLGSAALDLAYVACGRTDLYWERDLQTWDIAAGIILVREAGGFVTSADGGAEPLAARSVACGNEVLHRELIGLLRKANA

SEQ ID NO: 15671 - protein, 543 aa, Anabaena variabilis ATCC 29413
MLFSILWILIMGFFAGQLARRLTAPPLIGMILVGIILGPQVRNLISQDVLGAADELRTVAVTIILMKAGLGLDREKLAQQGSVALRLGFLPATTEAIAIAIASIIIFKFDFPTGLLLGCVIGAESPAVIVPGMLRLKSLGLGVTKGIPDAILTGSALSDVLLLLVFSLLLNFLSDGGVEQITLIGGFTLNAVYLLPIQILMQIVLGLFLGYLAARLLVLLLTKQNWTQNAVQDTVIAASLALFLVIIANTLPYFSGYLATMAMGFFLIELDAPLARRLRGGFDSLWVVAEIFLFVLLGATIQLQVLENILLPGILILSIGLFIGRMIGWYLSTLGSNWNWHERLFLLPGNSAKATVQAAIGAIPLAQGIAGGEIILAIAVLSILITAPLGAWATTVFAPKLLRRGEVDPTKVTIATRTLLLAAVDTSSLAIEVLTKVADLARRSNGEAIVLHVVNTSNQQDVEQIQAQAKQLLSDIRYKFLTITGAVPEEILRIAETYNATAIVMGKRGHQPWEKVLIGSVSQAVIENSSIPVILLDTRPKKN

SEQ ID NO: 15672 - protein, 210 aa, Bradyrhizobium sp. BTAi1
MRDPVETYMNLVPMVVEQTNRGERAYDIFSRLLKERIIFVTGPVEDGMATLIVAQLLFLEAENPKKEIAMYINSPGGVVTSGLAIYDTMQFIRPAVSTLCTGQAASMGSLLLCAGHKDMRFSLPNSRIMVHQPSGGFQGQATDIMLHAQEILSLKKRLNEIYVKHTGQSYKAIEDALERDKFLTAEAAAEFGLIDKVIDKRPEDPAPMAK

SEQ ID NO: 15673 - protein, 235 aa, Zea mays
  misc_feature (27)..(27): Xaa can be any naturally occurring amino acid
LHPLRCSRFHRAVRNLTWPCRRWWSTXVVFPPVARPPGSAGSHFLGGAGVRGLEIGGNFIKFTAIGVYLEDAAVPALAKKWGGKTADELASDAAFFRDVVTGDFEKFTRVTMILPPTGEQYAEKVTENCVAFWKAAGLYTDAEGVAVEKFREVFKPETFAPGASILFTHSPAGVLTVAFSKDSSVPAAGGVAIENKRREGVGAPRQGDRRARRRAVGGARLHHRLRRGAGGRANE

SEQ ID NO: 15674 - protein, 317 aa, Prosthecochloris aestuarii DSM 271
MAKPIKIFAGRSNTALAEKIADYLDMPLCDAKVENFSDGEISVNYFESIRGSDMFIIQSTNPPADNLMELLIMIDAARRSSAARITAVIPYYGYARQDRKDRPRVAITAKLVANLLTKAGANRILTMDLHAPQIQGFFDIPFDHLYSSVVLIDHIRSMELDNLVVASPDVGGVKLARAFAEALGTDLVIVDKRRPKANVAEVMNIIGDVNGKNVLLVDDMIDTAGTLVNAAKAIQDAGGKKIYSAATHGILSGPAIERINASVLEKVILTDSVVTGHAPSGKIEEVTVSNLFGEAIKRIYDDNSVSCLFDSKNIKKK

SEQ ID NO: 15675 - protein, 350 aa, Candida glabrata CBS 138
MTVKVLFLGPEGTYSHQAAIQQFSHLVDYNVVYEAVDSIPSCVDKLIEHDNDIEDVDLYSVVPLENSTNGQVVFTYDILRNLMQGSNGTNMRIRENQVVAPITIVGEQYVSILHCLISPDPSIGIESLQNYDTLKIYSHPQVWGQVSKYLVELQKRFPNLKLERINCNSTSEAVLQAAEEQSSSQSSGILNLAIASEIAASIYQCYIIQHSINDILGNTTRFLVFKKKSNHRRLLAPPSATPQRVSLLTFTIKQDDPGSLVEVLSVLKDFSLNMCSISSRPYLLRSEQISQQGENFRRRNWQYIFFIEFYIEQDKEFDKDKFCDRIDALCGDWCHWGRFPRDICYYKNTA

SEQ ID NO: 15676 - protein, 131 aa, Alyssum lesbiacum
YAKMYKEDGLTGGHVIMLGADPLSQAAAIGALHAYPGGLQVGGGINSENCLSYIEEGASHVIVTSYVFNNGKLDLERLKDLVKIVGKQRLILDLSCRKKDGRYAIVTDRWQKFSDVFLDEKSFEFLGGFAD

SEQ ID NO: 15677 - protein, 355 aa, Arabidopsis thaliana
MSEFDKHVQNHIKNEKPFNSIKPSEIDSTLSLSDSLLLKIIEKLPESQSNDVSLVCKRWLNLQGQRLRSLKLLDFDFLLSERLTTRFPNLTHVDLVNACMNPRVNSGILFCHKSISFHLSSDSSNWEFLEENLLHSDVIDRGLRILSRESFDLLNLKVINASELGLLSLAGDCSDLQELELHKCNDNLLHGIAACKNLKGLRLVGSVDGLYSSSVSDIGLTFLAQGCRSLVKLELSGCEGSFDGIKAIGQCCEVLEELSICDHRMDDGWIAALSYFESLKILRISSCRKIDASPGPEKLLRSCPAMESLQLKRCCLNDKEGIKALFKVCDGATEVNIQDCWGLSDDCFSLAKAFR

SEQ ID NO: 15678 - protein, 292 aa, Pyrococcus furiosus DSM 3638
MKVRKAVIPAAGLGTRMLPITKSMPKEMLPIVDRPAIHYVVEEAIKAGIEDILIITGKGKRAIEDYFDRSFELEYYLRERGKFEELKQVEEIGEMVDIYYVRQKKPLGLGDAILHAEKHVNGEPFAVLLGDDIIISKKPAIKQLMEVAERKNTSVIGVEKVPWELVSRYGIINGQKIDEQLYTITDMVEKPSPDEAPSNMAIIGRYVLIPEIFDFLKETPPGKGGEIQLTDALRAMLNEYEMLAKVISGRRYDIGTRIGFIKANIELSLLRDDLREGVILFIKNILQEVQDE

SEQ ID NO: 15679 - protein, 125 aa, Oryza sativa Japonica Group
MGGGKNKVQMGAVQACEPYCPTPTPPVTPPPSPPSGGGNKCPIDALKLGVCANVLNLLKLKVGVPASEECCPLLGGLVDLDAAVCLCTAIKANVLGININVPVDLVLLLNYCHKTCPSDFSCPLI

SEQ ID NO: 15680 - protein, 390 aa, Pyrococcus furiosus DSM 3638
MINNAQPPIYEEGLEELMQELKGKYHATNDYRWAILNSDITFITVGTPSKPDGSIDLTHVKQAAKSIGKALRDKEDYHVVVVKSTVLPGTTEEVVKPILEKHSGKKAFKDFGLAMNPEFLREGVALKDFLNPDRIVLGVQDEKTKKILEELYEPINAPKLIVDIKTAEMIKYASNAFLATKISFANEIGNICKKLGIDSWKVFEGVGLDHRISPHFFKTGIGFGGSCFPKDVKALIKKAEEIGENPLILKAVIEVNERQPLKMIELLKKHIPELKGRKIGVLGLAFKPNTDDVRETRAYIIIKKLLEEGASVIAYDPKAMENFKRFYPDVSGGIEYATSPEDVLKSTEIILIVTEWPDFEELDYSGKIVIDGRRIKAAERTARIYEGVCW

SEQ ID NO: 15681 - protein, 216 aa, Pseudomonas sp. ADP
MPSKNLHRNWVVIPHVTNHDDADITDLEAFRVQFNKENEKSGVKVTMLAFMIKAAVAALKKFPEFNSSLDGDQLVMKNYFHIGFAADTPNGLVVPVIKDADQKGIVQISKEMGELAAKAREGKLAPADMQGGCFSISSLGGIGGRYFTPIINAPEVAIMGVCKSSIEPKWDGKQFAPRLMLPLSLSWDHRVIDGAAAARFNVYFASLLADFRRIVM

SEQ ID NO: 15682 - protein, 265 aa, Streptomyces spectabilis
MSLAHAEGGAALLRLAVRAAHRAGELLLEGAAAGPPEVRTKSSAKDLVTAFDRRSEACVVEILTAARPDDGILGEEGGERPGGSGVRWVIDPLDGTANFVSGYPAFVVSIAAEREGRTEAGVVHDPSRRETFTAIRGRGAARDGLPLTVSGAERLEQALVSTGFSSDPATRDRQAALAARVVSRVRDIRSSGSAALDLCWVAAGRLDAYYESDTRLWDRAAGALIAEEAGAWVGGDAAGQPPGDAMTIACAPKVADALRALVGHA

SEQ ID NO: 15683 - protein, 115 aa, Triticum aestivum
QGLKSTACLPVSRRSNGASLGSVSNGGRIRCMHVWPIEGIKKYETLSYLPPVSTEALLKAVDYLIRSKWEHSLEISRVGFILREHNASSGYYDGRYWTMWKLTMLGCTDATQVIN

SEQ ID NO: 15684 - protein, 328 aa, Prochlorococcus marinus str. MIT 9301
MAKIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGEIDVLVAGVGTGGTITGVSRYIKQEKGKNITSVAVEPSHSPVITQTMNGEEVKSGPHKIQGIGAGFIPKNLDLSIVDKVEQVTNDESIEMALRLAKEEGLLVGISCGAAAAAAVRLAEQDEYAGKTIVVVLPDLAERYLSSIMFTEVPSGIIQEPVKA

SEQ ID NO: 15685 - protein, 485 aa, Vitis vinifera
MFVSGAESGHENSAIPGTVLIPTRFVWPYGGRRVLLSGSFTRWSEHIPMSPIEGCPTVFQVIWSLAPGYHQYKFFVDGEWRHDEHQPFVSGNYGVVNTIFLPREPDVVPAVFSPDTPGGSNMDLDNDPFPRGCYIEVIPRISEADLEVSRHRVSEFLSTHIAYELLPESGKVIALDVNLPVKQAFHTLYEQGIPVAPLWDFCKGQFVGVLSALDFILILRELGNHGSNLTEEELETHTISAWKEGKLHLRQIDGSGRLCPRHLVHAGPYDSLKDVTLKILQNKVATVPIIHSASQDGSFPQLLHLASLSGILKCICRHFRHSSSSLPILQQPICSIPVGTWVPKIGESNGQPFAMLRPNASLGAALSLLVQAEVSSIPIVDDNDSLLDIYSRSDITALAKDRAYAQIHLDNMSIHQALQLGQDANSPYGFISGQRCQMCLRSDPLHKVMERLANPGVRRLVIVEAGSKRVEGVISLSDVFRFLLG

SEQ ID NO: 15686 - protein, 400 aa, Pseudomonas sp. ADP
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVSVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRVEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 15687 - protein, 629 aa, Nostoc sp. PCC 7120
MEASFEVTLQMAIAVFAGIGAQVLAAYLRVPSIVILLLLGILLGGDGVGLLHPQLLGTGLEVIVALATAIILFEGGLNLDLRELGRVSLSLQRLVTLGTLITLIGGSMAAHWLGEFPWNIAFLYASIVVVTGPTVISPLLKQINVDRQVATLLEGEGVLIDPVGAILAFVVLDTIVNGDADPVKAIIGLIMRLGIGAAIGAAGGYFMSLIFKRANFLSSELKNLVVLAVLWSLFTLAQMIRSESGVMTTVIAGAVFANSSVPEERSLRSFKGQLTILSVSVLFILLAADLSIASVFALGWGSLFTVLVLMFVVRPVNILFCTWNSNLNWRQKLFLSWVAPRGIVSASVAPLFAILLTQRGVNGGDSIKALVFLTIIMTVVCQGLTAGWVAKFLGITSQEATGAVIVGCNPLSLLIARFFQERGENVVLIDTDPDYIAQAETQNLRVIASSALDGEVLEEAGLASMGTFLAMTSNGEVNFVLAERAAEEFNPPRVLAVFPRDPQANGSANNKVQQAFVSDLPIKTWNEYLNDGRVKLGTTTLSESEFASQQEHIQEKIRNGVLVPLLVEREERLQIIPANQEWEVGDRIIYLLHDPRPNLLKRLSGASQSTPLVLETLPEVEEVPLAKVL

SEQ ID NO: 15688 - protein, 431 aa, Haloarcula marismortui ATCC 43049
MGPELSSASSSDNSSTPSEPESALETARLQLHRAADHLDIDPNIVERLNHPQNVHEVTVPIERDDGTVEVFTGYRAQHDSVRGPYKGGLRYHPDVTRDECVGLGIWMTWKCAVMDLPFGGAKGGIAVNPKTLSRDEKERLTRRFAQELRAVIGPNRDIPAPDMGTDPQTMAWLMDAYSMQEGETIPGVVTGKPPIVGGSEGREDAPGRSVAIITQQVCEYYDQPLSETTVAVQGYGSVGANAARLLDEQGATVVAISDVNGAMYDPAGIDTATVPSHDEEPEAVTEYADTVISNDELLTLDVDVLIPAALGNVITEANADDIAAEYVVEGANGPTTSTADSILADRDVVVIPDILANAGGVTVSYFEWLQDINRRSWSLERVNDELDEEMRAAWDAVRTEFENRDITWRDAAYIVALSRIAEAHEARGLWP

SEQ ID NO: 15689 - protein, 507 aa, Streptomyces coelicolor A3(2)
MTRYAAPGTEGAIVSYQSRYDHFIGGEYVPPARGQYFENPSPVNGLPFTEIARGTADDVERALDAAHEAAPGWGRTSVTERSDILLKIADRMEANLERLAVAESWENGKPVRETLAADIPLAIDHFRYFAGAVRAQEGSLGEIDDDTVAYHFHEPLGVVAQIIPWNFPILMATWKLAPALAAGNAVVLKPAEQTPASIHYWLSLVADLLPPGVLNVVNGFGVEAGKPLASSPRVAKVAFTGETTTGRLIMQYASENIKPVTLELGGKSPNIFFEDVWARDDDFRDKALEGFTMFALNQGEVCTCPSRALVQRGVYAEFMEAAVARTELIKPGHPLDTDTMIGAQASNDQLEKILSYLDIGRQEGAKVLTGGERIEHDGELKGGYYVQPTIFEGHNRMRIFQEEIFGPVVSVTSFDDFDDAVKTANDTLYGLGAGVWTRDMNTAYRAGRAIQAGRVWTNCYHAYPAHAAFGGYKQSGIGRENHKMMLEHYQQTKNILCSYSPKKLGFF

SEQ ID NO: 15690 - protein, 402 aa, Haloarcula marismortui ATCC 43049
MSITKRLKAVGPGAMVAAAFIGPGTVTTASVTGAEFGYALLWTMVFSIVATIVLQEMSARLGLVSGEGLGEALRERFDNQIVEYVSIFLVVGAIGVGTAAYEAGNILGGAAGLATITGIDSTVWGVVMGLVAGLLLYTGRYKLIERALIGLVAVMAFSFVASAILIGPDPGAIAMGFVPGIPSGSLYLITGLIGTTIVGYNLFLHASNVQERWSGPDDIGHSRIDTVLSIVAGGVITITIMVTAAAAFEPGTQISDIGRMAEQLRPIAGPYAELFFSIGIFAAGFTSATTAPLAGAWATTGALGWDSDMQSTQFRAVWGTILSVGVLSVLLGGSPVQIIVFAQVVNGILLPIVAVFLIYAMNQRDLLGEYTNGSIANALGAIVTLIVVWLGVRTLLSVAGVL

SEQ ID NO: 15691 - protein, 468 aa, Salmonella typhimurium LT2
MIHGPLELILNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTIRIEPPLTLTIELCEQVLKSARNALAAMQVSVEEV

SEQ ID NO: 15692 - protein, 218 aa, Saccharomyces cerevisiae
MSSSKRRIETDVMKLLMSDHQVDLINDSMQEFHVKFLGPKDTPYENGVWRLHVELPDNYPYKSPSIGFVNKIFHPNIDIASGSICLDVINSTWSPLYDLINIVEWMIPGLLKEPNGSDPLNNEAATLQLRDKKLYEEKIKEYIDKYATKEKYQQMFGGDNDSDDSDSGGDLQEEDSDSDEDMDGTGVSSGDDSVDELSEDLSDIDVSDDDDYDEVANQ

SEQ ID NO: 15693 - protein, 247 aa, Oryza sativa
HENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKPEDVYGEQAYQRDAMELLSSDQCSE

SEQ ID NO: 15694 - protein, 340 aa, Yarrowia lipolytica CLIB122
MESVPASIETYKTLKPSKTLRYHHNDPITSLDFDDTGAYAVTAGTDESIQLYSAHKGTHQRSSYSKKYGAHLARFTHNSMSIVYASTKEDDTIRYLSLHDNSYIRYFRGHKDKVHALNVSPISDVLLSASMDHTVRLWDLRSPHCQGVLNLVSPNLIAFDPRGLCFGVANTSAQDLSLYSVSAWGSDPFATFALPAPPGDGWASVEFSNDGKYILLATYGEQHHVIDAFTGNLTHKLVGHHPLRRDQDNMRGGSTHTAFSVDGRTVFGCSRDGKIIVWDLQDRVDERGRLYPSKALNCAPNAASPQILGVNPASMQLATADKELTFWLPEKDVAEPPKEA

SEQ ID NO: 15695 - protein, 526 aa, Aspergillus nidulans FGSC A4
MADTQIPVNGTYHSQPGYPDSYNHAHTAVNSVSNFQPAQSSTPSNAPSNDQKNGISKDEVGWYFVEQYYTNMSRSPDKLHLFYSRRSQLVFGTEAESVPVAVGQKAIQEKFKQLDFQDCKVRVLNVDAQASFENILISVIGEISNKQEPSRKFVQTFVLAEQPNGYYVLNDVFRYLVDEEEVAEDAAISSDTVEEPELQAPAQTAAGPITETEESKVDTEEAAAKIDEKLEKAEEAESEAPAAETAPQTNGTEQPEPAAEVVETPAPAAEVVPEKPASPEPSPAPPAEKEAPTKEPAPPAKAVPKTWASIASKTGAAAPVVPAIPVAPVKPAPAAAPASQPAAPAPAPASAAAAAPAAESGPSQPSSNDGSGWQTAGHDHKKSQARASDNQAVLGYIKNVTEKVNADLLKETLERYGKLTHFDVSRQKNCAFIEFADRAGYNAAVAANPHQIGTEQVKVEERRPRGSVYGGNTNYGPGRGGAGRGRGDRAGSQGRGGFQRDGRGGFAPRGRGGNANTKARNQGQAA

SEQ ID NO: 15696 - protein, 389 aa, Enterococcus faecalis V583
MSTKDVKELAIEQAKKFGGKLEVCPKVPIETKADLGIAYTPGVAAVSSAIHEKKERAYELTTKKNTVAVISDGSAVLGLGNIGPEAAMPVMEGKAALFKRFAGVDSIPLVLDTQDTEEIIQTVKFLAPTFGGINLEDISAPRCFEIEQRLIDELDIPVFHDDQHGTAIVVLAALYNSLKLINKKIEDIHVVINGGGSAGLSITRKFLAAGVKHIIIVDRAGILSETDTALPPHHAEIAKLTNREHRTGDLATALEGADVFVGVSAPGVLKPEWIQQMNEQPVIFAMANPVPEIFPDEALAAGAYIVGTGRSDFPNQINNVLAFPGIFRGALDARAKKITIEMQIAAAKGIAKLIPDNELTPTNIIPDPFQEGVAKVVAESVRNAVKETN

SEQ ID NO: 15697 - protein, 763 aa, Oryza sativa
MAILSALGTEVFIPVAAAVGVAFAVAQWLLVARVKVNPAHAAAAAAKNGGYGDYLIEEEEGLNDHNVVVKCHEIQTAISEGATSFLFTEYQYVGIFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGAQKEVTNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 15698 - protein, 974 aa, Candida glabrata CBS 138
MSLRPTVSKDKSRPVLVKRVFSVDDDANEVQNDIRYFENLADGVKIVLPGSENNIQDSAALSTGGNVAVPVPQGLRDEALVPVDSLRSLSTPDLMESITNLQQKLVTPRINGVAAHGNVGSPRFIIHDHTHTHPGDKKSATHHDLYIEELPAQRSNSSQALPAGSVAGGNGTSSLTDIPPVDLEASNLGETERLDPDNASRASSIESYTLRERQDAINETHPFGIRIWKPALYKKKRSVEKAADEDIHETKLKKITWAVKATNWIWVATCGLFLFTVFASASITVLIAGLFTKSARDYSRLMLRLARYLLYPFGKVVYLIQDKQYLEEDRDEGISVQQFYNWVTSYKSRLFFHESQTRPTESDALGNNMHHTSYGSIQKVVGEQTNTESNNPMLDNNGYTELPHSTSFQNPSNDHQNSAATQRRLFGRGKWSLGRIVFYAIFHIVLQPIVLFLSLLTWLAVFTIPMSNILWNLMYHCRRHPLALGFKSIKNSSNQIIEHYDDKNILLCTFRCAGWHYYKFTIDGTNVIVVNLIAMVFFTIFDFYALKEFFNIDLWITSESTVFILCLASIIPLAFYIGQAVASISAQTSMGLGAVINAFFSTIVEIFLYCVALQQKKGLLVEGSMIGSILGAVLLLPGLSMCGGALNRKTQRYNPRSAGVSSALLIFSMIVMFVPTLLYMMYSGYDVICDDLDATLPLDLYSAYKVMSTSKCHFSHPPLKFDKLYTHVIEPMSIVCAFVLFLAYTIGLWFTLRTHAATIWQLPIADPPREIVNTEANGIDGILSHEEDHNDEGGGHDAPNWSRSKSTLILLLATLLYAIIAEILVSCVDSVLEDFPSLSPKFLGLTIFALVPNTTEFLNAISFAMHGNIALSMEIGSAYALQVCLLQIPALVLFSVITAIGVDKALISIRDQMFPLVFPTWDLVASMASIFVFTYLYAEGKSNYFKGSILILLYVIIIMGFYYQGLIAEWGIIT

SEQ ID NO: 15699 - protein, 137 aa, Zea mays
  misc_feature (39)..(39): Xaa can be any naturally occurring amino acid
  misc_feature (45)..(45): Xaa can be any naturally occurring amino acid
  misc_feature (68)..(68): Xaa can be any naturally occurring amino acid
  misc_feature (75)..(75): Xaa can be any naturally occurring amino acid
  misc_feature (77)..(77): Xaa can be any naturally occurring amino acid
  misc_feature (101)..(101): Xaa can be any naturally occurring amino acid
  misc_feature (116)..(116): Xaa can be any naturally occurring amino acid
MTNLCQTTVEIVQRVPTVGDDLIGTNLFMVSNSVYETTXPALVLXVNQIGSVTESVEADNMDKRSGWXVMAGHRXSXTHDTFIADLSGGLSTVHITMGAAXRSERMAKYNLLLRIXEELGDASVYAGAKFRSPVQPY

SEQ ID NO: 15700 - protein, 176 aa, Mycobacterium avium 104
MTNSPFQTATATLHTNRGDIKVALFGNHAPKTVANFVGLAQGTKEYSTQNASGGSSGPFYDGAVFHRVIRGFMIQGGDPTGTGRGGPGYKFADEFHPELQFDRPYLLAMANAGPGTNGSQFFITVDKTPHLNRRHTIFGEVVDPESQKVVDAISTTSTDGNDRPSEPVVIESITIS

SEQ ID NO: 15701 - protein, 141 aa, Bacillus licheniformis ATCC 14580
MTTISNAMSRQVATISSNQTVQEAAELMSRHNVGAIPVVDQGVLKGMITDRDITLRTTAEGQDGQTPVSNVMTTNVVSGNPNMSLEEASQLMAQSQIRRLPIVENNHLVGILALGDLAVNELSNESAGQALANISTPARTQ

SEQ ID NO: 15702 - protein, 148 aa, Triticum aestivum
  misc_feature (49)..(49): Xaa can be any naturally occurring amino acid
  misc_feature (67)..(67): Xaa can be any naturally occurring amino acid
  misc_feature (82)..(82): Xaa can be any naturally occurring amino acid
  misc_feature (116)..(116): Xaa can be any naturally occurring amino acid
  misc_feature (118)..(118): Xaa can be any naturally occurring amino acid
  misc_feature (122)..(122): Xaa can be any naturally occurring amino acid
MADAQRAGAGAARGGGFGSRGDRGGDRGRGRGRRGPRRGANKNEEKEWXPVTKLGRLVKEGKIKSMXEEIYLHSLPIKEYQXIVDYFLPKLKDEVMKIKPVQKANSCWVNRTPIQXAXVINXGGLPNAMSGLGIKTSKGSSHCVSGKL

SEQ ID NO: 15703 - protein, 531 aa, Coccidioides immitis RS
MLEELVTAVSPGQAVLIAFGLFATFLFILDLKIDWRIQKLGPQAPRVRTYLPLGADFIYRAMKAAGKQKDLEFWTKMTEVPKYTGPGRLSTFEVKFSCYSRSLFTIDPDNIKAVLTGQFADYGKGRRFHEEWRDFLGDSIFATDGELWSKSRQLIRPMFSRDRIVDTEIFEKHIHKLIPLLGGGANQDGSKVVDVGPLFFRFTLDAATDYLLGQSVDSLDNPKTTFAESFQYVLHRQSVIFRSGPLSPLLSRKLFHENLKKMDDFMQPFIEQVRALTPEELDHKLSKKDTFLHALARFTRDPTVLRDQLVAILLAGRDTTAATLSFCIFELSRHPAVVQRLRNEIETVCGNRKPTYSELKEMKYLNAVLNETMRLYPVVPFNVRHALVDTTLPRGGGSDGQSTIGVPADTRIVYSTMAMQRRRDLYPPPPVPGEKTLQPYFDPLLFHPERWLSGWQPKPWHFIPFNGGPRICLGQQFATIEMGYTVTRILQHYPEIIGVGAPKPGTDPKFKFDVTLSPGQRLDCVFVKKEE

SEQ ID NO: 15704 - protein, 382 aa, Vitis vinifera
MSFLSRRLYRAFSTSTAATAQATGNLESVFKDIYRERNLKRLVQKFKKSSELDRFRTKTGIYEETVRRLASAKRFRWIEEILEEQKKYKDISREGFAVRLITLYGKSGMFDHAFKVFDEMPDQKCERSVLSFNALLGACVNSKKFDKVEGFFSELPSKLSVEPDLVSYNIVINGLCDMGSMDSAVGMLDEMEKKSLEPDLITFNTLLNGCYTSGRFLDGEKIWGRMEKKNILPDIRSYNAKLVGLVSEKRMLEGIGLVEEMQTKGIKPDGYSFNALIKGFCNDGKVDEATNWYGKMRENDCLPDKLTFATLVPLYCEKGSFDQAFELCKEIFNRKCLVDEVLLQNAVDGLVKGGKVVEAKKLVQLGNSNSYRRYNLKIPTDK

SEQ ID NO: 15705 - protein, 105 aa, Triticum aestivum
PGAERLRCGYSKDAKEATPAAAVRRSCRARPLLAAASAAVSASAAAPALALVDERMSTEGTGLSLGLSNNLLGWFLLGVFGLIWSLYTVYSSALDDDDESGGLSL

SEQ ID NO: 15706 - protein, 418 aa, Pseudomonas sp. ADP
MLALRTVTYCTENEETPPWPKCARSPPFAATVPLSAPTTSKWKKPPARARRRRAPRRSSPSSAPSSPLAARPCACRSCPTTQRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVSVTDRGFINVDIQMRTNVPHIFGIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 15707 - protein, 315 aa, Oryza sativa
  misc_feature (96)..(96): Xaa can be any naturally occurring amino acid
HATATATATAASHSHLDRYGYDDVEPEDEVRPDFPCPYCYEDHDITSLCAHLEDEHPFESKVVACPVCSARISKDLLDHITLQHGYLFRISFLRCXKVSKFCIMFCELLFLYVSLMVYYLQRHHRLRRVAVPSNHALSLGGRDLQETYLKVLLGNSSRSSGTNAASSVTDSLLSSLVLNLSSSEAEDTAKFSALAVVENNWFKRTLPSKTWKASSDSNLSQEERERRRRRAAVRSSFVQHLLVSTLLMTSRRKKEQLRALESRVGLLSTHFWMNDEGKHLPNPEAVHPTGGWFLILSTLMMTRCGLASYLAWEQF

SEQ ID NO: 15708 - protein, 332 aa, Triticum aestivum
  misc_feature (5)..(5): Xaa can be any naturally occurring amino acid
  misc_feature (7)..(7): Xaa can be any naturally occurring amino acid
  misc_feature (16)..(16): Xaa can be any naturally occurring amino acid
  misc_feature (20)..(20): Xaa can be any naturally occurring amino acid
  misc_feature (32)..(33): Xaa can be any naturally occurring amino acid
  misc_feature (42)..(42): Xaa can be any naturally occurring amino acid
  misc_feature (113)..(113): Xaa can be any naturally occurring amino acid
  misc_feature (118)..(118): Xaa can be any naturally occurring amino acid
  misc_feature (129)..(129): Xaa can be any naturally occurring amino acid
HPNHXLXLQRCFKDEXFRLXLVQSIGEGVSSXXVEEFGREIXRDEIYQITVVDILMWAIEVDWRDFFPYLGWIPNKGFETGLHTTEFRRTSVMRALINEQKKRIARGEARVSXLDFLXLAENALTDDQXMMLVWEAVIEAADTTLVTTEWAMYELAKNPEKQDRLYQEIREVCGDETVTEDHVPRLPYLSAVFHETLRFHSPVPLVPPRFVHETTKLAGYDVPAGTEIVINLFGCNMNKKDWEEPEDWRPERFMDGRFEAADMYKTMAFGAGRRSCAGSLQATTISCAAIARFVQDFAWRLKEGDEDKVDTVQLTSYKLHPLYVYLSPRGRK

SEQ ID NO: 15709 - protein, 482 aa, Microcystis aeruginosa PCC 7806
MVATTETNVGKIVQIIGPVIDAEFPSGNLPRIYNALTVKGTNSAGQNLSVTCEVQQLLGDNQVRAVAMSTTDGLVRGMDIVDTGAAISVPVGKCTLGRIFNVLGEPVDEKGPVNVTETSPIHRPAPKLVDLEVTPTVFETGIKVIDLLTPYRQGGKIGLFGGAGVGKTVIMMELINNIAIQHGGVSVFGGVGERTREGNDLYNEMIESKVINADNPEDSKIALVYGQMNEPPGARMRVGLSALTMAEYFRDVNKQDVLLFVDNIFRFVQAGSEVSALLGRMPSAVGYQPTLGTDVGDLQERITSTKEGSITSIQAVYVPADDLTDPAPATTFAHLDGTTVLSRGLASKGIYPAVDPLGSTSTMLQADIVGDEHYGTARAVQSTLQRYKELQDIIAILGLDELSEEDRLTVDRARKIERFLSQPFFVAEVFTGSPGKYVTLADTIKGFQMILKGELDSLPEQAFYMVGSIDEAIAKGEKLKKG

SEQ ID NO: 15710 - protein, 548 aa, Pseudomonas sp. ADP
MTEITVNGMTCTSCATHVKDALEKIPGVNAAVVSYPESRAQVMADTAVSHNQLLAAIAALGYQGSIRVGDFKDEPKIRDALEGAGLHIAIIGSGGAAMAAALKAVEQGATVTLIERGTIGGTCVNIGCVPSKIMIRAAHIAHLRRESPFDGGIAATVPAIDRSKLLAQQQARVDELRHAKYEGILDGNPAITVLHGEARFKDDQSLVVRLNEGGEREVTFDRCLVATGASPAVPPIPGLKESPYWTSTEALVSDTIPARLAVIGSSVVALELAQAFARLGSQVTILARSTLFFREDPAIGEAVTAAFRAEGIEVLEHTQASQVAHVNGEFVLTTGHGELRADKLLVATGRAPNTRSLALDAAGVTVNAQGAIVIDQGMRTSNPNIYAAGDCTDQPQFVYVAAAAGTRAAINMTGGDAALNLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFNKDVKQLSCCAG

SEQ ID NO: 15711 - protein, 625 aa, Erythrobacter sp. NAP1
MESQAVVIAAVGALGVGAQWVAWRTGWPAIVLMLAAGFIAGPITGLIDPESAFGELLDPMISVGVALILFEGGLSLDLRELRHSGKAVWRLATIGVLVGWALGALAGFYIAGLVWPVAVLFGGILIVTGPTVVIPLLRQSNIQTRPNSILKWEGIVNDPTGALCAVIAYEYFRRINEFPDASLVDVVPPLIFAAILAGLIGYAAARMIAYLFPRGAIPEYLKVPVLFVVVIAVFVLTNLIEHEAGLVAVTVMGVTLANREVSSIRSIHPFKENVAVLLVSGIFILLASSLSLEDLAYLNPMESVGQRFILFLLALLFVVRPITVLVSLLGSDVPWNERIFVAWIAPRGIVLVAISGLFALRLGDLGIEGGQLLIGLSFAVVVVTVIAHGFTIEPVARLLNVKGSSRPGLLIVGSTPWTIALARQMSALDTPVMIVDQSWQRLGAARREGLPYYHGEILNEATEHNLDLSPFQVLVAATDNEAYNTLVCNEFAHEMGRDSVYQLGESADGDDKHALPLSLRGRALFESGYGVDEVNDKQKQGWVFKKTKLSEEFDFEDAQLKLSDTGTMLLLVRKSGTLRFFTHAARPEPRAGDTIVSFTPPQIRANPKEDTDPKATEVRPRPQAT

SEQ ID NO: 15712 - protein, 271 aa, Haemophilus somnus 129PT
MQHKLISFIGGGNMAQAIVLGLLKQGYPAHYIRVCDPNQSRRDLFIAQGTQVSSNNVEAIQDADVVLLAVKPQIMAEVCVPLSVVDFSDKLVISIAAGISTVRLTALLPSAKNIIRVMPNTPALVSAGMSGLFATPQVSVNLKQFAQDLLSAMGEICWLEQEQDMHAVTAGSGSSPAYFFLFMEAMQQALIEMNLDPKTARLLVQQSALGAAKMVIENPQIALSELRENVTSKGGTTASALVVFNEQNVTQIIKQAMLACVKRSQEMESLF

SEQ ID NO: 15713 - protein, 305 aa, Ashbya gossypii ATCC 10895
MAKAIEISTSESAFILEALRQNLRLDGRTFDQFRDVEIELGSEYGDVTITMGKTKIHCRISAQIAQPYEDRPFEGLFVISTEMSPMAGAQFENGNNTGEDEVLISRMIEKAVRRSSAMDLEGLCIIAGSKCWAIRADVHFLDCDGGFIDASCIAVMTGLLHFRKPDVSVQGEQVIVHPVDEREPVALGILHIPVCVTFSFYNPEDAEVNVKGDSADEIAIIDATLKEELLRDGVLTVTLNKNREVVQLSKAGGLPMDALSLMNCCHKAYTITEKITDQILAALKQDALQRDKYAAVLSAENPREA

SEQ ID NO: 15714 - protein, 178 aa, Erythrobacter sp. NAP1
MTPEALKALVRTVPDFPEPGIQFRDITTLIGHAEGLSASVEHLAAKACAGGAQKIAGMEARGFIFGAAVAAALGIGFVPIRKPGKLPIDTIGIDYALEYGTDRLEMDPQAVAAGERVVIVDDLIATGGTALAAAELIRMAGAVVEQALFVIDLPDLGGAEKLRGAKVAVEALMHFEGE

SEQ ID NO: 15715 - protein, 93 aa, Synechococcus sp. WH 8102
MASYKISIEGGSTFECADDVYILDAAEEAGVDLPYSCRAGACSTCAGKVLSGSVDQTDQSFLDDDQIGQGFALLCVSYPTSDCSIKANAEDDL

SEQ ID NO: 15716 - protein, 277 aa, Haloarcula marismortui ATCC 43049
MLGMGLTLQPADFQRLIKEPVDIGIGAVTQWLVMPAAAYGLYVLLDLPDAVGIGLILVGAAPGGTASNVMAYLGRGDVALSVAITTLTTLAAPIVMPAWVVFTLGEQINVTFAEMFQSIIQIVIIPVFLGFTIRYLLDRYSPKAAEIGTDVFPVISVAAIVAIVAGVVGANVDNILTAGLLVLVAVVTHNAIGLGSGYGVGRATGMSTDRVRTCAFEVGLQNSGLAVALATTLFEPAAALIPALFSVWHNITGPALASFFSWQDSGQKSVEAVPSDD

SEQ ID NO: 15717 - protein, 307 aa, Flavobacterium sp. K3-15/DSM ID92-509
MKFQNALETIGNTPVVKINNLFNSDHEIWIKLEKSNPGGSIKDRIALAMIEDAEAKGLLNKDSTIIEPTSGNTGIGLALVAAVKGYKLILVMPESMSIERRKIMEAYGAEFVLTPREKGMKGAIEKANELAEETPNSWIPRQFDNPANVKIHVETTAQEILQDFPEGLDYVITGVGTGGHITGIAKALKEKYPNLKVIAVEPELSPVLSGGSPAPHPLQGLGAGFVPSILDITLLDGVITVGKDEAYEYAINAAKKEGLFCGSFHRSRLSRYRKTFTGNTAWSKNSLPLITTPEKGIFLLRDSSKIL

SEQ ID NO: 15718 - protein, 528 aa, Hordeum vulgare subsp. vulgare
MMAGATSATAAAGAFAAAKARGPAAACPWLVAAGGRRRSGVVRCDAGGDAQAASKAASITALEQFKISADRYMKEKSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYRPLTEMYEAAADADVVFTSTASESLLFTKEHAEVLPPISLAMGGVRLFVDISVPRNVGACLSEVEHARVYNVDDLKEVVEANKEDRVRKAMEAQTIITQELKRFEAWRDSLETVPTIKKLRSYADRIRASELEKCLQKIGEDNLNKKMRRSIEELSTGIVNKLLHGPLQHLRCDGSDSRTLDETLENMHALNRMFSLDTEKAVLEQKIKAKVEKTQS

SEQ ID NO: 15719 - protein, 474 aa, Salmonella typhimurium LT2
MQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 15720 - protein, 458 aa, Aspergillus nidulans FGSC A4
MLSRSAISRNAPRALQNAASRRGMASAATPGLQYDVSEAAGVKIANREPAGVTGTLALVAKAGTRYQPFPAFSDALELFAFQSTLKRSALRITREVELLGGEFSSTHSRENVVLKTKFLANDLPYFVELLAEVASQTKYPSYELNEIIAKLLKLRQVAIANDPEAVAVDAVHGVAFHQGLGETITPSAHAPYEKNLSAEAIAEFAKNAYAKSNIALVGSGVSSAELSKWVGDFFKGLPNAGTTGRYQVKSDSASKYYGGEQRISTKAGNSVVIAFPGTSAFGTSSYKPAASVLAALLGGESSIKWSPGFSLLGQATQGFSQLRVSTKNHAYSDAGLLTVTLSGKADQVASAGKTVVDALKKAAAGEVPADDIKKATAFAKFQALESAQTLATGLEATGSALINGSKPYQIGEVAQSVDSVTEAQVKDLAKSLLSGKASVASVGDLSQLPYAADLGLTV

SEQ ID NO: 15721 - protein, 326 aa, Ashbya gossypii ATCC 10895
MSVNYEQVNVAPLVLLSVLDHYKRMNTPDNKRCVGVLLGDNSGSTIKVTNSFALPFEEDEKNPDVWFLDHNYIENMNDMCKKINAKEKMIGWYHSGPKLRSSDLKINGLFKKYTQGNSLLLIVDVKQQGVGLPTDAYMAIEEVKDDGSSTERTFVHLPTAIEAEEAEEIGVEHLLRDVRDQAAGNLSLRLTNQLKSLQGLQRKLRDIVAYLDKVNSGQLPANHIILGKLQDVFNLLPNLGSPDEEAPATKKDDVLASSNTLQKALTVKTNDELMVIYISNLMRAIIAFDNLIENKIKNKKLQEAKRDPEPEEATKEEIQQQESAKA

SEQ ID NO: 15722 - protein, 109 aa, Zea mays
  misc_feature (20)..(20): Xaa can be any naturally occurring amino acid
  misc_feature (42)..(42): Xaa can be any naturally occurring amino acid
SHGILQLYPFEVLYQRGSFXLFNLPTYRGLKARPNLNVGICXEHDGYPSSVTFFSNTALDYFSCSPFNFPIAMLASSHVLVLCASLLYSNLLFVHLFINNTTITYPYSS

SEQ ID NO: 15723 - protein, 260 aa, Erythrobacter sp. NAP1
MAHLFIFGLGYTAKRIKSKLEEQGWSVSATGSDGDIDFDDRGAVMNTIAKSSHVLSSVPPDRKAGADPVLEAYGKELRGRALYYLSSTGVYGDQQGAWVDEASPTGTGRRNARSDADAAWMEMGARVFRLPGIYGPGRSALDRVREGKARRIDLPGQVFSRVHVEDIASGVTASLTQDAPPGAYNLGDDLPASGNAVTEYACRLLGVEPPPMQTLEEANLSEMALGFYSENRRVANGKAKRVLGWELKYPTYVEGLSALL

SEQ ID NO: 15724 - protein, 325 aa, Citrullus lanatus
MADAKSTIAKDVTELIGNTPLVYLNRVVDGCVARVAAKLEMMEPCSSVKDRIGYSMISDAENKGLITPGESVLIEPTSGNTGIGLAFIAAAKGYRLIICMPASMSLERRTILRAFGAELVLTDPARGMKGAVQKAEEIKAKTPNSYILQQFENPANPKIHYETTGPEIWRGSGGKIDALVSGIGTGGTVTGAGKYLKEQNPNIKLYGVEPVESAILSGGKPGPHKIQGIGAGFIPGVLDVNLLDEVIQVSSEESIETAKLLALKEGLLVGISSGAAAAAAIRIAKRPENAGKLIVAVFPSFGERYLSTVLFESVKRETENMVFEP

SEQ ID NO: 15725 - protein, 389 aa, Candida glabrata CBS 138
MHNELLGRSVDTCSTENDYNGEQNLRILAVFIVMISSGLGAYFPILSSQYSFIRLPNWCFFVAKFFGSGVIIATAFIHLLQPAAEALTDDCLGGTFEDYPWAFGICLMSLFMLFLAEIVAHHFVDKKFNHSHAETDNANALPDIILKDIQISTDDLSEGMLNCAGHQDSLQDSKKIETGVSTNLKRVDDSGFEGQYEYKRESTDETWIDENTLTTGNSEHKFSADYVSKVFVLCVLEFGIIFHSVFVGLSLAVAGSEFKVLFIVITFHQMFEGLGLGTRIAETEWPPSKWYTPWIMAFAFTITSPIAIAIGIGVRHSWVPGSRKALIANGVFDSISSGILIYTGLIELMAHEFIFSNQFKGEHSLRNMLTAYFIMCCGAALMALLGRWA

SEQ ID NO: 15726 - protein, 419 aa, Dehalococcoides sp. VS
MYELSVLPSGLRVISHHMPASRSVTICVYIGVGSRYETDCEAGASHFIEHMVFRGSKKYPDSQLISSAIEGVGGILNAATDRESTLYYAKVGSDKFALALDVLSDMLVTPLFNPEDLEKERKVIYEEISMSLDNPSHRVGLLLDEILWPDHPLGRDIAGTRQSVAGLDKQKLQAFMHSHYNPANIVVAVAGDIKHKSAVAAISQAFSGLRGKNEIQSFAPYHYGNPCQIGVDKRDAEQINLMIAMPGMNRLDDCRYAFSILNTILGDGMSSRLFAHVRDNLGLAYSVQSGTEFLHDTGAFSIYAAVDPANLTACVEAILTELESAKTTITAEELTKAKEMSKGRIHLAMEDSRYMAKWIGSQELLCRRVNTHEDVIRLIDEVSLKAVMELAGEYFRKPEMRLALVGPVDKEAVAGLLKG

SEQ ID NO: 15727 - protein, 406 aa, Emericella nidulans
MAAELTSTKLNAENHLLLDQPLLRLPHELARRNLKSFQRIVEREKEYVLPALKEAAKASMSGNQTPEQTLATLDVMISRMQGLKRKMENLQQEEKKIHHQSRKRIQHLNQLYQIPSLTDVKYDQWSRVRLDRLVIDHMLRSGYSESAQRLARAKNIEELVDLNVFVQCQRIAESLRNGETKDALQWCNENKAALKKSQYNLEFELRLQQYIEMIRTRDRAKFVDAMVHARRYLAPYDETQSAEIRRAAGLLAFPPNTRAEPYKSMYASERWVYLSELFIRTHHELLSLPSRPLMHIALSAGLSALKTPACHSAYTSSSSNSHSTATSVCPICSTELNELARNLPYANHTKSSVENDPVVLPNGRVYGLHRLLDMSKKLSSLEAGKVRDPTTGEIFNESELKKVYIM

SEQ ID NO: 15728 - protein, 127 aa, Quercus suber
ASRKAACGITKKPKDLIENIDAADVDNELAVAEYVDEMYKFYKETEDLSQVHDYMIKQTDINPKMRSILVDWLIEVHRKFELTPETLYLTINIVDRFLSIMAVSRRELQLVGISSMLIASKYEEIWP

SEQ ID NO: 15729 - protein, 93 aa, Capsicum baccatum var. praetermissum
MAPAEMEKTTTFDEAEKVKLNANEADDEVEEGEIVEETDDTTSYLSKEIATKHPLEHSWTFWFDNPVAKSRQAAWGSSLRNVYTFSTVEDFWG

SEQ ID NO: 15730 - protein, 93 aa, Capsicum chinense
MATAEMEKTTTFDEAEKVKLNANEADDEVEEGEIVEETDDTTSYLSKEIAAKHPLEHSWTFWFDNPVAKSRQAAWGSSLRNVYTFSTVEDFWG

SEQ ID NO: 15731 - protein, 481 aa, Arabidopsis thaliana
MKKRGWRISLISQISDLLCLSRGSSSTLKTLTPFCFTLSRSPFHQSGGDDDASGLKNQLLRFRNDSGKVASVLERNKIQGAAFVELLRQLRPWPVLSQLVFDWRRNKALCDGLPMTADEYAKGITISGRLKNVDLALSLFHESANKTTSVYNALMGAYLCNGLSHHCEQLFLDFNSQQDGPSSSTPSVSTYNILISLYGRLIMVERMESVFLQLQQLNILPDSSTYNNLIAGYIYAWDWDKMEATFHSMKNGLVKPTLATYLLMLRGYANSGNLLRMEDMYQAVKRHVDRNEIKLIESMICAYYRSCHKDRIRKIKTLSKLIPKKSYKPWLYLLLMQVYAKDDNLHAMENFIDQAITKGLQIETDGIMRSIVASYFRCNAVDKLAKFVQRANSAGWKMSRSMFHGLMIMYGSQKRFKEMENVLSEMESFKISRSKKTLCILLRVYAATHGQEHKVNQVAGMMLKHGHDFQRPEASKRVMGK

SEQ ID NO: 15732 - protein, 719 aa, Salinibacter ruber DSM 13855
MPNALSVPTDLLTLTVDETGVATLALDAPDASVNKISWDTLNAFSDALDVVETHADLSGLVIASGKPDSFIVGADLAMLQTFEIPAEARRLSREAHALGERVRSLPVPTVAALHGPVMGGGLELALNCDYRVASTADATKMALPEVQLGLLPGGGGTQLLPRLVGVQQALRLMLTGKNTYPDKARRIGLVDALIHPPGLRHAARRAARELAAGTRTVERAEQSLGDRLLEGNPVSRRVIYRQARTRTERRTRGNYPAPPRIIDAVRTGMEEGLEAGLDTERQHFGELVFTPESQALVSIFFAKRDAETNPQPEQARPVDTVGVLGAGLMGSGIAQVSAQNGLDVVLTDQSLALAAEGKKAIWSAVTEQEDKGIINTFTRDQIVERVAPTADYAPLQAADVVIEAVPEDLSIKHAVLSEVETVVDADTVLASNTSALPISTIAEGVDDPSRVLGMHYFSPVPDIPLLEIVVTEETSDEALATAYAAGLAQDKTVIVVNDGPGFYTTRILALYMNEALLLFEAGAEIEAVDEAMMDAGFPMGPFELFDLVGLDVAAKITDVMGEALSPERVDISDRAGRLAEADLLGQKTNRGFYEYDADDDADDKDPQGVNDAVYRHRDASSRSTPPAGAIQDRLLLMMVNEAVRCLEDEVLRAPIDGDLGAVFGLGFPPFLGGPFRHADRAGAASIVDTLQRLADRHGPRFAPADRLQTHAAQDTTFHS

SEQ ID NO: 15733 - protein, 148 aa, Brassica napus
  misc_feature (142)..(142): Xaa can be any naturally occurring amino acid
MATSIESSDVEVGFAKLQGEDFEYYMQTYSIVLGRNSKKSTVDVDLSSLGGRMNISRNHARIFYDFTRRRFALEVLGKNGCLVEGVLHLPGNPAVKLDSQDLLQIGDKEFYFLLPVRSILGGPRHVVSGPVGPYNQYPGSGXGKRGGR

SEQ ID NO: 15734 - protein, 314 aa, Streptococcus pyogenes str. Manfredo
MDPNVITVTSYANIAIIKYWGKENQAKMIPSTSSISLTLENMFTTTSVSFLPDTATSDQFYINGVLQNDEEHTKISAIIDQFRQPGQAFVKMETQNNMPTAAGLSSSSSGLSALVKACNQLFNTQLDQKALAQKAKFASGSSSRSFFGPVAAWDKDSGAIYKVETDLKMAMIMLVLNAAKKPISSREGMKLCRDTSTTFDQWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 15735 - protein, 276 aa, Coprinopsis cinerea okayama7#130
MTLDSARFEPLIHQILSAPGTDLSTISAKRVRRQLLEIDSTLTPEYIKEHREELDTLISAVFEQVSAEQGANQEEEQDEETYSADESHTSRKRHHEDDGDEDHADDTSPPPKKAKKSAKGSQKLSDEELARKLSNEINGRTTRTGGKARGTKASKGGRVRKSAATVDSGGESDEDEAPKKKSKRRSGGGAGGAKGGFGKEFILSEPLSAVVQAEKMSRPQVVKQLWEYIKGNDLQNPKNKREIMCDASLKAVFNRDKIDMFAMNKVLGQHLHEPES

SEQ ID NO: 15736 - protein, 308 aa, Microcystis aeruginosa PCC 7806
MVATLKGRDVLRITDMSSQEISALLNLSAQLKAGNLNPSCKKVLGLLFYKASTRTRVSFTVAMYQLGGQVIDLNPSVTQVGRGEPLADTARVLDRYLDILAVRTFKQEDLEAFANYSRIPIINALTDLEHPCQILADLQTIQETFQTLRGINLTYVGDGNNVANSLLLGGALMGLNVRVASPANYQPDGEIVASAQAIGEKTGSKILITDDPVMAVKDSQVVYTDVWASMGQESLADARIPVFQPYQVNEQLMSHADKDAIILHCLPAHRGEEITDGAIEGVQSKVWEQAENRMHAQKALMVSLLGLI

SEQ ID NO: 15737 - protein, 357 aa, Bacillus clausii KSM-K16
MEPLELGVLYGDGIGYEIVSASVKIVSAAAAKSGLAIDWHVLPMGLDAIKQTGSSMPAETVQALDKLDGWLMGPHDSQSYPKQLQNVRNPSGELRHHFDLYANIRPAKSEPYVKGVVERADLVIYRENTEGFYVDRNMYKGIGEWMVTADVAVTAGVFTRKAIERIAHAAFRAARERRKKVSIVHKANVISLGSGLFLNVCKEVGHHYPDVSVDDYHIDAMCAHLVRRAAEFDVIVAENMFGDILSDLTGELVGSLGLAGSINASESKAMAQAAHGSAPDIAGLGLANPIGMIRSSAMLLGWIGKKHKSQLCSTVERRINQGVADTLVSGVCTKDLGGTASTQQFTDVVCEKIEEAE

SEQ ID NO: 15738 - protein, 194 aa, Campylobacter upsaliensis RM3195
MYIPYVIEKTSRGERSYDIYSRLLKDRIVMLSGEINDDVASSIVAQLLFLEAEDPQKDIYLYINSPGGVITSGFSIYDTMNYIKPDVCTICIGQAASMGAFLLSCGAKQKRFALPNSRIMIHQPLGGARGQATDIEIQAKEILRLKTILNEILAQNTNQKIARITKDTERDFFMSAIEAKEYGLIDKVLEKSFK

SEQ ID NO: 15739 - protein, 346 aa, Mycobacterium avium 104
MAAVTPVFVDVDTGVDDALALMYLFASPDADVVGIASTGGNVAVEQVCENNLGLLQLCGLTGIPVSKGSGQTLTGPMRLPSKVHGPRGLGYAELPPSDHRVTDHDSASAWVRAAHAHPGELIGVATGPLTNLALALRAEPALPTLLRRLVIMGGSYDHRGNTTAVAEWNISVDPEAAAEVLAGWGGADVVRERLPILCGLDLTRKVAMTPDHLTRLATAADSGTRPLSADDEPGTRSAAANPLIRVIEDAMRFYLEAYHDLGHGYQAHMHDPLAAAVALDPTLVATRPATVEIELTGTLTRAMTVTDWSGRREPNALIGIDVDSAAFFDRFIERVGPFARRVGGGR

SEQ ID NO: 15740 - protein, 93 aa, Capsicum chinense
MATAEMEKTTTFDEAEKVKLNANEADDEVEEGEIVEETDDTTSYLSKEIAAKHPLEHSWTFWFDNTVAKSRQAAWGSSLRNVYTFSTVEDFWG

SEQ ID NO: 15741 - protein, 505 aa, Coccidioides immitis RS
MSDNTHPAKRRRLDRRGFHSQDSSSDELGANSDVERRRASWLKQVRTTYQSPRPYKTTPRQTTNSDSESPDELAVDHHHTYWRRQSAMRRSILSTPRESSRSERHRTEDADDDDDDEGEESSEDTSEDENRAKEKAERPVRVRTPTPPPPPPPPKPERLNYKQKLVLKGHQRGVSAVQFSPDGSMIASCSADGTIRVWNSSTGKLIHTFEGHLGGISTLCWSPDGTFIASGSDDKSIRLWNVLTGKQHPTPFLGHHNYIYSIAFSPKGNMLVSGSYDEAVFLWDVRSAHVMRSLPAHSDPVAGIDFIRDGTLIASCASDGLIRIWDSATGQCLRTLVHEDNPPVMGVKFSPNGKYVLAWTLDGCIRLWNYVEGRCIKTYQGHKNEKYSISGGFGTYNAPGGPPIAFVFSGSEDGAVVCWDVVSKKILQRLEGHRDVVLGADACCVGGKRLIVSCGMDMTIRLWEEEEIVERDQEGQSVKADSEPREKSDNAAASEVDADGDTPMT

SEQ ID NO: 15742 - protein, 93 aa, Capsicum frutescens
MATAEIEKTTTFDEAEKVKLNANEADDEVEEGEIVEETDDTTSYLSKEIATKHPLEHSWTFWFDNPVEKSKQDAWGSSLRNVYTFSTVEDFWG

SEQ ID NO: 15743 - protein, 93 aa, Capsicum chacoense
MATAEMEKTTTFDETEKVKLNANEADDEVEEGEIVEETDDTTSYLSKEIATKHPLEHSWTFWFDNPVAKSRQAAWGSSLRNVYTFSTVEDFWG

SEQ ID NO: 15744 - protein, 410 aa, Magnaporthe grisea
MADHQTTKIDKSNHLLLDQTLLRLPYDLMRKNFRNAHFVVEHESKAITKLLKDTATGSLKGKHSSDDVLKNIDAMLAKAKGIKRKLQACSDEEARLYRQLGARIKHVGEVVSMETVDDVRYEQWSRTRLDRLIVDYMLRHGYNESACALADDRGIRDLVDIDTFIHMSRIQESLANRSVTEALAWCHENKKELRKIDSNFEFMLRFQQYIELVRSQTLPKVLEAITHARKYLIPFKETYPHEVNQAAGLLAYPPEQTSDSYSNLWGQERWEMLSTLFIETHHRLLSLPSFPLLHIALSSGLSALKTPACHTAGARDLADTPNSAPGNSLDSSMCPICSAELNELAENVPYAHHSKSHVEHDLVLLPNDRVYGKARLEEYARKSGLPHNCVKDLRTGEIYPASRMKKVFIT

SEQ ID NO: 15745 - protein, 537 aa, Solanum lycopersicum
MVFDFGTLVASLNRLSTSDHQSVVSINLFVALICACIIIGHLLEENRWMNESITALVIGLCTGVVILLISGGKNSHILVFSEDLFFIYLLPPIIFNAGFQVKKKSFFRNFSTIMLFGAVGTLISFIIISFGATSIFKKWNIGYLEIGDYLAIGAIFSATDSVCTLQVLSQDETPLLYSLVFGEGVVNDATSVVLFNAVQNFDLSHINTSKALELVGNFLYLFASSTILGVVAGLLSAYIIKKLYFGRHSTDREVAIVILMAYLSYMLAELFYLSAILTVFFSGIVMSHYTWHNVTESSRVTTKHAFATLSFIAEIFIFLYVGMDALDIEKWRFVSDSPQLSVQVSPILLGLVLVGRAAFVFPLSFLSNLMKKSPEERISFNQQIIIWWAGLMRGAVSVGLAYNQFTRGGHTQLRANAIMITSTITVVLFSTGVFGLMTKPLIRLLQPSPKHLTRMISSEPTTPKSFIVPLLESTQDSEADLGPNVPRPHSLRMLLSTPSHTVHRYWRKFDNAFMRPVFGGRGFVPFVPGSPTEPSGH

SEQ ID NO: 15746 - protein, 529 aa, Sclerotinia sclerotiorum
MLGAIASIGGFMFGYESGQISGFVQMSDFLDRFGENGELSAVRQGTIVAILCAGTLVGCLGSSYLCDTIGRRYTISSSAFFYIIGVIIEITSSTHWVQFAMGRFTAGLGIGALSTSVPMYQSESVPKNIRGAVVSSYQLLITLGIWTAYMINYGTHSAYTNSAQWRIPNGLSALWAIILGTAVLFMPESLALHTVSDVKMKARKNMALLNGVDPYSPLIDSEIQEIEQKLAAEREGGDHPWYEIFTGPRMLYRTLLGMVLQAGQQLTGANFFFYYGTTIFKSGGISDSYVTSIILGTVNVVATIGGLWIVKNCGRRKALMVGAAEMFVCMLIYSFVGHFKIQRQAQCSSPWAVLICFTCIYIVGSATTWGPLVWAIVGELYPARYRASCMALATASNWLFNFLISFFTTFITNDIDYYYGLVFAGSLFALFWIVYFFVIETKDRSLEEIDTMYVLHVNPRTSSTWDPKSLGAEGVKGVDTDGMFLTTGGKDIKKSEMAGRPMLEHDERRFPETAGGAASQEHKPEIMNA

SEQ ID NO: 15747 - protein, 131 aa, Brassica napus
  misc_feature (124)..(124): Xaa can be any naturally occurring amino acid
MVKGIRVYEHGGPEVLKWEDIEVGEPKDGEIRVKNKAIGLNFIDVYYRKGVYKPASMPFTPGMEAVGEVVAVGSGLTGRKIGDLVAYAGSPMGAYAEEQILPADKVVPVPSSMDPIVAASIMLXGMTAQFL

SEQ ID NO: 15748 - protein, 295 aa, Helianthus annuus
NLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHE

SEQ ID NO: 15749 - protein, 395 aa, Glycine max
MGSSVKLSRRALETEMPVMVQMQELQRGAKNALSLAQGVVYWQPPKQALEKVKELVSEPLISRYGNDEGIPELRAALVKKLRDENNLHKSSVMVTSGANQAFVNLVLTLCDPGDSVVMFAPYYFNAYMSFQMTGITNILVGPGSSDTLHPDADWLERILSENKPAPKLVTVVNPGNPSGTYIPEPLLKRISDLCKNAGSWLVVDNTYEYFMYDGLKHSCVEGNHIVNVFSFSKAYGMMGWRVGYIAYPSEVKDFAEQLLKVQDNIPICASILSQYLALYSLEVGPQWVLDQVKTLEKNREIVLEALSPLGEGSVKGGEGAIYLWAKLPDLDAHDDFDVVRWLANKHGVAVIPGKACGCPSNLRISFGGLTENDCRAAAERLKKGLEELVRDGLRE

SEQ ID NO: 15750 - protein, 499 aa, Pseudomonas sp. ADP
MAKMRKVTTVRGYGAFVGANHLEVEETTGTGQEKTGTKKVIAFKRAIIAAGSQAVRLPFMPNDPRVVDSTGALALSGVPKRMLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAATPRISSPGVIFHAATGIDAATVAPVQTTLQKRILRAMGGGRSGHRQDHPPASDAGREHRHGGGSGAWQLHGCAACAQVSPQPSYPDKARTGDGSGLVLCVPKQSPQNTVHLYSIHVSHFQAQALQPTPPRTHAAVPNGSRALRDLARVGQRGSVRRPGRPPHPQALRAQSVCQVS

SEQ ID NO: 15751 - protein, 639 aa, Haemophilus somnus 129PT
MILFTNLTLKRGNTLLLENTCATINPGQKVGLVGKNGCGKSSLFALLKKEMSAEEGDITFPNHWAMAWVNQETPALEISALDYVIKGDREYCKLQKALATATENNHGNDIARIHAQLDTIDAWTIQARAASLLHGLGFSQEDLTRTVKSFSGGWRMRLNLAQALLCRSDLLLLDEPTNHLDLDAVIWLERWLIQYQGTLILISHDRDFLDPIVNKIIHIEQHKLHEYSGNYSSFEVQRATKLAQQTALYRQQQQKINHLQKYIDRFKAKATKAKQAQSRVKALERMELIAPAYVDNPFTFKFREPLALPNPLVSIEKASAGYNNGESTVEILQKIKLNLVPGSRIGLLGKNGAGKSTLIKLLAGELTALSGHIQLAKGVQLGYFAQHQLDTLRSEENALWHMQKIAPQQTEQQLRDYLGSFAFHGDKVNQAVSSFSGGEKARLVLAIIVWQRPNLLLLDEPTNHLDLDMRQALTEALIDYQGSLIVVSHDRHLLRNTVEEFYLVHDKQVEEFTGDLEDYQKWLNEINSTPKHNEKIINNNENTGNHRKEQKRKEAELRQRSAPLRKEIADIERKMQIYQQKLQEIELLLSDTVLYQTENKAKLTALLNEQVQLKKALEDIEISWFTMQEALENLINNIE

SEQ ID NO: 15752 - protein, 139 aa, Zea mays
MFAETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRRE

SEQ ID NO: 15753 - protein, 280 aa, Bacillus subtilis
MDYEKERTERAERIRKGGAEKYHQSNREKGKLFVRERLSLLFDDDIELEDAFFAECMSDGLPADGVVTAIGKIGGQTVCVMANDSTVKAGSWGAKTVEKIIRIQEIAEKLNCPLIYLVDSAGARITDQINVFPGRRGAGRIFYNQVKLSGRIPQICLLFGPSAAGGAYIPAFCDIVVMVDGNASMYLGSPRMAEMVIGEKVSLEEMGGARMHCSISGCGDILAETEEEAIQLVRAYLSYFPANFQEKAPIHEKRPPKHFETPLADVIPQNQNAPFDMHEL

SEQ ID NO: 15754 - protein, 607 aa, Debaryomyces hansenii CBS767
MNQSSSDKYTLEGMPSEPPRPRQSLQLQVDGENVKPSQSVTFGDLDNQEKLRRFTISSQPSSVNLAHSKNPESLPSSRKTSLQGNPNITNSSRNSSTTSEIFQFFANNQTYAVKPQQQVSTSTTQGYITPSNQSSGVNSPVLETPPHLKRGYTFDESSHKPTRLSSPSPPPLSQANFASLQEFQQAPHPINITNNNSLPRGSCNIKKSTKTVVASPSGPPVPFQQYLTKSDDEKIHILLGCTGSVATIKVPMIVDKLFNIYGKSKISIQLVVTKSATHFLKGLKIHSDVKIWRDEDEWANYNEHNIATTTISTNNVSSSRKPKNPFDNLILHNELRKWADIFLIAPLSANTLAKITNGIADNLLTSIIRSWSPINTTMASTNVNKNSVNVKKPILVAPAMNTHMYIHPITAKQLLLLSSPEYGFGIEVLKPVEKVLVCGDIGMGGMREWLDIVDILRRRINSINYVSDGKRIIAKKDEDERDADEDDDEEEEGNDDDDDDDDDDDDDDDDDDDDDDDDDDDDDDDDDDENEEVDDGDDDNNGSVNGQSTTLKRTSDTDKVSKENDDMIFEIQDNDAKEAQRDATEKSSSNNYYIRTDKIPVETQNIV

SEQ ID NO: 15755 - protein, 341 aa, Synechococcus sp. WH 8102
MSGRFGVVGCGYVGSAVALHLRAQGYELMGTTTGPARLAELCDLVDHPRILRAGDSAADFSVIDDLDGVLIAMAPTTASYEEDQYRAVYAEAVPALVKALRERPRQRPLHVSYLSSAGVYGDQSGAVTTELSSPDLSNTTNELLVQAENAVLALNTPSIQTCVLRLGGIYGPGKDIPSFIRSASGQQVAKNGNHINAWVHLDDIVRGVEFALQRRLQGIYNLVDDLQLSRRELSNALCDDEGLPPVIWDNHDRPGARGVQRSCLQCTAAPDGFHAENPVDAGTGRRLLMRPLSCRKCGNPFARDWRHNPSPSNPFSECSAILALEQLEPRRAADRCVAGDP

SEQ ID NO: 15756 - protein, 767 aa, Oryza sativa Japonica Group
MGSACEAGTDEPSRDDVKGTGNGILENGHSHKPEEEEWRNGMGEDLPNGHSTPPEPQQTDEQKEHQVQIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVRYQSRKRLAEQRPRIRGQFVRQSGQEDQAGQDEDR

SEQ ID NO: 15757 - protein, 261 aa, Glycine max
MAKLFLKQAKQYADARPSYPPQLFQFIASKTPSHNLAWDVGTGSGQAAKSLAAIYKNVIATDASDKQLEFAAKLPNVRYQHTPSTMSTAELEQMVASKGTIDLVTIAQALHWFDRPTFYEQVKWVLKKPHGIIAAWCYYLPRVSDAFDTVFDQFYSTNVSPYWDPARKWVDDNYRSIDFPFEPVDGADHTGPFEFVTETMMDLDDFLTYIRSWSAYQTAKEKGVELLAEDVVEKFKLAWGEDAKKVVKFPIYLRIGRTGDS

SEQ ID NO: 15758 - protein, 526 aa, Aspergillus nidulans FGSC A4
MGLVSLVLDNVCERCSALSVWALSGLGLLSVIIIAVVLNVLRQILFKNPNEPPVVFHWFPFIGSTISYGIDPYKFFFNCRAQYGDIFTFVLLGKKTTVYLGTKGNDFILNGKLKDVCAEEVYSPLTTPVFGRHVVYDCPNAKLMEQKKFVKYGLTSDALRSYVQLITAEVEDFAQKSSVFQNAKGVFDVSRTIAEITIYTASRSLQGKEVRDKFDSTFAELYHDLDMGFAPINFMLPYAPLPHNRKRDAAQRKMAETYMEIIKERRKSGEKKDSEDMVWNLMSCVYKNGTPLSDEEIAHMMIALLMAGQHSSSSTLSWILLHLARHPEIVEELYQEQLKVLGSDMHMTYDDLQKLELHSKIIKETLRIHAPIHSIIRAVKSPMPVPGTSYVIPTSHNVLSSPGVTARSDEFFPNPLKWDPHRWDSNPIANSTEDEEKIDYGYGLVSKGTNSPYLPFGAGRHRCIGEQFAYVQLITVTAALVRLFKFDTVSESDKSSVPETDYSSLFSRPAGKCFVQYEKRNVTTKA

SEQ ID NO: 15759 - protein, 377 aa, Solanum tuberosum
MDSSNPKVITCKAAVVGKEGEMIKIEEIQVDPPKSNEVRIKMLFASLCHTDILASNGYPYSLFPRVLGHEGVGMIESVGENVTNLKEGDIVMPLYLGECKECPNCKSGKSNLCHKYHLTFSGLMLDDTSRISIHGGQVLYHSFSCSTWSEYIVINANYVIKVDPQKIPLQHASLLCCGFTTGYGATWREVHVEKGSTVAVLGLGVVGLGAIEGARSQGASKIIGVDINESKQGKGELFGMTDFINPKESMTSVSEMIKDVTEGLGVDYVFECTGIPSMLNEAIEASKLGIGTIVVIGAGHGLTREFNLVPLLCGRTLKGSIYGGIRLHSDLPAILHRCATKEIQLNELITHQISLTEINQSFELLKDPHCVKIIIKF

SEQ ID NO: 15760 - protein, 330 aa, Dehalococcoides sp. VS
MANEKNLYETLGVSKTASADEIKKAYRKLARKYHPDLNPGDKAAEETFKKINQAYEILNSPENRAKYDKYGDQWQYGEQFEKARASQQQTQGNPFGGYDFSFGSSEGGGFEDILSQMLGGRMGGRRSRSQPGQSIEQPVDISLEEAASGTSRLLSFQMQKPCETCGGSGVKDKKTCPTCQGTGINPGIERLEVKIPAGVNTDSKIRLAGKGGYGQVGGQRGDLYLRINVRPHEKFERKDDDLTVNVPVNLTTAMLGGEIFVPSLKGKLALKIPAETQNGRTFRLKGQGIPHLGKDGSGDLLAKVSIVLPEKLTDTERNLFEKLRQLRPDS

SEQ ID NO: 15761 - protein, 627 aa, Triticum aestivum
MGNTCVGPSIGKNGFFHSVSTVLWTRRPDGEALPAANADANGGVADRAPPPDAPLAGHIVSKAPEPVKIASGAANAKPDEAAQPKPKAKPPVHPKPAPAKEQESKASTDSSSSSGSGSGGEAKPPHHRPKVPPVKRVSSAGLLVGSVLKRKTESVKEKYSLGRRLGQGQFGTTYLCVERSSGKEYACKSILKRKLVTDDDVEDVRREIQIMYHLAGHPNVISIRGAYEDAVAVHLVMELCAGGELFDRIVQKGHYTERKAAELARVIVGVVEVCHSMGVMHRDLKPENFLFVDQTEEAALKTIDFGLSVFFRPGQIFTDVVGSPYYVAPEVLKKKYGPEADVWSAGVIIYILLCGVPPFWAENEQGIFEEVLHGKLDFESDPWPSISEGAKDLVRRMLLRDPKKRLTAHEVLRHPWVQVGGLAPDKPLDSAVLSRMKQFSAMNKLKKMALRVIAENLSEDEIAGLKEMFKMIDSDNSGQITYEELKVGLKKVGANLQESEIYALMQAADVDKSGTIDYGEFIAATLHLNKVEREDHLFAAFQYFDKDGSGYITPDELQLACEEFGLGSDDLSLDNMIREVDQDNDGRIDYNEFVAMMQKPALGLAKKAGAGLESSFSIGFREALRMA

SEQ ID NO: 15762 - protein, 103 aa, Triticum aestivum
KGLKLFQCPKDLAQEHYKDLKERPFFPNLIDYITSGPVVCMAWEGDGVVASARKLIGATNPLQAEPGTIRGDLAVQTGRNVVHGSDSPDNGKREIGKFCQWRI

SEQ ID NO: 15763 - protein, 395 aa, Nostoc sp. PCC 7120
MLKIPNVQKLFSAATFLVSITTIFCSQPALAASFKPTPLIIDDDGSQDGMTALAYMLANPKFDIQAITIAQGIARPQSFANNLERMLGRLDISGIPIGIGRSTPLAGNNTFPEPIRAGADTFWSPFVQLPNTAPLVITRPAAELIVEKVKRSLTPVAILATGPLTNIAEALRLDPTIINNIAVIEIMGGAVFVPGNLPVLPYPPFSTNTTAEFNIWADPLAAQEVFAAGGQGLKIQLTPLDATNQIAFSRADQQAWLATATPESKLAAEFLDFALTVIQSNNDPNPAWDLVAAINLSEPDFSVETSLYLEVDTTSDPGNTQGQTRAIPNLPPNVLVSLNPSFNNLPFQPGQVFSYLQIQSVPEPTLIPGILVLATVSAGMMTRRSQKKVNNKLRA

SEQ ID NO: 15764 - protein, 648 aa, Zea mays
MNSMDEINLLRQAQRQHQHHLMVRGIGEEIDLEIGPVDDPSFSGASLVAVTSTHDTVVHADDHKSLLIPCSQPGAADGLAPQQHLSQGEEHDGMLRSPSGHTKKKKKVVKKWREEWADTYKWAYVAVHDTTTRIFCSVCKEYGRKHRRNPYGNEGSRNMQMSALEEHNNSLLHKEALRLQMASKEKLQPPEIEGPVYVKALSKTAASILECVLRRDPHEAEYIQSIQEVVHSLEPVLVKNAQYIQILERLLEPERCFIFRVPWIDDRGEAHVNRGFRVQFSQALGPCRGGLRFHPSMSLSVAKFLAFEHTLKNALSLYKLGGAAGGSDFDPKGKSDNEIMRFCQSFMDELYRYLGPDQDFPAEDIGVGPREMGYLFGQYRRLSGHFQGNFTGPKIFWSGSSFRTEATGYGLVFFARLLLAEMNKELKGLRCVISGSGKIAMHVLEKLLPCGAIPITVSDSKGYLLDEDGFDYMKYSLLRDIKAQQKSLKEYLKTYPHAKYIDDAKPWSQQCDVAFPCASHNEIDQGEAVAISNSGCRVLVECSNMSCTVQAVDILRKAKVIVAPAKATAAGGVALGEIELNPEFNLMQLSVEDFENRIQDAIKQTYERSVKAAQDYGIMKESPDFLVHGANICAFLNIAQAMTDQGCV

SEQ ID NO: 15765 - protein, 530 aa, Blumeria graminis f. sp. hordei
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVFDCPNSKLMEQQKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15766 - protein, 521 aa, Rigidoporus microporus
MPSFASLKSLVVLSLTSLSLAATVALDLHILNANLDPDGTGARSAVTAEGTTIAPLITGNIDDRFQINVIDQLTDANMRRATSIHWHGFFQAGTTEMDGPAFVNQCPIIPNESFVYDFVVPGQAGTYWYHSHLSTQYCDGLRGAFVVYDPNDPHLSLYDVDDASTVITIADWYHSLSTVLFPNPNKAPPAPDTTLINGLGRNSANPSAGQLAVVSVQSGKRYRFRIVSTSCFPNYAFSIDGHRMTVIEVDGVSHQPLTVDSLTIFAGQRYSVVVEANQAVGNYWIRANPSNGRNGFTGGINSAIFRYQGAAVAEPTTSQNSGTALNEANLIPLINPGAPGNPVPGGADINLNLRIGRNATTADFTINGAPFIPPTVPVLLQILSGVTNPNDLLPGGAVISLPANQVIEISIPGGGNHPFHLHGHNFDVVRTPGSSVYNYVNPVRRDVVSIGGGGDNVTFRFVTDNPGPWFLHCHIDWHLEAGLAVVFAEDIPNIPIANAISPAWDDLCPKYNANNPDSGLA

SEQ ID NO: 15767 - protein, 371 aa, Cicer arietinum
MAGVNQNGVAEFVAVPTHGGQFVQYNVFGNLFEVTAKYRPPIMPIGRGAYGIVCSLLNTETNELVAVKKIANAFDNHMDAKRTLREIKLLRHLDHENVIGLRDVIPPPLRREFMMSTLPPNSWILIFIKSFAPIKICQMNTASTFCIKFFVGLRYIHSANIIHRGLKPSNLLLNANCDLKIIDFGLARPTMESDFMTEYVVTRWYRAPELLLNSSDYTSAIDVWSVGCIFMELMNKKPLFPGKDHVHQMRLLTELLGTPTDADIGLVKNEDARRYIRQLPQYPRQPLNRVFPHVHPLAIDLVDKMLTVDPTRRITVEEALAHPYLEKLHDVADEPVCTEPFSFEFEQQHLDEEQIKEMIYREALALNPEYA

SEQ ID NO: 15768 - protein, 101 aa, Capsicum annuum
MGLKKSNKHITQSVALKQILKRCSSFGKNENGLPHDVPKGHFVVYVGENRSRYIIPISWLTHPEFQSLLQRAEEEFGFNHDMGLTIPCDEEDFCSLMSIFR

SEQ ID NO: 15769 - protein, 217 aa, Shewanella sp. ANA-3
MNQSLLAPFGTAIERVEAGLEALRQGQGVLVVDDEDRENEGDLIFAAESLTNAQMAMLIRECSGIVCLCLPDEKVKALELPPMVENNSSQYGTAFTVSIEAKVGVTTGVSAADRVTTIKTAIADNAKPSDLARPGHVYPLRAQPGGVLTRRGHTEGTIDLMQLAGLKPAGVLCEVTNPDGTMARLPEIIAFGAEHNMPVLTIEDIVIYRKSLLANVG

SEQ ID NO: 15770 - protein, 360 aa, Oryza sativa Japonica Group
MVGNGEGRKGAGASVLVTGGAGYIGTHTVLRLLEKGFAVTVVDNFHNSVPEALDRVRLIAGAALSARLDFIAGDLKSKDDMEKVFAAKRYDAVIHFAGLKAVGESVAHPQMYYENNVAGTMNLYSAMTKYGCKKIVFSSSATAYGQPEKTPCVEDSKLSALNPYGTTKLVLENYFRQVQAADPEMRVILLRYFDPIGAHRSGDIGEDPRGIPNNLLPYIQQVAVGRRPELNVYGVDYPTRDGTAIRDYIHVVDLADGHIAALEKLFATPDIGCVAYNLGTGCGTTVLEVVKAFEEASGKKIPIKICPRRPGDCTEVYASTDKAKKELGWSARFGIEDMCRDQWNWAKKNPYGYSANAEQN

SEQ ID NO: 15771 - protein, 679 aa, Oryza sativa Japonica Group
MGLSSAIEWWEEWQLRILALSSMGIQVFLFFSAMMRKRAIPSWFRSIVWLAYLGSDATVIYAMASLFNRHKNQDYTNSFKVQGSYSLEVFWAPILLIHLGGQDVITAYNIEDNELWRRQVLTTVSQITVSVYVFYKSWWLDIIHSDLRMMQAAMQMFVFGVLKCIEKPWALRSASINMLVSSNSLITKIEKSNEEGDRIDISLESYVEEARKFVLNPSDVDGNRCHFKPYMLFVDLSLPYSLRLSILKTLWIRDDVHLLLQEELAHTFHRLYTKLRTLVPDHHVVWSTDWKNIPKSPRSIRSVLESISRILRILGLFFLFEASGIFLLSHKEVYKSNDIKVTYVLLCCTTMIEFLSLFGWVYTNIFRNNPPWSYKVSQCRLIGNYVGSSIKPCDSSGSIIVLVLQHVKSGWKDYITNVASYRMFNDNRGQWSLQRNNCDNEDLAWNVRAPFDESVLLWHLATDLCLLSEGYTNEGATRSIEISNYMMYLLLNNPDMLMAGTKRSLFTTAIHELKGIIGDETLEDIDLAHKIIAKMESSEGCPSFIHNACVLSKALLCLDNTKMWEVIEGVWVEMLCFSASRCRGYLHAKSLGNGGELLTFVWLLLLQMGMEPLAEKLQRAEIPKRGGNGAASAASLSSDKSLALQRKKTEVPSGDEGNIADVPSTSNDSIVIDIGDNAS

SEQ ID NO: 15772 - protein, 134 aa, Brassica napus
  misc_feature (119)..(119): Xaa can be any naturally occurring amino acid
  misc_feature (132)..(132): Xaa can be any naturally occurring amino acid
MQARRGQSSYRDRTDEFFGIVETLRRSTAPDAANNVPYGGGGGGRREDPRSAVANQSEFKKRAAVIGLAINQTSQKLSKLAQLAKRSSVFDDPTREIQELTAVIKQEISSLNSALIDLXAVRNSHNDERTIXRD

SEQ ID NO: 15773 - protein, 480 aa, Oryza sativa Japonica Group
MVKICCIGAGYVGGPTMAVIALKCPAIEVVVVDISKPRIDAWNSEQLPIYEPGLDEVVKECRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIDDLFKPDRVLIGGRETAEGRKAVQALKSVYAHWVPEDRIITTNLWSAELSKLAANAFLAQRISSVNAISALCEATGANVTEVAYAVGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCHGLLGDKAQISIYDPQVTEDQIQRDLAMGKFDWDHPMHLQPTSPTAFKQVSVVWDAYEATKNAHGLCILTEWDEFKTLDYQKIYDNMQKPAFVFDGRNVVDPEKLREIGFIVYSIGKPLDAWLKDMPAVA

SEQ ID NO: 15774 - protein, 184 aa, Physcomitrella patens subsp. patens
MDGGRPVGTDGYDFAYRMTIEDRYKRAAEGRVALRRLVSVQALLQILKATWACLGALNGDTPNIELVTSCAFGGAAVLLGTLGIKGGAKLLRFYILLTMIAVVLSLVPFASGNYIGKASQFAKHGCEFMWKDNWEYLQVTGDYQRILYLSLEGLLELIGILLQLVAVLTAFSFMKNVTHRKKRD

SEQ ID NO: 15775 - protein, 328 aa, Ashbya gossypii ATCC 10895
MMDKLDLDQLPYYDPRVERKVALVTGGNSGIGWYTVLHLYMHGFIVYVGGRNSSRVHKAIKEIKQEAENRLETARQDPHDELERCLGELRYLPIDLTDLRSVEKAAKKFRAQESTLDVLINNAGVMALPYELTHDGFEVQMQTNYVSHFLLTMRLLPYVKRSGGRVVTLSSIGHKIQFTYCPLDCHFDYRPNIFFTWLRYAMAKTAAIQFTKMLAIKHPDVMCIAVHPGLVMNTNLFSYWTRLPIVGIIFWIFFQIVGFCFGVSNEEGSIGTLKSALSPALTLERDNGKYFTTGGVESRPSSVANNLDNAASTWIWTVHQLRDRGYEI

SEQ ID NO: 15776 - protein, 213 aa, Bacillus clausii KSM-K16
MNHTNNMNRWIDVSQPLNEKLAHWPGDLPYSYQLTFSKQQTGSVNIGQMAMSVHSGTHVDAPFHFKNDGAKITDLDIHVFIGKARVVDLSKYEKIDKAALRSLHLEGVKRLLIKTAVPNQATAFPENIPYVTPDGAAYMKEKGIILIGVDVPSVDPLDSKELEGHHALADNGISILENLMLDKVKEGDYELIALPLPMEEADGSPVRAVIRAI

SEQ ID NO: 15777 - protein, 506 aa, Medicago sativa
MDLLLLEKTLLALFIAATIAVTISKLRGKRFKLPPGPIPVPIFGYWLQVGDDLNHRNLTDYAKRFGEIFLLRMGQRNLVVVSSPELAKEVLHTQCVEFGSRTRNVVFDIFTGKGQDMVFTVYGEHWRKMRRIMTVPFFTNKVVQQYRYGWESEAESVVNDVKNNAEASVGGIVIRKRLQLMMYNIMYRIMFDRRFESEEDPLFVKLKALNGERSRLAQSFEYNYGDFIPILRPFLKGYLKVCKEVKDRRLQLFKDYFVDERKKLESTKSTTSNDGLKCAIDHILDAQKKGEINDDNVLYIVENINVAAIETTLWSIEWGIAELVNHQDIQNKVREEMDRVLGPGHQVTEPDLHKLPYLQAVIKETLRLRMAIPLLVPHMNLHDPKLNGFDIPAESKILVNAWWLPNNPAHWKKPEEFRPERFLEEESHVEANGNDFRYLPFGVGRRSCPGIILALPILGITIGRLVQNVELLPPPGQSKIDTSEKGGQFSLHILKHSTIVAKPRSF

SEQ ID NO: 15778 - protein, 505 aa, Vigna radiata var. radiata
MDLLLLEKTLLGLFLAAVVAIVVSKLRGKRFKLPPGPLPVPIFGNWLQVGDDLNHRNLTQLAKRFGDIFLLRMGQRNLVVVSSPDLAKEVLHTQGVEFGSRTRNVVFDIFTGEGQDMVFTVYGEHWRKMRRIMTVPFFTNKVVQQYRHGWEAEAAAVVDDVRKNPDAAVSGLVIRRRLQLMMYNNMYRIMFDRRFESEEDPLFQRLKALNGERSRLAQSFEYNYGDFIPILRPFLKGYLKICKEVKETRLKLFKDYFVDERKNIGSTKSTNNEGLKCAIDHILDAEKKGEINEDNVLYIVENINVAAIETTLWSIEWGIAELVNHPEIQQKVRDEIDRVLGVGHQVTEPDIQKLPYLQAVVKETLRLRMAIPLLVPHMNLHDAKLGGYDIPAESKILVNAWWLANNPAHWKKPEEFRPERFFEEESHVEANGNDFRYLPFGVGRRSCPGIILALPILGITLGRLVQNFELLPPPGQSQIDTSEKGGQFSLHILKHSTVVAKPRSF

SEQ ID NO: 15779 - protein, 372 aa, Trichodesmium erythraeum IMS101
MLNAQTIISILLVFVPISIAANAMELGSSVIFITSAIAIIPLAGWMGTATEEIAVVLGPNLGGLLNATFGNATELIIGIIALNAGLVRVVKASITGSIIGNLLLVMGLSMFLGGLRFKEQKFQSVVARLNASAMNLAVIAILVPTAVNATSNGISSNTMQNLSVAVGIVLITVYILTLLFSMKTHSYLYEVGIVGSESQDLDSDSESEENAEHKPNLLLWILVLLIATLTVAFESELLVDSLEEATSALGLTALFTGVIVVPIIGNAAEHATAVTVAMKNKMDLSVSVAVGSSLQIALFVAPVLILTGSLLGQPMDLNFNPFELVAVVVAVLIANSVSSDGRSDWLEGVLLLAAYTILGLAFYFHPVIKGLS

SEQ ID NO: 15780 - protein, 497 aa, Wolbachia endosymbiont of Drosophila ananassae
MGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKDQHLLVFWDFLRNVGSIIVNNVPGVNRVVYDITSKPPATIEWE

SEQ ID NO: 15781 - protein, 78 aa, Escherichia coli O157:H7 EDL933
MSTIEERVKKIIGEQLGVKQEEVTNNASFVEDLGADSLDTVELVMALEEEFDTEIPDEEAEKITTVQAAIDYINGHQA

SEQ ID NO: 15782 - protein, 199 aa, Triticum aestivum
DILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEETLAEGASESLHVKDYKY

SEQ ID NO: 15783 - protein, 405 aa, Phaeosphaeria nodorum
MAELTSMKLNAESHLLLDQPLLRMPYELSRRNFKNAQRVIEHSSANMTTSLAAATKAASKSASPDATLDSLDAMISKMQVLKRKLEGLHEEETRIHKSAKARLRHLQDLYDVNSLVDVKYDEWSRTRLSRLLVDYLLREGYSESAAHLAQSKEIEDLVDVDAFIACHKIERSLREGMSTSLALDWCKEHSKELKKGGSMLEFELRLQQYIELVRQGGETKLVEARVHAKKYLSTSGDFELLRKAAGLLAYKPWDDVEPYVSLYSPSRWAHLANLFLSTHHNLYSLPPRPLLHIALSAGLSALKTPACHSAYTSSSANASSATTSVCPICSTELNELARNVPYAHHTKSIVKNDPVVLPNGRIYGRDQLTAFNKKVGTESGWVRDPVDGIKGEAWSESEVRKVYIM

SEQ ID NO: 15784 - protein, 426 aa, Desulfotalea psychrophila LSv54
MFEKQVFLFGVNHKTTPVAVREKIAFTDGYETALTRLQEEVGCDESYLLSTCNRVEILVYADSTRDIEAEVSRFLFAGKVPEEDCRDYLYALKGLPAVQHLFTVAASLDSMVVGEAQILGQLKTAYRHASALGCTGPLLNRLLHKSFSVAKRVRTETAIGASAVSISYAAVQLARKIFGNLDTKKVMLVGAGEMAELAAEHLVGQGVSSVVVANRTLTRAVELADKFGGTAICMEELYAQLEDVDIIISSTGAQHIIIESAEVRPIMRVRRNRPLFFIDIAVPRDLDPELNELENVYLYDIDDLSNVVEVNKSGRDHEAIKAGCIVEEETRKFDEWYQGLAVKPTVLALREKMSGIIEQELRKTLPRLHDLGEHDQRSIEKMVASISSKFLHDPLHYLKSDSCHGRDKSQAKVDTLRSVFSLKGDI

SEQ ID NO: 15785 - protein, 99 aa, Candida glabrata CBS 138
MSNIPVKLLSEAQGHVVTIELNNGDTYRGKLVESEDNMNVQLRDVMVTSSTQKLSRMDHVFVRGSHIRFFVVPDMLKNAPLFKKNQSRQPPPVRGPRRR

SEQ ID NO: 15786 - protein, 260 aa, Brassica napus
  misc_feature (90)..(90): Xaa can be any naturally occurring amino acid
MGSASNPLVTSSVVDDSPLPSNLTQDDLKKLAAYKAVEYVKSGMVVGLGTGSTAKHAVARISELLRQGKLRDIIGIPTSTTTHEQAVSLXGIPLSDLDSHPVVDLSIDGADEVDPALNLVKGRGGSLLREKMVEGASKKFVVIVDESKLVKHIGGSGLAVPVEVVPFCCDFTRGKLEELFREAGCKAKLRVKSGGEAAAVTDNGNYVVDLYLERDMGDLEAASEKILRLPGVVEHGMFLGIATTLIVAGKSGVTVKDRFG

SEQ ID NO: 15787 - protein, 235 aa, Oryza sativa
MAGGGDELKLLATWFSPFASRVKFVFHLKGLSYENIEEDLKNKSELLLKSNPAIKKVPVLLHNGKPLCESMVIVEYLDETFAAVGPSVVPADPYERAVARFWVSYIDNKLVAPWFQVFRGKSMEEKAEGLKQIFVAAAVLEVAFRECSKGRPFFGGDAAGIVDVALGSQLGWLRASQALSGIKLFDPAKTPLLPAWAERFLALDAAKASMPESGRLLAYAKMRQAESDAANAAAN

SEQ ID NO: 15788 - protein, 530 aa, Blumeria graminis f. sp. hordei
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVFDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15789 - protein, 403 aa, Halobacillus aidingensis
MHGFHDVFIQILLLLAISVTVIAIAKLLKEPDSVALVLVGLVLGLTQLPFIEEAESYITQSEVFQATVISLFLPILLGDATLKLPFHHLFSQKKTVMGLAFLGTFISSLTIGAASYFLLDLPLAVAFTFAALMSATDPISVLSIFKSLGVKQKMSTIMEGESLFNDGIAVVLFKIASIYLLTYIEMGWAGLGSGVFMFLKFAVGGALVGLILGYVFSQVIRVYDDYPLEVAFSALLFFGSYFIAEHFHTSGVIAVVVGGFVFGDYGAKIGMSEETKTNLNTFWDSVTLLANALIFLMVGLEIRNIDLAGNWGYIVGAIAIVLVGRTIAVYIGTGWIKELSSKERILINWGGLRGSLSIALALSLPMDFDGREQVLLLTFSVVLFSLIVQGLTLKPVIKKLGLA

SEQ ID NO: 15790 - protein, 530 aa, Blumeria graminis f. sp. hordei
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVYDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15791 - protein, 530 aa, Blumeria graminis f. sp. tritici
MGIPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVFDCPNSKLMEQKKFMKAALTTEAFRSYVPIIQNEVESFIKKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15792 - protein, 530 aa, Blumeria graminis f. sp. tritici
MGIPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVYDCPNSKLMEQKKFMKAALTTEAFRSYVPIIQNEVESFINKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15793 - protein, 530 aa, Blumeria graminis f. sp. tritici
MGKPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVYDCPNSKLMEQKKFMKAALTTEAFRSYVPIIQNEVESFINKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15794 - protein, 330 aa, Microcystis aeruginosa PCC 7806
MSYSATLMRHPMFPAASDSNRLRLFSGSANVPLAQEVARYLGMDVGPMIRKRFADGELYIQIQESIRGCDVYLIQPCCNPVNDHLMELLIMIDACRRASARQITAVIPYYGYARADRKTAGRESIAAKLVANLITEAGASRVLAMDLHSSQIQGYFDIPFDHVYGSPVVVDYLLSKKLPDIVVVSPDVGGVARARAFAKKLNDAPLAIIDKRRQTHNVAEVMNLIGDVKDKTAVLVDDMIDTAGTIAQGAQLLKAKGARQVYACATHPVFSGPAIERLSSGIVEEVIVTNTIPVPQDHFFPQLKVLPVAPILGEAIWRIHEDNSVSNMFK

SEQ ID NO: 15795 - protein, 336 aa, Nostoc sp. PCC 7120
MHTRDRQRLTMQIHQELSLPGMGCGTWAWGNQLLWGYNESMDAQLQAVFNLCVSNGVTLFDTGDSYGTGRLNGRSELLLGKFSQEYQGVNQENICIATKLAAYPWRWTRQSMINACKSSAQRLGRNVDLVQMHWSTANYAPWQEVGLLDGLADLYEQGLVKGVGLSNYGTKRLQRVHQKFAERGVPIKTLQVQYSLLSTYPVTELGLKDVCDELGIKLIAYSPLALGILTGKYSEKGPFPRGVRGLLLRQLLPGVRSLLQCLQDVAQSRNKTMSQVALNWCIAKGTMPIPGARSVKQAQENIGALGWQLNSGEIAELDKAAASSDKKMVQNIFQTK

SEQ ID NO: 15796 - protein, 591 aa, Oryza sativa
MDQYEVLEQIGKGAFGSALLVRHKLEKKKYVLKKIRLARQTDRTRRSAHQEMQLIATVRNPFIVEYKDSWVEKGCYVCIVIGYCEGGDMAEAIKRANGTYFSEEKLCKWLVQLLMALDYLHANHILHRDVKCSNIFIARDQSIRLGDFGLAKILTSDDLASSVVGTPSYMCPELLADIPYGTKSDIWSLGCCIYEMTALRPAFKVFDMQALINKITKSIVSPLPTKYSGAFRGLIKSMLRKSPEHRPSAAQLLKHPQLQPYVLQVQLKSSPTRNILPIHQSLTDKVKKMTFPSDVVDSARRRMARRNSLGNERTVTFSKPSPERNSVSSTRSIKEYTTTQSVKGLSVDSSEAGDEVTSKAIITKTSSILRTPKSLPAKTYTARNQLEPPKTSYNRTYRSELPSKTTPNKIARPARRASLPLSTYETPTKRSISILEQLDSPDVSVNAPRIDRIAEFPLASSEDPLLPIHNKLSPGHGSCSTPPFINRSITKDKCTIQVLRTDGDNGSDSSGRNATAASSRGSNDSRQQRFDTSSFQQRAEALEGLLEFSAQLLQQERYEELGILLKPFGPEKASPRETAIWLTKSFKETAS

SEQ ID NO: 15797 - protein, 239 aa, Mycobacterium sp. JLS
MELDKQIALVTGGTSGIGLASARLLAAEGAEVVVSGRDAERGAQAVAEIGGAVRFVQADMSDPQSVKDLAEQAGDVDILVNNAGVFPAAPTLDQDLASFETMFDTNVRGAYFLVAEVARGMVARGRGAIVNITSPAGDKGFPGTSAYGATKAALASLTRTWAAEFGANGVRVNSVSPGPTRTPGTADMGDFIDDVAGALPLGRTARPEEVAQAVLFLTSPRSSFVTGSTLYVDGGGSAV

SEQ ID NO: 15798 - protein, 202 aa, Capsicum annuum
MASTPAIFLATLVICCSLSSSHAEILFSSLKKSLEVTVKHRAGVLMAGEDTLEIDWFLNKTFPAGTDSAYKTIKLKLCYAPISQKDRAWRKTEDHIKKDKTCQFQVDSTPYKSSNNKFNWTIERDVPTGTFFVRAYILNGDGHEIGYGQNTDDKKVNNLFDIQAISGRHATLDICSVVFSAFAVVSLFGFFYMEKRNAKASK

SEQ ID NO: 15799 - protein, 551 aa, Magnetospirillum magnetotacticum MS-1
MHPRLLHHAGRLPDRRTHHIPVRVVSPAFGFRCLESNDLTQFTDFGLAEPILRALGEAGYVSPTPIQTQALPPAMEGRDLCGIAQTGTGKTAAFALPILHRLSLENRRAPRRGCRVLVLSPTRELASQIAESFSDYGRHLPYTSTVVFGGVNISRQERAIAPGVDILVATPGRLIDLVDRRALTLEGVEILVLDEADQMLDLGFIHALKRIVKMLPARRQSLFFSATMPKNIAGLADQYLSNPVQVAVTPVATTAERVDQQVIFCHTGAKQALLNHVLRDPKIERVLVFTRTKHGADRVVRGLDKVGIVGAAIHGNKSQPQRERALAAFRDGSCRVLVATDIAARGIDVEGVTHVVNYDLPNVPESYVHRIGRTARAGAEGQAISFCNDEERAYLRDIERTTRQKVPVVGFPEGFQPPSRQEAQETAAEEARRPPRQPQGRPGQRQGRPGGRGQEGRGEGRGEHRAHEARGGRPGGQPGHRQDQRQDSRGPRPDGQRSDQRRPERAGEGRPQGARPQGGRPNDGRRGDARPARSGAEGGRAIGWLDRSPRS

SEQ ID NO: 15800 - protein, 361 aa, Pinus taeda
MKALILVGGFGTRLRPLTLSVPKPLVDFANKPMILHQIEALKAIGVDEVVLAINYQPEVMLSFLKEFEAKVGIKITCSQETEPMGTAGPLALARDKLDDGSAEPFFVLNSDVICEYPLKQMLEFHKKHGGEASIMVTKVDEPSKYGVVILDEETGRVDRFVEKPKIFVGNKINAGIYLLNPSVLNMIELRPTSIEKEVFPKIATKKQLYSMILPGFWMDIGQPKDYISGLRLYLDSLRRNLPKKLSFGAHIIGNVIVDETAQIGEGCLIGPDVAIGPGCVIEAGVRLSRCTVMRGVRIKKHACVSGSIIGWHCTVGQWARVENMTVLGEDVHVCDEVYSNGGVVLPHKEIKSSITKPEIVM

SEQ ID NO: 15801 - protein, 250 aa, Haloarcula marismortui ATCC 43049
MKAVVLAAGKGTRLQPLTDDLPKALVEVDGKPLLTHCLDELISLDADEFVIVVGYRQQQIIDYYGSSYDGVPVTYVHQEEPAGLAHALLQAEPKIEHDFMLMLGDNVFRGNLDTVVQRQQEQRVDCAFLVEEVPKNEASRYGVCVTNKYGEITDVVEKPDDPPSNLVMTGFYTFSPAIFKACSLVQPSDRGEYELSDAIDLLMDSGRTIDAVRLNGWRVDVGYPENRDAAEQRLAEETATLASGGGNISR

SEQ ID NO: 15802 - protein, 133 aa, Microcystis aeruginosa PCC 7806
MSLKPYISRLLALVLVLVIGLMGCSSSSGLTGNYGQDTLTVIETLTTALDVVKDDPNKAAVESQAKEQINDYISLYRRDKKSGGLRSFTTMQTALNSLAGYYTAYGSRPVPDKLKQRLKQEFKQVQFSLQKGI

SEQ ID NO: 15803 - protein, 369 aa, Oryza sativa Japonica Group
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 15804 - protein, 504 aa, Candidatus Kuenenia stuttgartiensis
MYMALGDIASIIKREIESYEEKLKLENVGYVMQVGDGVARIYGLDECMSNELLEFPDNVYGIAMNLEEDNVGAILLGSEDKIKEGDIVKTTGKIVQVPVGKAMLGRVVNALGLPIDGKGPIATDEFRPIEGNSPNVVERQPVKEPLQTGIKAIDAMIPIGRGQRELIIGDRQTGKTAILVDTIINQRTSGVYCIYVAIGQKMSTVASVVKTLEENNVMDNSIVVVASAGDPAPLQYIAPYAGCAMGEYFRDNGMHAVVMYDDLYKHAIAYRQISLLLRRPPGREAFPGDIFNLHSRLLERAAKLNDELGAGSLTALPVVETQGGDYSAYIPTNVISITDGQIYLESDLFNAGVRPAISVGLSVSRVGGNAQIPAMKKVAGMLRLTLAQYREMASFAQFGSELDKFTQAQIAKGERLVEILKQPQYEPALVEDQVMAIFAGINGFLDDIPVDKIKKFEKEFLAFMKQKHASISLEINEKKKIDQELSSKLENAIREFKQIFDKKG

SEQ ID NO: 15805 - protein, 263 aa, Magnaporthe grisea 70-15
MTRFRPCIDLHAGQVKQIVGGTLDSTTSELRTNFVSPHPPAHFARLYRDANLVGAHVIMLGPGNDVAAKESLAAWPGGLQVGGGITDKNAAEWIANGADKNQAIITSFLFPEGRFSQSRLDAVLAALGNDKSKLVIDLSCRRRDTGPEPKWVVAMNKWQTLTDMEVNQDSIKKLEPYCSEFLIHAADNEGLQGGIDEDLVRNLAEWCSIPVTYAGGGRNLDDLEAVKRLSNGKVDLTIGSALDCFGGSGVKLDDCIEWNKRQE

SEQ ID NO: 15806 - protein, 471 aa, Candidatus Kuenenia stuttgartiensis
MVNITERNIGQIVQVIGPVVDVRFQPGKLPPIKSAVSINDVKKKISVVAEIAQHLGNDTARCIAMSSTDGLVRSMEVLDDGGPISVPVGKEVLGRIFNLLGKPIDTKEDFEAKNYLPIHRAPPSFEERETTTTVLETGLKVIDLLAPFARGGKIGLFGGAGVGKTVLIMELIRSIATEHGGYSAFAGVGERTREGNDLWLEMKESGVIDKTVLVFGQMNEPPGARLRVALTGLTMAEYFRDVEGQDVLLFIDNIFRFVQAGSEVSALLGRMPSAVGYQPTLATEMGDLQERITTTKKGSITSLQAVYVPADDFTDPAPVTTFPHLDATIALSRQIAELGIYPAVDPLRSTSRILDPRILGQEHYEVAREVQRILQRFKELQDFIAILGMEELSEADKVLVARARRLQRFLSQPFFVAEQFTGTKGKYVPLKETIRGFKEVVEGKYDNLPEQAFYMVGGIEEVVEKAKQMGG

SEQ ID NO: 15807 - protein, 637 aa, Ashbya gossypii ATCC 10895
MSQIYLNSSMLVQLNATVQEFISDWLEHYSIHQQTLNPTQRILQFGTTTTVVLLGFLYLMGKWFLGPGNGGKPVPFELAVPEAAQKHWKGKRLFSASVYDPQQPGMIQNYCPATGQFLGSFRSMSKEDIDERFAAAAKAQVSWAKTSFAQRRQVLKTMQKFVLENQEMLARVACRDSGKTMLDASLGEIMVTMEKLQWMIKHGERTLRPSKRAGPANFFMKLYKGGEVRYEPLGVVGAVVSWNYSFHNTLGPIIASTFAGNGVVIKCSEQVVWSSEFFVKLARESLKVCGHDPELVQLCYCFPPSETDDTANYFTSHPSLRHLTFIGSKPVAHHVLACAAKSLTPVVVELGGKDALVVLDSAKDLESLSSIIMRGTFQSAGQNCIGIERVIVCQKNYDALVKILEHRISELRVGADIDNLEDVDVGAMISDNRFDYMEELIQDAVSQGARLLHGGSRYTHPKYPQGHYFQPTLLVDVTTDMRISQNEVFGPVLTVMKAKDIEDCIRIANDTPFGLGGSVFGKNRKDCNYVANHMNVGNVAINDFATYYVCQLPFGGIGSSGYGRFGGEEGLLGLCNSKSICYDKVSWISTFIPPPVDYPIKSSAGAWNFARAFITGAYTNSLWQRAKSILELAKGGR

SEQ ID NO: 15808 - protein, 258 aa, Microcystis aeruginosa PCC 7806
MTNHLFDLTGRVAIITGAARGIGRVLAQGLAQAGAKVVIGDINQVGAEQTVQLIQEAGGEAIAIQTDVRQRQACQNLINQTVANYGQLDIMVCNAGVEILKNTDELEEFEWDQVINVDLKGYFNCAQLATKQMIKQGTKGSIIMNSSICAFVAVPKSSGAYSAAKGGVNQLVKSLAVELASHKIRVNAFAPGYMNNMMEGTEGLRSTSDEMDELYTRIPMKRTGDLEELIGPVVFLASAASSYVTGAILMVDGGYTAI

SEQ ID NO: 15809 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 15810 - protein, 98 aa, Anabaena sp.
ATFKVTLINEAEGTKHEIEVPDDEYILDAAEEQGYDLPFSCRAGACSTCAGKLVSGTVDQSDQSFLDKDQIEAGYVLTCVAYPTSDVVIQTHKEEDLY

SEQ ID NO: 15811 - protein, 98 aa, Anabaena sp.
ATFKVTLINEAEGTKHEIEVPDDEYILDAAEEQGYDLPFSCRAGACSTCAGKLVSGTVDQSDQSFLDDDQIEAGYVLTCVAYPTSDVVIQTHKKEDLY

SEQ ID NO: 15812 - protein, 352 aa, Streptomyces avermitilis MA-4680
MTHQWRGIIEEYRDRLPVSDSTPVVTLREGGTPLVPAQVLSERTGCEVHLKVEGANPTGSFKDRGMTMAITRAKEEGAKAVICASTGNTSASAAAYAVRAGMVCAVLVPQGKIALGKMGQALVHGAKILQVDGNFDDCLTLARNLSDNYPVALVNSVNPVRIEGQKTAAFEIVDMLGDAPDIHVLPVGNAGNITAYWKGYQEYAADGIARHKPRMWGFQASGSAPIVRGEVVKDPSTIATAIRIGNPASWKFALAAKDESGGFIDEVTDREILRAYRLLAAQEGVFVEPASAASVAGLLKAAEQGKVDPGQTIVCTVTGNGLKDPDWAVAGAPQPVTVPVDAATAAERLGLA

SEQ ID NO: 15813 - protein, 61 aa, Oryza sativa
  misc_feature (30)..(30): Xaa can be any naturally occurring amino acid
  misc_feature (38)..(38): Xaa can be any naturally occurring amino acid
RGLLGAPIPKGPNVFKRFLSAGNFFFFGTXTLGLIFKXKKYFSPAPLGGFALNPAWASLLF

SEQ ID NO: 15814 - protein, 1199 aa, Arabidopsis thaliana
MAAIARLPLTHSLPSIFNPSSFLSQSLSFPTYLHRSPFRSFSSVSPILCTSHRDSRSPGSDSNASIVGDLLDYLNESWTQFHATAEAKRQLLAAGFDLLSENEDWNLKPGGRYFFTRNMSCLVAFAVGEKYVPGNGFHAIAAHTDSPCLKLKPKSASSKSGYLMVNVQTYGGGLWHTWFDRDLSVAGRAIVRASDGSFVHRLVKVKRPLLRVPTLAIHLDRTVNSDGFKPNLETQLVPLLATKSDESSAESKDKNVSSKDAHHPLLMQILSDDLDCKVEDIVSLELNICDTQPSCLGGANNEFIFSGRLDNLASSFCALRALIDSCESSENLSTEHDIRMIALFDNEEVGSDSCQGAGAPTMFQAMRRIVSSLGNKQVTECTFDRAIRKSFLVSADMAHGVHPNFADKHEENHRPQLHKGLVIKHNANQRYATSGITSFLFKEVAKLHDLPIQEFVVRNDMGCGSTIGPILASGVGIRTVDCGIAQLSMHRYVNYCHSLATLSHVSKSKYVRLSFWFLELVTCFGPSKFDMAMSSNYLDATLKETFRRSPFKFANTKVPHAGLGDSVSPIKEVPEEEEVPNDPVNIQIPFIESALSTSRLRGKNTNVYYEYIQLSQGISQGRVEIVKDFLNHHPDSVDEWINLYETPLLKACACGKPEIVKELLRRMTPEQMLPKMSQNASYHTPLTVVAVSGNMEIAEALVAKNPKLLEIPGINGQIPVVVAVENTQMEMARYLYTRTPVQVLLDQDGYHGSLLFLNAIFYKMLDIALDLFNMSRRLAVTKHSQIESIPIIVLASKPDLFPGGCYLGPLTRFIYSWIQVKLPTLPQPSRSNRDQQNTLMRKLLKGLSKWTGIDEVYRLKVMHLQAKKLLLGISEETLALGLKERSETVDEALLFAVRYGNVDFLVEMIRNNSELLWSTRTSSSSTLFLLAVEFRQEKVFSLLYGLDDRKYLLLADKDCDGNGVLHLAGFPSPPSKLSSVVGAPLQLQRELQWFKEVERIAPEIEKERVNTEEQTPIEIFTKEHQGLRQEAEKWMKDTAMSCSLVAALIVTVTFAAVFTVPGGTDDNSKGKPFHLRDRRFIIFIVSDLISCFASCTSVLIFLGILTARYSFDDFLVFLPTKMIAGLSILFVSIAAMLIAFSSALFTMMGKEGKWIVAPTILFACLPALLFVLLQYPLLKEMIFSTYGKGIFDRNMKCWA

SEQ ID NO: 15815 - protein, 98 aa, Anabaena sp.
ATFKVTLINEAEGTKHEIEVPDDEYILDAAEEQGYDLPFSCRAGACSTCAGKLVSGTVDQSDQSFLDDDQIEAGYVLTCVAYPTSDVVIQTHKEKDLY

SEQ ID NO: 15816 - protein, 149 aa, Zea mays
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 15817 - protein, 422 aa, Bacillus subtilis
MKPLLKENSLIQVKHILKAHQNVKDVVIHTPLQRNDRLSERYECNIYLKREDLQVVRSFKLRGAYHKMKQLSSEQTENGVVCASAGNHAQGVAFSCKHLGIHGKIFMPSTTPRQKVSQVELFGKGFIDIILTGDTFDDVYKSAAECCEAESRTFIHPFDDPDVMAGQGTLAVEILNDIDTEPHFLFASVGGGGLLSGVGTYLKNVSPDTKVIAVEPAGAASYFESNKAGHVVTLDKIDKFVDGAAVKKIGEETFRTLETVVDDILLVPEGKVCTSILELYNECAVVAEPAGALSVAALDLYKDQIKGKNVVCVVSGGNNDIGRMQEMKERSLIFEGLQHYFIVNFPQRAGALREFLDEVLGPNDDITRFEYTKKNNKSNGPALVGIELQNKADYGPLIERMNKKPFHYVEVNKDEDLFHLLI

SEQ ID NO: 15818 - protein, 118 aa, Nicotiana tabacum
MAEEGQVIGVHTVDAWNEHLQKGIDDKKLIVVDFTASWCGPCKFIASFYAELAKKMPTVTFLKVDVDELKSVATDWAVEAMPTFMFLKEGKIVDKVVGAKKDELQQTIAKHISSTSTA

SEQ ID NO: 15819 - protein, 135 aa, Glycine max
  misc_feature (58)..(58): Xaa can be any naturally occurring amino acid
  misc_feature (102)..(102): Xaa can be any naturally occurring amino acid
RRPPPQAITTTHKYSSEQLTHRLLSPVAQRAFPHFTRLGAMAKLALALLLLLAVAASXSASSGSHLDLDLGFLSSGERRRECRGTVAECLAEESDEEGLDLXGSHRRALYGGGYISYGALRRDNVPCSRRGASYY

SEQ ID NO: 15820 - protein, 384 aa, Desulfotalea psychrophila LSv54
MWPQKREEVMKAIIALEDGTIFEGKSFTGRGEAIGEIVFNTSMSGYQEILTDPSYTGQIVTMTYPMIGNYGINPEDMESSSVHPKAFLVKEYNAFPSNYRSTQPLAQFLETYGVLGVEGFDTRALVRHIRKAGAMKGIVSTEDLDHASLVKKAQEWTGLVGQNMVERVSCEKPYGWADNMPLSGSNFSTAKSADNNEKAFKVVAFDFGIKYNQLRILAEKGCQVQVVPATTSAQAVLDMNPDGIFLSNGPGDPEGVEGVVDTIRELLGKKPIFGICLGHQILGLAYGARSYKLKFGHRGGNQPVKNLETGKVEITSQNHGFCIDTTSLNEEDVKITHINLNDNSVEGMRHRKFPAFSVQYHPEHAPGPHDATYLFDEFIEMMQQ

SEQ ID NO: 15821 - protein, 360 aa, Streptococcus pyogenes str. Manfredo
MTKRLLILEDGTIFEGEPFGADIDVTGEIVFNTGMTGYQESITDQSYNGQILTFTYPLIGNYGINRDDYESISPTCKGVVVSEVSRLASNWRKQMTLDAFLKIKGIPGISGIDTRALTKIIRQHGTMKATMADDGDSIQHLKDQLRATVLPTNTIEQVSTKTAYPAPGIGKNIVLVDFGLKHSILREFSKRQCNITVVPFNITAEEVIQLNPDGLMLSNGPGNPEDLPEALDMIRGVQGKIPIFGICMGHQLFSLANGAKTCKMTFGHRGFNHAVREIATGRIDFTSQNHGYAVERSSLPDTLMVTHEDINDKTVEGVKHRDFPAFSVQFHPDAAPGPHDASYLFDEFLEMIDSWRCTSK

SEQ ID NO: 15822 - protein, 530 aa, Blumeria graminis
MGIPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVYDCPNSKLMEQKKFMKAALTTEAFRSYVPIIQNEVESFIKKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15823 - protein, 531 aa, Frankia sp. CcI3
MALPASAEDSAPDPHTTAGRLAHLRRVNDDAVHAGSQRAVDAQHAKGKMTARERVEAFLDPGSFVETDAFARHRAHDFGVQANRPYGDGVVTGYGTVDGRQVCVFSQDFTVFGGSLGEVFGEKIVKIMDLALKTGCPVVGINDSGGARIQEGVVSLGLYGEIFYRNVMASGVVPQLSLIMGPCAGGAVYSPAITDFTLMVDQTSHMFITGPDVIKEVTGEDVGMEELGGAHTHNSRSGVAHFQSADETECLELARALLSFLPSNNLDDAPSYDAVDDLDAEIDPDLDTFIPDSPNTPYDMHQIIERVLDEGDFLEVHAQFAQNMIVGFGRVDGRSIGVVANQPMQFAGTLDIDASEKAARFVRTCDAFNIPVLTLVDVPGFLPGTSQEWNGIIRRGAKLIYAYAEATVPKVTVITRKAYGGAYDVMGSKHLRADINLAWPTAEIAVMGARGAVNIIYRRDLARSESPETRRAELIQDYTDHFATPYIAAERGYLDAVISPSETRRELIRALRLLRTKRESLPPKKHGNIPL

SEQ ID NO: 15824 - protein, 268 aa, Arabidopsis thaliana
MEIKSYQNQAEYFVEHYLLADPFLPYTSVLVGICLCKLVYDLTELFSSIHVKSYSALTKIKRIEWNNRGISTVHAIFISFMALYFAFFSDLFSDQRSLETLTVFRNSPLSTFGLGVSVGYFLADLGMIFWLYPSLGGSEYILHHCLSGTAVAYSLFSGEAQLYTYMVLISEVTTPEINLRWYLDIAGLKRSKAYLVNGVAIFFAWLTARILLFIYMFYHVYTHYDQVIEMHTFGYLLVFVVPISLSVMNLIWFGKIVKGLKKTLEKRQ

SEQ ID NO: 15825 - protein, 342 aa, Haemophilus somnus 129PT
MKTVVSLGEILLRLSPPQYQTLTLTTSLECQFGGSELNVLSTLAQLGHNVSLISAIPDNDLGRMTKNFLFSRQINQDYILEKGQRLGIYYYQKGFSLRASRVTYDRKHSAFWESQLSDYDLESVFKGADWFHVSGITPALNDNLYSLTHYLMTKAKAEGLTVSFDLNFRASLWNSFQEARELLSPLAALADVCIGIEPLSLSGDGQGDLKDQLGLTRPYEDQELLKSILDKLAKTYSVKSFAFTQREMGHTNEYLLKGYLYQDGHLYQTDKSGIQVLDRVGTGDAFTAGVIHGMLKKESPEKSLAIAMASFKFKHTIEGDINVISQADIDQLLDETSHEIKR

SEQ ID NO: 15826 - protein, 218 aa, Arabidopsis thaliana
MKQNLVAVDILLNQMRDRNIKLDSFVVSAIIETNCDRCRTEGASLAFDYSLEMGIHLKKSAYLALIGNFLRSNELPKVIEVVKEMVKAQHSLGCYQGAMLIHRLGFGRRPRLAADVFDLLPDDQKGVAAYTALMDVYISAGSPEKAMKILREMREREIMPSLGTYDVLLSGLEKTSDFQKEVALLRKEKKSLVASARFRENVHVEDKICDLLFATNLL

SEQ ID NO: 15827 - protein, 185 aa, Debaryomyces hansenii CBS767
MGLKQDDKFPTDVTFKYIPIELNNTQDPLTCEQPILLKLDKHLEETDGNTLIVSVPGAFTPTCTANHIPPFLTNLSKLKKEKNIGSIIVISANDAFVLNAWGKLLLSTVKVTEPAPKIFFASDGNAAFSKEYDLSVDASANGMGIRTARYAIVVEDKTRKISYLGKEVERGVKFSGIDAILQAKL

SEQ ID NO: 15828 - protein, 563 aa, Ashbya gossypii ATCC 10895
MSEITLGRYLFERLKQVEVRTIFGVPGDFNLSLLDKVYEVDGMRWAGNANELNASYAADGYARVKKISCLVTTFGVGELSALNGIAGSYAEHVGVLHVVGVPSTSAQAKQLLLHHTLGNGDFTVFHRMSANISDTTAVITDISSAPAEIDRCIRACYVHQRPVYLGLPANMVDLTVPASLLNTEIDLSLKPNDPEAEEEVVSTVLELVANAKHPVILSDACASRHDVKQETKQLIDVTQFPAFVTPMGKGSIDEQHPRFGGVYVGTLSAPDVKEAVESADLILSVGALLSDFNTGSFSYSYKTKNIVEFHSDHTKIRSATFPGIKMKTVLQNLVKRIGEAAKGYQPSPVPTYAAPNEDADPKTPLKQEWLWNQVSSFLKEGDIVITETGTAAFGINQTRFPSSTIGISQVLWGSIGFTTGACLGAAFAAEEIDPNKRVILFIGDGSLQLTVQEISTMVRWGLKPYLFVLNNDGYTIERLIHGETAQYNCIQPWKHLDLLPTFGAKDYETHRVATTGEWRALTEKQEFNKNSSIRMIEIMLDVMDAPSSLIKQAKLTAATNAQP

SEQ ID NO: 15829 - protein, 294 aa, Brassica napus
MDQYEKVEKIGEGTYGVVYKARDKVTNETIALKKIRLEQEDEGVPSTAIREISLLKEMQHSNIVKLQDVVHSEKRLYLVFEYLDLDLKKHMDSSPDFSKDLHMIKRYVYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPTEDTWPGVTSLPDYKSAFPKWKPTDLESFVPNLDPNGIDLLSKMLLMDPTKRINARAALEHDYFKDIGVMP

SEQ ID NO: 15830 - protein, 364 aa, Raphanus raphanistrum subsp. raphanistrum
SSNKTLVSPGGVFEFGFFKLASSSCWYLGIWYKNIPERSYVWVANRDNPLHSSTGTLRISGTNLVLLDQSKNTVWSTNLTRRCVKSPVVAELFDNGNFVMRYSNNSDPSGYLWQSFDFPTDTLLPQMKLGFDLKTGPHRFLRSWRSPDDPASGNYTYKLETRGLPEFFLRSEDFLLYRTGPWNGIRFNGVPEMPRLLDNILTENKEEITYTFRMTNHSIYSKFIITHSGFFQLLTWTPKVQLWNVLWSIPNDQCDLYVLCGPYGYCDTKTSMCNCIKGFKPKGSQAWALGDMSQGCVRKTSLSCGGDGFIRLTKMKLPDTTYAIVDKLVGIKECKKRCLKDCNCTAFANADIRKGGSGCVMWTG

SEQ ID NO: 15831 - protein, 407 aa, Anabaena variabilis ATCC 29413
MTNMQFSQRLQPLQSNVFADMDKAKALALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFTDIPTDVLARSRMMVLSYPHNPTAAIAPLSFFKEAVAFCQEHNIALVHDFPYVDMVFEDSSNWDQNLSQSPIPNHRSLVPSILQADPDKSVSIEFFTLSKSYNMGGFRIGYAIGNAQMIQALRQIKAAVDFNQYRGILNGAIAALTGPQAGVEAAVSTFRQRRDAFIHALHHIGWYVPTPKATMYIWAKLPSSWSQNSIEFCTQLVKQTGVAASPGAGFGKSGEGYVRFALVHEPSILRTAVERISNFL

SEQ ID NO: 15832 - protein, 706 aa, Bradyrhizobium sp. BTAi1
MSALWVIVLCGALSIVYAIWATQSVLSADAGNARMQEIAAAVREGAQAYLRRQYTTIGIVGVVIFVLLAYFLGMLVAIGFAIGAILSGAAGFIGMNVSVRANVRTAQAAITSLAGGLELAFKAGAITGLLVAGLALLGVTIYFGILTGFMKLAPDSRTVIDALVALGFGASLISIFARLGGGIFTKGADVGGDLVGKVEAGIPEDDPRNPATIADNVGDNVGDCAGMAADLFETYAVTAVATMVLAAIFFAKSSLLANMMTLPLAIGGICIITSIAGTFFVKLGASQSIMGALYKGLIATGVLSLAGLAIAIAWLIGFGKLDGVDYTGTALFICGVVGLVVTGLIIWITEYYTGTDFRPVKSIAAASVTGHGTNVIQGLAISMEATALPAIVIIAGILVTYSLAGLFGIAIATTTMLALAGMIVALDAFGPVTDNAGGIAEMAGLPKEVRKSTDALDAVGNTTKAVTKGYAIGSAGLGALVLFAAYNQDLQFFIADSAHHPYFAGIKPDFSLNNPYVVVGLLFGGLLPYLFGAMGMTAVGRAAGAIVEEVRRQFREKPGIMQGTDKPDYGKAVDLLTKAAIKEMIIPSLLPVLSPIVVYFLIYAIAGGGAAGKSAAFSAVGAMLLGVIVTGLFVAISMTSGGGAWDNAKKYIEDGHFGGKGSDAHKAAVTGDTVGDPYKDTAGPAVNPMIKITNIVALLLLAILAH

SEQ ID NO: 15833 - protein, 367 aa, Raphanus raphanistrum subsp. raphanistrum
SSNKTLVSPGGVFELGFFKPLATHVGIWGIWYKKVFQKTYAWIANRDSPLSNSIGTLKISGNNLVLIGQSNNTVWSTNITRGNARSSVIAELLPNGNFVMRYSNNRDPSGFLWQSFDFPTDTLLPDMKLGYDLKTGRNRFLTSWRSYDDPSSGIPRTNSKFEGDCPEFILMTEPFEIQRSGPWNGIEFSGIPEDEGLNYMVYNYTENSEEIAYSFHMTNQSIYSRLIVREDTLNRFTWIPPSRAWSTFWGLPKDGCDYLYFCGSYSYCDLNTSPNCNCIKGFVPKNQQRWDLRDGTDGCVRTTRLSCGGDGFLRLNNMNLPDTKTATVDRRIDVKKCEEKCLSDCNCTSFAIADVRNGGSGCVMWTG

SEQ ID NO: 15834 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFEANTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTIFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYELTLIEVVE

SEQ ID NO: 15835 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFQILENQASGAGNEIQLTDAIDTLNKTQR

SEQ ID NO: 15836 - protein, 163 aa, Bradyrhizobium sp. BTAi1
MADARRAPLKDQTDITGARALIVEARFYDDIQDAMLEGATAELKAAGVGYDVLTVTGSLEIPATIAIALDAATQHGKPYDLAIALGCVIRGDTIHFEIVSQESSRALMDLSVARGLPLGNGILTVNNEDQAWARARVSEMNKGGDAARAALAVLRIKRRLARG

SEQ ID NO: 15837 - protein, 255 aa, Dehalococcoides sp. VS
MSSVDVNVKDPGFESEEAQARKRYMLQLFGFQAKHYDLHDDIMGLGIHRRWGKEMVLEILTYTRNMPQVKMLDLACGTGFVTFNTLRYMKNVDIDAFDITPEMVEVAKVRLKKNYPDRNVKFWVGDAEISYGDAKYDVIGTCFAFRNFANKNLAASNIFKALKPGGLLVLQDMTKPEKQPFRGIYLFALKNLMPIMARIIGTEKKSARYLANSVLAMPSNAEIMAILQNQGFINIKSHYQSGGMGTLTVAYKPEN

SEQ ID NO: 15838 - protein, 380 aa, Hirschfeldia incana
SSNKTLVSPGDVFELGFFKTTTRSSQDGSTDRWYLGIWYKTTSDHRTYVWIANRDNPLHNSIGTLKISHSSNLVLLDQSDTPVWSTNLTGVVKSPATAELLANGNFVLRGSYTIDLTHFMWQSFDFPVDTLLPEMKLGRNLIGPEHEKILTSWKSPTDPSSGDYSLILETEGFLHEFYLFKNEFKVYRTGPWNGVRFNGIPKKMQNWSYIVNNFIDNKEEVAYSFQVNNNHNIHSRFRMSSTGYLQVITWTKTVPQRNMFWSFPEDACDLYQVCGPYAYCDMHTTPMCNCIKGFVPKNAGRWDLRDMSGGCVRSSPLTCGEGDGFMVLGQMKMPETSEAFVEEMIGLEECSQKCVRDCNCTGFAIMDNMNGGSGCVMWTG

SEQ ID NO: 15839 - protein, 258 aa, Dehalococcoides sp. VS
MSSLAEAPIQDPGFDSEEAHKRKQYMVDLFVVQAKNYDFHDDVFGLYAHRFWMRTVLKIVGKFVKGRTSTKMLDLACGTGFVTFNTARNFENIDIDSFDISPDMLAVAKERYEKYFKGRSIKFWQGDAEVPFGEEKYNLITTSFAYRNFANKGLATENVFRALKPGGLFIIQDLTKPEHHPMRGLYIFYMKYILPLFTSILGTEKSAARWLYKSAMMMPTNGQIVKLMESKGFEKCQYKSLSLGIACVIWGYKPEKSE

SEQ ID NO: 15840 - protein, 198 aa, Streptococcus pneumoniae
GIEDILVVTGKSKRSIEDHFDSNFELEYNLKEKGKTDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 15841 - protein, 322 aa, Pyrus pyrifolia
MENFPVINLESLNGEGRKATMEKIKDACENWGFFELVSHGIPTEFLDTVERLTKEHYRQCLEQKFKELVASKGLEAVKTEVNDMDWESTFYLRHLPQSNISQVPDLKDEYRNVMKEFALKLEKLAEQLLDLLCENLGLEQGYLKKAFYGTNGPTFGTKVSNYPPCPNNDKIKGLRAHTDAGGLILLFQDDKVSGLQLLKDGEWVDVPPMRHSLVINLGDQLEVITNGKYKSVEHRVIAQTDGTRMSIASFYNPSSDAVIYPAPTIVEKNAEEKNQVYPKFVFEDYMKHYVGVKFQAKEPRFEAMKAVEVKTSFGLGPVKTTA

SEQ ID NO: 15842 - protein, 368 aa, Raphanus raphanistrum subsp. raphanistrum
SSNKTLVSPGNVFELGFFTTGSSSRWYLGIWYKKVSGRTYVWVANRDNPLSSSIGTLRFSNMNLVLLDQSNKSVWWTNLTRGNERSPVVAELLANGNFVIRDCSNNDASGFLWQSFDYPTDTLLPGMKLGYDAQKGLNRFLTSWRNSDDPSSGNISYKLDTQRGMPEFFLLKDGLRAHRSGPWNGVQFSGIPEDQKLSYMVYNFTENSEEVAYTFRMTNSSIYSRLKISFRRFLERWTTPTSIPWNLFWSAPVDLKCDVYKTCGPYSYCDLNTSPLCNCIQGFMPSNVQQWDLRDPSAGCIRRTRLSCSGDGFTRMKNMKLPETRMAIVDRSIGVKECEKRCLSDCNCTAFVQMRYPEWWVGMCDVDR

SEQ ID NO: 15843 - protein, 322 aa, Pyrus pyrifolia
MENFPVINLESLNGEGRKATMEKIKDACENWGFFELVSHGIPTEFLDTVERLTKEHYRQCLEQKFKELVASKGLEAVQTEVKDMDWESTFYLRHLPQSNISQVPDLKDEYRNVMKEFALKLEKLAEQLLDLLCENLGLEQGYLKKAFYGTNGPTFGTKVSNYPPCPNNDKIKGLRAHTDAGGLILLFQDDKVSGLQLLKDGEWVDVPPMRHSLVINLGDQLEVITNGKYKSVEHRVIAQTDGTRMSIASFYNPSSDAVIYPAPTLVEKNAEEKNQVYPKFVFEDYMKHYVGVKFQAKEPRFEAMKAVEVKTSFGLGPVKTTA

SEQ ID NO: 15844 - protein, 368 aa, Raphanus raphanistrum subsp. raphanistrum
SSNKTLVSPGNVFELGFFTTGSSSRWYLGIWYKKVSGRTYVWVANRDNPLSSSIGTLRFSNMNLVLLDQSNKSVWWTNLTRGNERSPVVAELLANGNFVIRDCSNNDASGFLWQSFDYPTDTLFPEMKLGYDLKKGLNRFLTSWRNSDDPSSGNISYKLDTQRGMPEFFLLKDGLRATGVVHGMESNLVAYQRDQKLSYMVYNFTENSEEVAYTFRMTNSSIYSRLKISSEGFLERWTTPTSIPWNLFWSAPVDLKCDVYKTCGPYSYCDLNTSPLCNCIQGFMPSNVQQWDLRDPSAGCIRRTRLSCSGDGFTRMKNMKLPETRMAIVDRSIGVKECEKRCLSDCNCTAFANADIRNGGSGCVMWTG

SEQ ID NO: 15845 - protein, 198 aa, Streptococcus pneumoniae
GIEDILVVTGKSKRSIEDHFDSNFELEYNLKEKGKTDLLNLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 15846 - protein, 106 aa, Dehalococcoides sp. VS
MERTLLLVKPDGVNRGLSGEILGRMEKLGLKMIGLRMLQMDAVLADKHYAPHRERPFFKDLVTYITSGPIVAAVFEGENAVEKMRKAMGATDPAKSEKGTVRGDWV

SEQ ID NO: 15847 - protein, 266 aa, Oryza sativa Japonica Group
MAIGAVFTDYAGKINCLDFHRKEDLLVTSSEDDSIRLYNITSATLLKTTYHRKHGADRVCFTHHPSSILCSSRYNLESAESLRYLSLYDNRCLRYFKGHKDRVVSLCMSPVNDSFMSGSLDHSVRIWDLRVNACQGPFDTFLVGGDTAEVSDIKFSNDGKSMLLTTTNNHIYVLDAYGGDKRCGFSLESSPNVATEAAFTPDGQYVISGSGDGTLHAWNINTIQEIACWNSHIGPITALKWAPRRAMFATASTALTFWIPNNSSSN

SEQ ID NO: 15848 - protein, 322 aa, Pyrus pyrifolia
MENFPVINLESLNGEGRKATMEKIKDACENWGFFELVSHGIPTELLDTVERLTKEHYKQCLEQRFKELVASKGLEGVQTEVKDMDWESTFHLRHLPQSNISEVPDLKDEYRNVMKEFALKLEKLAEQLLDLLCENLGLEQGYLKKAFYGTKGPTFGTKVSNYPPCPNPDLIKGLRAHTDAGGLILLFQDDKVSGLQLLKDGEWVDVPPMRHSIVINLGDQLEVITNGKYKSVEHRVIAQTDGTRMSIASFYNPGSDAVIYPAPTLVEKEAEEKNQVYPKFVFEDYMKLYAGVKFEPKEPRFEAMKAVEIKASFGLGPVISTA

SEQ ID NO: 15849 - protein, 206 aa, Oryza sativa Japonica Group
MAEVEAAPIAAAETPEVAAAEGAAAAKAPHKLHRQWAFWYDIQSKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 15850 - protein, 308 aa, Photorhabdus luminescens subsp. laumondii TTO1
MSTTFSNTLLSDILRQVRPLIGQGKVANYIPALAEVPADNLAIAICTIDGQIFHAGDAEKRFSIQSISKILSLTLAMTRYQEQEIWQRVGQEPSGQPFNSLVQLELEKGKPRNPFVNAGALIVCDMLQSRLSAPKQRMLEVVRKLAGCPDICYDSKVARSEMEHSHRNAAIAYLMKSFGNFDNDVLAVLQTYFHYCALKMNCIELAKCFIYLANQGSTIGSEQQILSPRQARQINALMMTCGMYDGSGEFAFRIGMPGKSGVGGGIVCVVPGEFTVTVWSPELDRSGNSLAGCAALELLADRVGRSVF

SEQ ID NO: 15851 - protein, 210 aa, Propionibacterium acnes KPA171202
MWHENPSCKRIQCRSSPCPIQEEGPLVTDDFTNPFQGEQPESLHFDVTIEIPRGNKNKYEMDHETGRIRLDRTLFTSTQYPYDYGYIEGTLGEDGDPLDALVLLTEPTFPGCLIECRALAMFQMQDEMGGDDKVLCVPADDPRRAGLIDLDDVGSMTLMEIEHFFTVYKDLEPGKSVEGATWTDRDEAEAEIKASFERAKGTSYENLHTA

SEQ ID NO: 15852 - protein, 472 aa, Staphylococcus epidermidis RP62A
MGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILAPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGIFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 15853 - protein, 131 aa, Triticum aestivum
  misc_feature (71)..(71): Xaa can be any naturally occurring amino acid
MATISAAAATTVVARAAIARPQALGLPQLRTRSERVRCSYSKDAKEATPAAAVRGAGASLLAAAGAVTASXGPALALVDERMSTEGTGLSLGLSNNLLGWILLGVFGLIWSLYTVYTSGLDEDEESGGLSL

SEQ ID NO: 15854 - protein, 169 aa, Vitis vinifera
MGDTDDYIKPVRTVFVTVGTTCFDALVKAVDTHEFKRELFARGYTHLLIQMGRGSYIPTKSTGEDGSLVVDFFTFSSSIADNLRSASLVISHAGSGSIFETLRLRKPLIVVVNEDLMDNHQSELAEELAERKHLFCARPQTLYQTIATMNLESLLPYTIQVMLQQLLSL

SEQ ID NO: 15855 - protein, 273 aa, Photorhabdus luminescens subsp. laumondii TTO1
MERRKITLIGAGNMAHAIIAGLVKGGYPAELINVCAPSHTRRDALATEYGVNSGSDNIRYAQEADVVVLAVKPQVMVDVCQPLKENVDFSNKLVLSIASGISVARFDALLQDKLNIVRIMPNTPALIGQGVSGLFASEQVSQSDRDFTQALMNSVGKTYWVKDENGINDVIAAAGSAPAYFFLFMESMQQEAERLGFDNQTAREIILQTAIGSAALAASNVDLPFATLREQVTSKGGTTAEALRIFYEGKLPETISNAMQAAIRRAQEMEKQF

SEQ ID NO: 15856 - protein, 438 aa, Vitis vinifera
METNTTATPASPPANNHTHIHHHSHSQPDTHHHGILPSDSMLVIIIPTISILLLVAIIVIVIMLRRLKSAKNRGNSKSNSSSSGNQNCNFIAHTAINFNSSPDVKSGCLYGGSLIRTPASRFKGVQVFTYKELEMATDKFSEANVIGNGGFGVVYRGVLSDGTVAAIKVLRRDGKQGERAFRMEVDLLTRLHSLYLVELLGYCADQHYRLLIFEYMPNGTLQSQLHPSHNQQRVLDWGTRLRVALDCARALEFLHEHAVPSIIHRDFKPSNILLDQNFRAKVSDFGLAKTSSDKINSQIPTRVIGTTGYLAPEYASSGKLTTKSDVYSYGVVLLELLTGRVPLDTKRPPGEDVLVSWALPRLTNRQKLVEMVDPALQGRYSKKDLIQIAAIAAVCVQHEADYRPLMTDVVQSLIPLVKNHSSVSSSCSSRFQMLSPRY

SEQ ID NO: 15857 - protein, 485 aa, Nocardioides sp.
MTTPRKFDEYRWNVLVDGVPLNVESRYPISDPSTGRYLTQVPDCAEADVDRAVQASRQAQAEWGALPPRARAAKLRELITLLREHREEFAMLDAIDGGFPISMMRNDVDAALELMDIFADMALDLGGKTIPVSTNLHFTTHEPFGVVARIGAFNHPFFFAASKVAAPLMAGNSVILKAPDQTPLSSLRLAEVAAEVLPQNLLITISGRGRVAGRAIVRHPQIKRIGFIGSTDTGRSIQRDAAEVAVKHISLELGGKNAQIVFADADLEQAALGAVNGMNFTWTAGQSCGSTSRLLVHESVADQVIARVVELVSAIAVGPPLDENAQMGPLVSQAQYDKSVHAIGEGIREGAKVVAGGGRPEGVGEGGWYLAPTVLADVRPGSFIEQNEIFGPVLSVIIFATDDEAVAIANGVEYGLTASVWTSDITRAHLIARRVEAGYVLVNGGSRHYWGLPFGGVKSSGVGSEESMEELISYTETKTTTVVLG

SEQ ID NO: 15858 - protein, 231 aa, Photorhabdus luminescens subsp. laumondii TTO1
MNNIEQNLQDVRTHIAIAAQKCERAPEEITLLAVSKTKPVEDIEKAIAAGQRQFGENYVQEGVEKIAYFANCNDLIWHFIGPLQSNKSRLVAENFNWCHTIDRLKIAQRLNEQRPEGMEPLNILIQINISDERSKSGIQLDELSTLAAEMNKLPNVRLRGLMAIPAPEPDYAHQLAVFRRMEQAFLNLKTKYPQIDTLSMGMTDDMAAAINCGSTLVRIGTAIFGARQYHN

SEQ ID NO: 15859 - protein, 444 aa, Frankia sp. CcI3
MSTSPVLHLSVIGTGYLGATHAVCMAELGFEVIGVDIDATRTQRLAAGEVPFFEPGLEGLLRKNLEAGRLTFSSSLAEAVDRAEVHFICVGTPQRPDSGATDLRHVEAATNGLIAAGLRPGTLVVGKSTVPTGTAARLAGRLAAGAPGAELAWNPEFLREGSAVDDTLRPDRLVFGVVPGGTAEARLRTVYARTIKEGTPVIVTDFVTAEIVKVAANAFLATKISFINAMAEICDMTGGDVTELAAALAHDPRIGPRFLQAGIGFGGGCLPKDIRAFQARADELGVGSALAFLTEVDAVNTRARTRTVALATKALGGSPTGRMVAVLGAAFKPNSDDIRDSPALDVATALHRAGGHVSVYDPAAIPNARIHYPYLHYTDSVIRAVAGAEIVLVLTEWSEFREIDPAALRPHVSRPIVIDGRHVLDPAVWRDAGWIYHALGRPLA

SEQ ID NO: 15860 - protein, 179 aa, Haemophilus somnus 129PT
MKKALLTALVLGTSLTVTGCFDKDNNVSQQAESTKESVSTAIAETKEAMSKKVTEVKEMATEKVEVAKEAMSEQVTEVKEMATEKVEAAKEAMSEQVTEIKETAAEKVEAAKEAMSEQVTEIKETAAEKVEAAKEAMSEQVTEVKEMAAEKVEAAKEAMSEKVMEVKEMATEIKSAVEK

SEQ ID NO: 15861 - protein, 449 aa, Haemophilus somnus 129PT
MSAIVSLEDFLAKVEQRDGHQPEFLQAVREVFTSIWPFLEKNPKYRSEALLERLVEPERAFQFRVAWTDDKGQVQVNRAFRVQFNSAIGPFKGGMRFHPSVNLSILKFLGFEQIFKNALTTLPMGGGKGGSDFDPKGKSDAEVMRFCQALMAELYRHVGADTDVPAGDIGVGGREVGYLAGYMKKLSNQAACVFTGRGLSFGGSLIRPEATGYGLVYFAQAMLAEKGQSFAGKTVVVSGSGNVAQYAIEKALQLGAKVVTCSDSSGYVYDPEGFTQEKLTALLDIKNVKRGRVKDYAEQFGLQYVEGARPWGVKADIALPCATQNELELSDAQQLIANGVQLVAEGANMPTTIEATDAFLEAGVLFGPGKAANAGGVATSGLEMAQSSQRLYWTAEEVDEKLHRIMLDIHANCKKYGTVEGQENINYVVGANVAGFVKVADAMLAQGVY

SEQ ID NO: 15862 - protein, 186 aa, Pseudomonas fluorescens PfO-1
MNIPNLITVLRVLLIPIFILLFYLPYQWSYLASSSVFAFAAATDWLDGYLARRLEQSTPFGAFLDPVADKLMVAVALVLLVQEHGNLWLTLPAAVIIGREIVVSALREWMAELGARAHVAVSNLGKWKTAAQMLALVILLANPKVFSFWVVIGYALLMVSAGLTLWSMVQYLRAAWPHLKTDVEKK

SEQ ID NO: 15863 - protein, 433 aa, Coprinopsis cinerea okayama7#130
MFTRQAISTLRLVRLSRGLATHANSGLAVPASLHLKTGQTFKGTSFGAPRSVFGETVFSTSITSYTESMTDPSYRGQILVFTTPLIGNYGVPHNVAPFDSQDVGVVLESQGIQCAAVVVGDVAEKFSHYTAVESIASWCKRHNVPGITGVDTRAITTLLRDQGTTLGRVAVGTDALLPPPAAEEYWDPSLENLVDQISTKQVYELNPTGSVKIAMLDFGAKANILRSLVRRDAAVTVFPWNYDFNKVRDQFDGLFLSNGPGDPKQCMEAALNLRRTIAEWNKPIFGICMGNQIIGMAAGLDSYRMTFGNRGHNQPVLALASSGSIKAGRVYVTSQNHQYALKLQEPFPEGWEPFFINCNDSSVEGIKSTDASGKQVWGVQFHPESAGGPLDTIEMFTDFVSHCKAQKVANYQPADVKPQVGLETEAPRVAATA

SEQ ID NO: 15864 - protein, 132 aa, Brassica napus
  misc_feature (17)..(17): Xaa can be any naturally occurring amino acid
  misc_feature (29)..(29): Xaa can be any naturally occurring amino acid
  misc_feature (32)..(32): Xaa can be any naturally occurring amino acid
  misc_feature (40)..(40): Xaa can be any naturally occurring amino acid
  misc_feature (48)..(48): Xaa can be any naturally occurring amino acid
  misc_feature (50)..(50): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(69): Xaa can be any naturally occurring amino acid
  misc_feature (80)..(80): Xaa can be any naturally occurring amino acid
  misc_feature (82)..(83): Xaa can be any naturally occurring amino acid
  misc_feature (90)..(93): Xaa can be any naturally occurring amino acid
  misc_feature (96)..(96): Xaa can be any naturally occurring amino acid
  misc_feature (98)..(98): Xaa can be any naturally occurring amino acid
  misc_feature (100)..(103): Xaa can be any naturally occurring amino acid
  misc_feature (105)..(105): Xaa can be any naturally occurring amino acid
  misc_feature (107)..(111): Xaa can be any naturally occurring amino acid
  misc_feature (113)..(113): Xaa can be any naturally occurring amino acid
MAYSMLSSAAVVTSPAXATMVAPFTGLKXSSXFPVTRKAXNDITSIVXNXGRVSWMKVWPPVGXKKXEXLSYLPDLTEAXLXXEAYYLLXXXXILXCXLXXXXLXYXXXXXRXRPTPLHFSFPKRSAALPYP

SEQ ID NO: 15865 - protein, 297 aa, Zea mays
MVLLLLYHSIWLRVAGAGDSSSTDSPGGSLRRAHRDRGSTMAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 15866 - protein, 222 aa, Hordeum vulgare
MAGEKGLVLLDFWVSPFGQRVRIALAEKGLPYEYVEEDLIAGKSDRLLRSNPVHKKIPVLLHDGRPVNESLIILNYLDDAFPDAPALLPSDPYARAQARFWADYVDKKVYDCGTRLWKVKGEPQAQARAEMLEVLKTLDGALGDKPFFGGDKFGFVDAAFAPFTAWFHSYERYGEFSLAEVAPKIAAWAKRCGERESVAKSLYSPEKVYDFIGLLKKRYGIE

SEQ ID NO: 15867 - protein, 173 aa, Oryza sativa Japonica Group
METTGGGGSPKEAVVPSAASGDTTLGRHLAHRLVQVGVSNVFAMPGDLNLTLLDHLIAEPGLHIVGCCNELNAGYAADGYAWARGVGACTVTFTVRGQLLHGRRRRSHRFWNQVTGDEAGAAFRNQECAGAAPSLPSAVARRSGSVVVDGGSASPSSPPSPSSETTASWDRHG

SEQ ID NO: 15868 - protein, 275 aa, Oryza sativa Japonica Group
MEPSDLAQKHTRFRIAVCKLAVSSSLVRTEKISMAISQEEQHAGGGRDYAEPAPQPFLGSSELRRWSLYRAAIAEFVATLLFLYVTVATCTAGVSGGHVNPAVTLGLLVARKVTLLRAALYVAAQCLGAGLVRALNSAHFARHGGGANVVGDGYSKGAGLAAEVAGTFVLVYTVFSATDAKRSARDSHIPVLAPLPIGFAVFVVHLATIPITGTGINPARSFGAAVVYNQPNAWHDQWIFWVGPLVGSAIATLYHEHVLRASTLKALGSFKGARQ

SEQ ID NO: 15869 - protein, 167 aa, Aspergillus oryzae
MSLTRQSHRTVDRDEVERLRKRFMKLDKDSSGTIDRDEFLSLPQVSSNPLATRMIAIFDEDGGGDVDFQEFVSGLSAFSSKGNKEEKLRFAFKVYDIDRDGYISNGELFIVLKMMVGNNLKDVQLQQIVDKTIMEADKDQDGKISFEEFTDMVENTDVSLSMTLSQI

SEQ ID NO: 15870 - protein, 363 aa, Bordetella petrii
MALQCGIVGLPNVGKSTLFNALTRAGIAAENYPFCTIEPNVGVVEVPDPRLQKLAEIVGPERILPATVEFVDIAGLVAGASQGEGLGNQFLSHIRETDAIVNVVRCFEDPNVIHVAGKVDPIADIEVIETELALADLQTAEKALHRHSKTARSGDKEAQRLVAALEKCIAALNQAKPVRSVDLSDEEAALIKQLCFITAKPAMYVGNVSDDGFTNNPLLERLTEFAAARNAPVVAICAAIESEIVDLPDEDRQAFLADMGMDEPGLNRLIRAAFKLLGLQTYFTAGVKEVRAWTIPIGATAPQAAGVIHTDFERGFIRAQTISFDDFIACKGEQGAKEAGKMRAEGKEYVVQDGDVMNFLFNV

SEQ ID NO: 15871 - protein, 204 aa, Oryza sativa Japonica Group
MRVMVALRLKGVEYELLQETMGKKSELLLASNPVHKKIPVLLHRGKPISESLVIVQYVDEVWPPPASILPRDDPYAAAIHRFWGQYIDDMFPPRIRILRGTVPGDKDEASDEMTTALLYLEEAFVECSKGKQYFGDDSIGYLDIALGSHLGWIRAVERIAGVELLGGAKVPNLAAWADRFCGHPAVVDVMPDVDILVEFTAKLI

SEQ ID NO: 15872 - protein, 234 aa, Trichodesmium erythraeum IMS101
MTKIILFDAVGTLFGVRDTVGEVYQKFAIEWGVDVSPSAVNQAFFDSFKAAPPMAFPGAESAKILDLEFEWWCQVAAETYKKVGVFEQFSNFRSFFGQLYDYFATGAPWFVYPDVKPALTKWHENGIKLAVLSNFDSRLYPVLAALKLADFFSDITISTEVGAAKPDQKIFTAALQKCNFTIEKALHIGDSLTADYEGAINVGIEAFWLNRNTISQPDINQFANLLDCFNSYFT

SEQ ID NO: 15873 - protein, 364 aa, Raphanus raphanistrum subsp. raphanistrum
SSNKTLVSPGGVFEFGFFKLASSSCWYLGIWYKNIPERSYVWVANMRQPSPQFHWNSQNLQALTSVLLDQSKNTVWSTNLTRRCVKSPVVAELFDNGNFVMRYSNNSDPSGYLWQSFDFPTDTLLPQMKLGFDLKTGPHRFLRSWRSPDDPASGNYTYKLETRGLSRVFSTSEDFLLYRTGPWNGIGLTAYRRCHGVDNILTENKEEIRYTFRMTNHSIYSKFIITHSGFFQLLTWTPKVQLWNVLWSIPNDQCDLYVLCGPYGYCDTKTSMCNCIKGFKPKGSQAWALGDMSQGCVRKTSLSCGGDGFIRLTKMKLPDTTYAIVDKLVGIKECKKRCLKDCNSYAFANADIRKGGSGMCDVDP

SEQ ID NO: 15874 - protein, 477 aa, Oryza sativa Indica Group
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRNINNDAFFELQDSLSMASNSEAEDAGGHERWWKPSSPLGTSVGTPGAEFYDAFEEISSDGATRSSQCMDDDLREMRLSLLMEIERRKQAEEALENWQKEWKKLSDHLSVIALTLPPPSLAEDTDDSSMDPGAELCQQITVSQLVAAAIARGFARAEVETDMETKIAAKNFEIARLSDRVQYYEAANREMSQRNQEAIELERSKYSLWCVESPRCQRCRGNNEISERRDRSGSGARLGLQLPLAQQPLPGPTYLQRSPKPVKTLIPTAIRAR

SEQ ID NO: 15875 - protein, 346 aa, Oryza sativa Indica Group
MSAAISGASLVLSSPPAPGARPQPRPARFTSLIMLSYHAAKQIPKDFLHIDDFDKDTIMKILNRAIEVKAMIKSGDRSFQPFKGKSMAMIFAKPSMRTRVSFETGFFLLGGHAIYLGPDDIQMGKREETRDVARVLSGYNDIIMARVFAHQDILDLAKYAAVPVINGLTDYNHPCQIMADALTMLEHIGRIENTKVVYVGDGNNIVHSWLRLAALFPLHFVCACPKGFEPDAKTVEIARSAGSKIEITDDPMEAVKGADVVYTDVWASMGQKEEAEYRKKVFQGFTVDEAMMEMAGPNAFLMHCLPAERGIEVTDGAIEAPNSIVFPQAENRMHAQNAIMLHVLGA

SEQ ID NO: 15876 - protein, 363 aa, Hirschfeldia incana
SSNKTLVSPGDVFELGFFKTTSSSRWYLGIWYKKVDFRTYVWVANRDNPLSSSIGTLKMSNMNLVLLDHSNKSVWSTSLTRGNERSPVVAELLANGNFVMRDSNNKDASGFLWQSFDFPTDTLLPEMKLGYDLKKGRNRFLTSWRNSDDPSSGEISYQLDTQTGMPEFYLLQSGVRVHRSGPWNGVRFSGMPGDQELNYMVYNFTENNEDVAYTFRMTNNSIYSILKTSSEGFLERLTWTPNSIAWNLFWSSPLENCDMYLICGPYSYCDVNTSPLCNCIQGFKPWNMQQWDLRDASVGVKRSTRLSCSGDGFTRMKNMKLPETKMAIVDRSIGVKECEKRCLMDCNCTAFANADIRNGGSGG

SEQ ID NO: 15877 - protein, 309 aa, Mycobacterium avium 104
MTPRHFLRDDDLSPAEQAEVLALAAELKKDPFSARPLEGPRGVAVLFDKNSTRTRFSFEVGIAQLGGHAVVVDARSTQLGRDETLEDTARVLSRYVEAIVWRTFEQHRLEAMAGAATVPVINALSDEFHPCQVLADLQAIAEHKGSLSGLRMCYLGDGANNMAHSLMLGGVTAGIHVTIAAPDGFTPAPEFVAAARRRAESTGATVTLTTDARTAARGVDVLVTDTWTSMGQEDDGLDRRTPFWPYQLNADLVSLADPEAIVLHCLPAHRGEEITDEVMDGPSSVVWDEAENRLHAQKALLTWLLERQA

SEQ ID NO: 15878 - protein, 367 aa, Hirschfeldia incana
SSNKTLVSPGNVFELGFFRTTSSSRWYLGIWYKKLSNRTYVWVANRDNPLSNSIGTLKISNMNLVLLDHSNKSVWSTNLPRGNERYPVVAELLANGNFVMRYSDNNDASGFLWQSFDFPTDTLLPEMKLGYDLKTGLNRFLTAWRNLDDPSSGDYSYKLENRELPEFYLSKNGFQVHRSGPWNGVQFSGIPENQKLSYMVYNFTENSEEVAYTFRMTNNSIYSRLKVSSDGYLQRLTLIPESIIWNLFWSSPVDIRCDLYKTCGPYSYCDGNTSPLCNCIQGFDPWNMEQWDQRVSAGGCIRRTPLSCSGDGFTRMKNMKLPDTTMATVDRSIDVKECEKRCLSDCNCTAFANADIRSGGSGCVSGP

SEQ ID NO: 15879 - protein, 750 aa, Oryza sativa Japonica Group
MDPCTGSMNPARARGTGQPLRVYGPGPCTESDRILFVSSRLPRESFPPLKPIAAAAGASLSFWSKIIAQNPRLELLLGRLILESEEGMSGPLDRFARPCLVPCKALLFVILPKRLSHLSVAGFEGFTHNDEKKEIRSDADNSEGEKKTKIGSFKKKAINAGNKFRHSLRRRSKKKNEPRGSIEDIRDVQDLQAVDAFRQCLVDEDLLPQQHDDYHTMLRFLKARKFDVEKAKSMWSDMLKWRKEFGADNIEEFDYTEADEVMKYYPQFYHGVDKEGRPIYIELIGKVDANKLMQVTTIERYVKYHVKEFERCFQMRFPACSIAAKRPIDSSTTILDVQGVGLKNFSKAARDLITRLQKIDNDNYPETLRRMYIINAGQGFKMLWSTVKSFLDPKTASKIHVLGSKYQNKLLEIIDENELPEFFGGKCKCEAFGGCKKSDKGPWKDPNIIKRVLNGEANYGRQIVTISSTDGKIIRYAGPQYPTRKGSDGSAESGSEVEDGASPMASRNLITNPLLTPVHEEASCHASKLAAHGFTSASPSIIEESIPVVDKVVDDGWGSPRASSSPSRSLPITFDGLWTQVITWLTVLIVSLFAMVRSVPSRMAKRFSSQSTDHDHSYVEYPQEAEYKEEFRPPSPAPSYTEKDVLSSMVRRLGELEEKVQALETKPSEMPFEKEELLNAAVRRVDALEAELISTKKVYVKILLPYKKKVMKYFNFHEQALYEALMRQDELLAYIDKQDMIKFRKKKFCF

SEQ ID NO: 15880 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 15881 - protein, 314 aa, Pyrus pyrifolia
MATFPVVDMSLVNGEERAATLEKINDACENWGFFELVNHGISTELLDTVEKMNKDHYKKTMEQRFKEMVVAKGLDAVQSQIHDLDWESTFFLRHLPSSNISEIPDLEEDYRKTMKEFAVELEKLAETLLDLLCENLGLEKGYLKKAFYGSKGPNFGTKVSNYPPCPKPDLIKGLRAHTDAGGIILLFQDDKVSGLQLLKDGEWVDVPPMHHSIVINLGDQIEVITNGKYKSIMHRVIAQSDGTRMSIASFYNPGDDAFISPAPALLEKKSEETPTYPKFLFDDYMKLYSGLKFQAKEPRFEAMKARETSSVATA

SEQ ID NO: 15882 - protein, 363 aa, Hirschfeldia incana
SSNKTLVSPGGVFEFGFFKIASSSRWYLGIWYKNIPKRSYVWVANRDNPLCSSTGTFKITGTNLVLLDQSKNTVWSTNLTRRCVKSPVVAELFDNGNFVMRYSDNNDPSGYLWQSFDFPTDTLLPEMKLGFDLKTGSHRFLRSWKSPDDPASGDYTYKLETRGRPECFLRSKDFLLYRTGPWNGFRFSGVPEMPQLLVNIFTENKEEITYTFRMTNHSTYSKLIVTPSGFFQLLTWTPKVQLWIVLWSVPKDQCDLYMLCGPYGYCDAKTSMCNCIKGFKPKASQAWASGDMSQGCVRRTRLTCGGDGFIRLTKMKLPDTMYATVDKLVGIKECKMRCLNNCKCTAFANADIQNGGSGCVMWT

SEQ ID NO: 15883 - protein, 388 aa, Caulobacter crescentus CB15
MSQDLLPGVTGVLALADGAILQGVGCGAVGDAVGEVCFNTAMTGYQEILTDPSYMAQIVAFTFPHVGNVGVNGEDVEQITGVAETAARGALFRDVPTVQANWRADGDFDAWMKARGVVGLAGVDTRALTRKIRETGMPHGVIAHSPDGQFDLAALVAKAKAWAGLEGLDLAKDASTTQTFTWDEGLWSWPEGYAKLDKPKYEVVVIDYGVKRNILRALAHVGARATVVPASTSAEDILARNPDGVMLSNGPGDPAATGQYAVPEIQKLVASGKPVFGICLGHQMLALALGAKTVKMEQGHHGANHPVKDLTTGKVEIVSMNHGFTVDTASLPAPVKETHVSLFDGTNAGIALDGKPVFSVQHHPEASPGPTDSLYLFERFAGLMDAAK

SEQ ID NO: 15884 - protein, 139 aa, Xanthomonas oryzae pv. oryzae KACC10331
MADRPGVVLQCKARSLPLHYPTRPSQRRWRFVSPSQEHRTSVCGDPKTRTTTTPSGAISPMSTIEERVKKIVVEQLGVKEEEVTTSASFVDDLGADSLDTVELVMALEEEFECEIPDEEAEKITSVQQAIDYVKSHVKS

SEQ ID NO: 15885 - protein, 198 aa, Streptococcus pneumoniae
GIEDILVVTGKSKRSIEDHFDSNFELEYNLKEKGKIDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 15886 - protein, 647 aa, Brassica napus
MSSAPSPGTGSPPSPPSNSTTTTPPPASAPPPTTPSSPPPPSTIPTSPPPSSRSTPSAPPPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 15887 - protein, 569 aa, Coccidioides immitis RS
MSGVSGGLAARLLERWGSFSLRVRARAHLGASFPGNRVPFAWLSDVAKPKYGASRQQCCLRRSSATRIPLLSLLALPCRVASEKRPRSSQSAWLVSTAASANVPVTFPPKSSHMDALIGRARSQPTWRYCYGPDGQETPVTTHLSAPSTAPNAASATPTATNAAQTTAITSCHLHATKTFCIAGDGKEVQVTGPAGPNTTPPTQYTDCHRHGSKLYCVGPNNEEVEVLAAEASSPTGGHDGHNHGNDQQELDCHFHAGVEIDRNYNVPYRIGSLFAILITSGIAVFAPILWKRFSPSTASASAFLIIKQFGTGVMVATAFIHLLTHAQLTFANRCLGRLQYEATATAIMMAGLFLTFLLEYFGHRVMASRIRPESDREGSVSSSTQQANQKDSSRTCAVAPEMSHQHAPRSDKLSVILMEAGIVFHSIILGLTLVVAGDSAYTPLFIVIIFHQMFEGLALGSRIADLAKMATGMKLIMATIFTLITPIGMAIGLGVRKTFNGNDRSTIIAIGTLDSFSAGILTWASLVNMWGHDWVYGEFRQTGVMKTCLGMLSLLLGMIAMAVLGKWA

SEQ ID NO: 15888 - protein, 346 aa, Caulobacter crescentus CB15
MKALRYHGARDVRYESMDDPTPQSDRDAIVQVTACSICGSDLHIYHGHGFSEDLGFCVGHEAVGEVVEVGRGVQRLKVGDKVMLPAAVGCGRCRSCLSGVIQTCENGQGACYGLSARLQGSQAEAVRVPAADMNAVPVPDGVSMDQALMMTDALATAWFGARNAEVRPGASVAVIGLGPIGLMAVESAYVMGAHVVYAIDPLPARRALAEEAGAIALHPDEALARVREDTKGRGLDCVIEAVGGEATVDAALRLVRPRGVVSVIGVQQAKRFAFPLERAFGAGLTFRVGTCSVPEELPALFPLVRSGRLRPEKYISHRLPLSDGPEAYRLFESREAGALKMVLTPG

SEQ ID NO: 15889 - protein, 530 aa, Blumeria graminis
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVFDCPNSKLMEQQKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPVKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15890 - protein, 168 aa, Avena vaviloviana
VMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 15891 - protein, 211 aa, Dehalococcoides sp. CBDB1
MLSDSSKKIKKEVEAINSEFKTIVGCGEAKCPKLKRLRLASTPDITLTVMIEIPKGSRNKYEYDKERKVIKFDRMLFSAVHYPSDYGFIVDTLAEDGDPLDALVLVWEPTFPGCMIETKPVGLFKMYDEKGPDAKLLCVPIGDPHFNFIRDLSDVPPHLLKEIFHFFNIYKELESKKTGVEGWEDRESAIKTYWESHQRYLDTLKDTKKVK

SEQ ID NO: 15892 - protein, 581 aa, Desulfotalea psychrophila LSv54
MNKTKIIATLGPQSQSVEEIYSLIQAGMNVARINLSHGDAESYKHLISNVKEARKLAEKDTAILLDNRGPEIRVSEMEEDIHLVDGEELVITNRAETVSPSRITTNYPQLAGDVQVGSRILLDDGKLALEVLAIEDEEVITKVIAGGILSSRKRVALPDNEVNLPSLSEKDKEDIAFGVEQDVDFIAASFVRQAGDVWAVRKIIEDNGGDQEIIAKIENRQGVNNLDEILQAANGIMVARGDLGVEVPAEEVPIIQKSIIKAANRLGKPVITATQMLESMITCPTPTRAEANDVTNAIFDGTDAVMLSGETAIGKYPVQAVAFLVRCATIAENALDYDHILANGLQNRRPTITDSISYASCATAADLKATAIITATSSGSTARMVARYRPKAPVIAVSPSPSTIRHLQLIRGVTPLLCNFGSSMDEQLDRVIHAATLAELIHNGDLVIITAGMPLGPTGTTNMLKVHTVADICVTGQGIGVKHAQGAVRIIQAEDDWQDLPEHTIAVVSSTNESMLKHLGKVRGIIAEAPGLTSHAAIVGRELGIPVICNVTNALMLFENDQVITIDGTTGHICYGSTQNT

SEQ ID NO: 15893 - protein, 810 aa, Vitis vinifera
MEFASSKESNSMFQRKYKLDLLKKTRFLGCKTVETPIDPTCKLGRKPSDVGEQESVVVTSSAEAEFRVVAHGICELLWLKKLFEDLRIPSEKPMKLYYDNKATINIAHNLLEDIVWDDFAESDDHIVPHPGGEHGNECPVRGDNCKRPRCEVIGVNNNADDRNATKYFRQGKEETNLPTLKHKRDKMLEKGSWSCTPDGVFPASCDSDSIKETTTLSSDDTMMSTRCFKSSNIESIDNEFCANDPILGDRCVAVDNNLYRYPLSHISQADNDLSFFDNARDEKECSDLLYCGWPDIGNFEDVDRMFRSCDSTFGLGSASNEEELSWFSSSHTNEESEDAMKLGFKFPPPESSVLKSASEQNEASRPNDASPSISESIKKNVSIGYKPSPQISESNKPDVLSHLSFMDGSETVTESKDDFTSKEHVYLHKKQSKHQNLSEGKRKDRFTENGGGFHHFPNPKQFADVKLPFGDSSCQVLATSGIRRQEQSVGSDSLCYSHIPYTHSNYIHPSDQFPVSPTPSCVKSENNGHSPFSPKESSYASNIQSMESSHDASFETPAIKVDEKREKLYRKQGFQTSFAISSKHKDLVVQAACYDPISVQKQLNHSENEVEGHSEVEGGSISIPMEMDSSNVQDNSCMSSMLEEISLEATSFRQLQNVTEQLDIRTKLCIRDSLYRLARSAEQRHNCGSLNSSSRDDGDTGGLLMAAEPNKNCTKGYPSHLVFFTKFLTSNSTIFALKSPESIHLMMAMYAPRGKKKLLMNSRTGHGLWIIRLNNQVNNVKEVFGLFGHLYFRSVEEQERIEGWIVPHFR

SEQ ID NO: 15894 - protein, 404 aa, Mycoplasma mycoides subsp. mycoides SC str. PG1
MNYNNKKTLKDIDVKNKTVLVRVDFNVPIQNGVITDDNRIIAAFPTINYLLENDAKIVLFSHLSRIKSKEDKLKKSLAPVAKRLEELLNKQVKFINQTRGQELEKAISSLQSKEIILVENTRFEDVLDDQVVKYESKNNSELGKYWASLGEVFVNDAFGTAHRAHASNVGIASNIKVSAIGFLVEKELKMLFQAVNEPKKPFIAILGGAKVSDKIGVIENLLPKVDKLLIGGGMSYTFLKALGKTIGKSLLEEDKIDLAKHYLEIGKDKIVVPVDTACAKEFADVSPTIFEGNIPDEWDGLDAGPKTIELFKQEIKKAKTIVWNGPVGVFEFKNFENGTKSVCQAIAEQTQNGAFTLIGGGDSASAAINMGFKDKFSWISTGGGASLEFMEGKELLGISAIQDK

SEQ ID NO: 15895 - protein, 338 aa, Mycoplasma mycoides subsp. mycoides SC str. PG1
MSKKVAINGFGRIGRLTFRQLFEKDIEIVAINDLTDTKTLAYLLEFDTAQGIFCEGEISHTDNSIIIKGKEVKVFAEKDASNLPWSELKVDLVIELTGFYTDKEKASAHIKAGAKKVVISAPATGDLKTVVYGVNHKSLTSDDVIISGASCTTNCLTPFTKALDDAFTIKKGFMTTVHAVTNDQRLLDLNHKDVRRGRAAAWNIVPSTTGAAKAVSLVLPHLKGKLDGYALRVPTITGSITDLTVEFENQELTVEQINNAVKKALESDADLAKAMKYETKPIVSSDIIGSKYGSIFDATLTKVMNVDGKQLVKVCSWYDNESSYVSQLVRTTIYFMSL

SEQ ID NO: 15896 - protein, 541 aa, Vitis vinifera
MGFLDAIPNKHSLQDSSSFLNTTTVIALCLFFALLCACIVIGHLLEEHRWANESITALLLGLCAGVVVLLVSKGRSSKILAFNEDLFFLYLLPPIIFNAGFQVKKKQFFKNFSIILMFGVFGTIISFCLISAGAFLLFKKIGITTLNIEDYLAVGAILSATDSVCTLQVLNQEETPFLYSVVFGEGVVNDATSIVIYNAVQSLDLSNIDALTALKLLGTFLYLFFTSTILGVVAGLLSAYIIKTLYFGRHSTDREVALMMIMAYLSYMLAELLSLSGILTVFFCGIVMSHYTWHNVTESSRITTKHAFATISFIAETFIFLYVGMDALDIDKWRSSKASAGTSVSVSSAFLALVLIGRAAFVFSLSNILNFFKSAESTKVEFRQQFIIWWAGLMRGAVTIALSYSEFSDSETTSTQDSALMITSTIIVVLFSTVVFGSITKPLIGAVLLRHAKPTVSDATDIASLEDLRLLFLENGDPSDGGNNQPSPKASNLRLLMRYPTSTAHYFWRKFDDKYMRPMFGGRGFVPYVPGSPTGAQDETS

SEQ ID NO: 15897 - protein, 136 aa, Zea mays
MSWCTIESDPGVFTELIQEMQVKGVQVEELYSLDVDSLSQLQPVYGLIFLFKWMAGGNDERPVVSDPNPNLFFARQVITNACATQAILSILMNRPEIDIGPELSNLKEFTGAFAPDMKGLAINNSDSIRAAHNSFA

SEQ ID NO: 15898 - protein, 530 aa, Blumeria graminis
MGISESFMFPYLQPLLQLGFGIALASGILSLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVYDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 15899 - protein, 501 aa, Asparagus officinalis
MTVSITAAVQLFLLLLLLLPLLFVHHKTKPKTKCRSPPGPPPLPVIGNLHQLSLLLHQSLYRLSKIHGPIFKLSLGRVPVLVISSPSLAKQVLKTHDLACCSRASTVSFKEYTYDGCDVAGAPYGDSWRNLRKIFVLKLLSSKKLTSFRLVQEEEIEGMISSIRTRSDTNATVNITEFVVRLANNITFRVAFGYRSEGEYGEKSRFQRLLESGNDTVASFYVGDYFPGLGWLDKMTGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 15900 - protein, 480 aa, Prochlorococcus marinus str. NATL2A
MSEISFDFDLIVVGAGYGGFDAAKHAAEAGLKVAIVESRDMGGTCVNRGCVPSKALLAASGKVRELADVPHLSEFGIHSAPVRFERKKIAEHAKNLVETIRKNLTKTLERSGVEILRGEGRLEGNQKVGLRETNGVDRIFSARDIILATGSDPFVPPGIEIDGRTVFTSDEAINLEWLPRWIAIIGSGYIGLEFADIYTALGCEVTMIEALDKVMPTFDPDITKIASRNLIDKRDIETRAGVFATKVKPGCPVEVELTDAKSREVIEELQVDAVLVATGRVPSTENLNLQSVGVETTRGFIPIDDQMRVLVNEKPVSNLWAVGDVTGKLMLAHTAAAQGSIAVENILGKAIEIDYRSIPAATFTHPEISSVGLSEEEAKDLAKNEGFELGIVRSYFKANSKALAELESDGIMKLIFNKETGEVLGAHIYGLHAADLIQEVSNAISRRQRVNDLAKEVHTHPTLSEVVEVAYKQASLQIKK

SEQ ID NO: 15901 - protein, 413 aa, Coprinopsis cinerea okayama7#130
MLAPPTLGIPQRGKKPILGLKIDKNNTSFELYAGGPSGPPESYMSPGDDARTIRPGPATIQPGGDTGTTTVPASKPGASEPITRIQDLLRDLNLTQPPPTVNPSPGDSILSKIEDPSSTQWSDECFEEISRLGEGAGGAVHKVKDKRNGMIMARKTITTREAPMKQLLRELTIMSSTKHVNIITFYGAYMSPSSSEIKIIMEYCEGGSLESVGKRIRERGAIVGEKIAGRLAEGVLQGLSYLHSKKTIHRDIKPSNILLSKEGVVKLCDFGVSGELILSQAGTFTGTSFYMAPERIQGKEYTIRSDVWSTGISLLELVQNRFPFPPDLPPIELMMYITNSEPPRLEDEPGVNWSEEMKDFIKQALTVDPVDRPTPKDMLEHPWIKNMMKYENTMGRWIAQVWGWSRSKKSRDE

SEQ ID NO: 15902 - protein, 263 aa, Microcystis aeruginosa PCC 7806
MQVTDLYIYPIKSCRGIQLSQAEVTPKGLLWDREMMLVDGKGKFITQREYPQLATVSVTITEDNFSLKTSQDSLTFQPNFTGEKRAVQIWESQTIAMDQGDEIAEWFEKILDIPCRLVRQSPDYPRPANPRYAGNDHTPVSFADGYPILLTNTASLADLNRRLVTPVPMNRFRPNIVISSDRAFSESSWQKITIGEINYALVKPCSRCIITTTDQETGRRNPQQEPLKTLSTFRRFPGGIMFGENVIPEKTGTIKVGDPITVI

SEQ ID NO: 15903 - protein, 316 aa, Bordetella petrii
MANDSFMIFTGTANTRLAVDVVNHLDMSLGKMTVGRFSDGEVMVEINENVRGKDVFVLQPTCAPTNDNLMEIMVMVDALRRASAGRITAAIPYFGYARQDRRPRSARVAISAKVVANMLQVAGVDRVLTMDLHADQIQGFFDIPVDNIYAGPILLGDIWRRNFSNLVVVSPDIGGVVRARALAKQLEADLAIIDKRRPRANVSEVMNIIGEVDGRTCIIMDDMVDTAGTLCKAAQALKDRGAGAVYAYCTHPVLSGGAIDRIEASELDELVVTDTIPLSEQGQASGKIRQLSCAALLGETILRISNAESVSSLFVD

SEQ ID NO: 15904 - protein, 393 aa, Prochlorococcus marinus str. NATL2A
MKTYNRFPLDLIRGKGSWVWDQKGRKYLDGVAGIATCSLGHSDKALIKSLSKQLKRLQHVSNLYGIPEQEELAQWLTSQSFAKSVFFCNSGAEANEAAIKLARKYGHIERNIDNPVILCSKESFHGRTLAAVSATGQTKYHKGFEPMVQGFQFFSYNDSESFENLFDTLEKTGPQIAAVFIEPIQGEGGINIGKKSFFELLRKKCTRSNVLLIFDEVQTGMGRTGTLWGYEQLGIEPDVFTLAKGLGGGHAIGALLVNQLADVFQPGDHASTFGGNPFACRAALTVGQEIQKRDLLNKVTERGNQLKEGLIKLSNKYSDIFISTRGVGLIQGLVIKDNIKTTSLDIVKSALEEKLLLVSAGVKVLRIVPPLTITKKEINELLSRLDKCLMKLS

SEQ ID NO: 15905 - protein, 369 aa, Hirschfeldia incana
SSNKTLVSPGNVFELGFFRTTSSSRWYLGIWYKKLSNRTYVWVANRDNPLSNSIGTLKISNMNLVLLDHSNKSVWSTSLTRGNERSPVVAELLANGNFVMRDSNNKDASGFLWQSFDFPTDTLLPEMKLGYDLKKGRNRFLTSWRNSDDPSSGEISYQLDTQTGMPEFYLLQSGVRVHRSGPWNGVRFSGMPGDQELNYMVYNFTENNEDVAYTFRMTNNSIYSILKTSSEGFLERLIWTPNSITLTLFWYLPLENQCDMYLICGRYAYCDVNTSPLCNCIQGFIPWNKQQWEMRDPSGGCKRSTRLSCSGDGFTRMKNMKLPETKMAIVDRSIGVKECEKRCLMDCNCTAFANADIRNGGSGCVMWTG

SEQ ID NO: 15906 - protein, 335 aa, Oryza sativa Japonica Group
MAAATTSLLLEATPRLLSLPPRRPVQPRGGIFLLKPPPPPPFPSRRGVAVAVAPPLRASHPDTARRVSVSPAAVEPPPKPRALLDAIKRSLLDSLAALKKPALALLLAGALLAAAGPHHGAALAASGGRVGGSAFSSRSSSPPSSYGYTAPAPRGGYSAAPFYSPSPFVSVGPAVGIGFGGSSFFFVLMGFAAFLYLAGFLSDSSGGSVLTETDKTTVLKLQVGLLGMARSFQKELDQIAEKADTSTPAGLSYVLTETTLALLRHPDCCISAYSSVDVKRSIDDGEKRFNQLSIEERGKFDEETLVNVNSIKRQKAGSQRSSGFSNEYIVVCFFL

SEQ ID NO: 15907 - protein, 380 aa, Hirschfeldia incana
SSNKTLVSPGDVFELGNFKTTTRSSQDGSTDRWYLGIWYKTTSDHRTYVWIANRDNPLHNSIGTLKISHSSNLVLLDQSDTPVWSTNLTGVVKSPATAELLANGNFVLRGSYTIDLDHFMWQSFDFPVDTLLPEMKLGRNLIGPEHEKILTSWKSPTDPSSGDYSLILETEGFLHEFYLFKNEFKVYRTGPWNGVRFNGIPKKMQNWSYIVNNFIDNKEEVAYSFQVNNNHNIHSRFRMSSTGYLQVITWTKTVPQRNMFWSFPEDACDLYQVCGPYAYCDMHTTPMCNCIKGFVPKNAGRWDLRDMSGGCVRSSPLTCGEGDGFMVLGQMKMPETSEAFVEEMIGLEECSQKCVRDCNSTGFAIMDNMNGGSGCVMWTG

SEQ ID NO: 15908 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 15909 - protein, 364 aa, Raphanus raphanistrum subsp. raphanistrum
SSNKTLVSPGGVFEFGFFKLASSSCWYLGIWYKNIPERSYVWVANRDNPLHSSTGTFRISGTNLVLLDQSKNTVWSTNLTRRCVKSPVVAELFDNGNFVMRYSNNSDPSGYLWQSFDFPTDTLLPQMKLGFDLKTGPHRFLRSWRSPDDPASGNYTYKLETRGLPEFFLRSEDFLLYRTGPWNGIRFNGVPEMPRLLDNILTENKEEITYTFRMTNHSIYSKFIITHSGFFQLLTWTPKVQLWNVLWSIPNDQCDLYVLCGPYGYCDTKTSMCNCIKGFKPKGSQAWALGDMSQGCVRKTSLSCGGDGFIRLTKMKLPDTTYAIVDKLVGIKECKKRCLKDCNCTAFANADIRKGGSGCVMWTG

SEQ ID NO: 15910 - protein, 251 aa, Magnaporthe grisea 70-15
MRNIFSVMAVLLPAVSAFCDHGTTLFPRASGDAVKVANFGFDGIRGPLNWHGLNKTANSKCAKGKEQSPIDISTSSNKTVKGSSLRFNIDSYPDGAELLNLGSTLEVIANGSISLDNKTFKLAQFHFHTPNKTVSVVGFFIELDEDNDEVIDGVFERVDEVATPGTAGHTGALDFSGLSKHLCKSDVYQYRGSLTTPPCSEGIRWNVVRKPITIDMLTFKKIKSIMKFNARYVQNTPGQINLLENAAENLK

SEQ ID NO: 15911 - protein, 327 aa, Oryza sativa Japonica Group
MEIHLHLHFLAILVVVPMLGSPAAGGLCRDSCGGIPVRYPLSIDDGCGSPYYRNMLTCADNATLRLRTPSGTYPVVGADYADPHLVVTDPSMWTCERPFTSVRAAPFSLDTSTRFSLSPRNDYLFFDCDEERVIVEPRPAVCDRYPERCDSTCDSAGYLCRNLPGCRGALEENNMSCCAYRPRAAESLRLMLRHCESYTSVYWRAVGDKFPPYDQVPAYGVRVDFEIPVTTRCLQCEDRRRGAGGTCGFDPVTRDFVCICNDARNSTTDCADGPASRYHSSAGVVAASAVFSISAAVGITGLVWYIRKIKSTKVVTCGVQSNENRFF

SEQ ID NO: 15912 - protein, 120 aa, Propionibacterium acnes KPA171202
MTYGQITLTGIRAHANHGVLASERELGQPFSVDVSLDVDMDTVSDDLTQAVNYATVAQRVLNILTREPVSLIETLAGKIADTVLAISPRVHSVQVTVHKPHAPVGVALDDVAVTYRKDAE

SEQ ID NO: 15913 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLIDDYKRTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 15914 - protein, 484 aa, Oryza sativa Japonica Group
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 15915 - protein, 221 aa, Zea mays
MAGPAVLNERILSSMSQKHVAAHPWHDLEIGPGAPEFFNCVVEIPRGSKVKYELDKASGLIKVDRVLYSSVVYPHNYGFIPRTLCEDNDPLDVLILMQEQVVPGCFLRARAIGLMPMIDQGEKDDKIIAVCADDPEFRHYTDITDLPPHRLQEIRRFFEDYKKNENKEVAVNEFLPAKDAINAIKYSMAIICVIRTELTKPVWMLYCRDLYGSYVIESLRK

SEQ ID NO: 15916 - protein, 501 aa, Asparagus officinalis
MTVSITAAVQLFLLLLLLLQLLFVHHKTKPKTKCRSPPGPPPLPVIGNLHQLSLLLHQSLYRLSKIHGPIFKLSLGRVPVLVISSPSLAKQVLKTHDLAFCSRASTVSFKEYTYDGCDVAGAPYGDSWRNLRKIFVLNLLSSKKLTSFRLVQEEEIEGMISSIRTRSDTNATVNITEFVVRLANNITFRVAFGYRSEGEYGEKSRFQRLLESGNDTVASFYVGDYFPGLGWLDKITGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 15917 - protein, 326 aa, Staphylococcus epidermidis RP62A
MKENFWSTLPRPFFILAPMEDVTDIVFRHVVSEAARPDVFFTEFTNTESYCHPEGIHSVRGRLTFSDDEQPMVAHIWGDKPEQFREMSIGLADMGFKGIDLNMGCPVANVAKKGKGSGLILRPETAAEIIQASKAGGLPVSVKTRLGYYDIDEWRDWLKHVFEQDIANLSIHLRTRKEMSKVDAHWELIEAIKTLRDEIAPNTLLTINGDIPDRQTGLELANKYGIDGIMIGRGIFHNPFAFEKEPREHSSKELLGLLRLHLSLFEKYDKDEARHFKSLRRFFKIYVRGIRGASELRHQLMNTQSIAEARELLDTFEARMDARSEV

SEQ ID NO: 15918 - protein, 430 aa, Zea mays
MAMLSRAASSAARRPLLPPPRLLAVRAMASSLFGHVEPAPKDPILGVTEAFLADPSSDKVNVGVGAYRDDNGQPVVLSCVREAERRIAGNLNMEYLPMGGSVKMIEESLKLAYGEDSDFIKDKRIAAVQALSGTGACRLFADFQKRFLPDSQIYIPTPTWSNHHNIWRDAQVPQKTFTYYHPESRGLDFSGLMNEIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKSLWLKEVKGMADRIIGMRKALKENLEKLGSPLSWDHITNQIGMFCYSGMTPEQVDRLTNEYHIYMTRNGRISMAGVTTGNVGYLANAIHEVTKPN

SEQ ID NO: 15919 - protein, 833 aa, Frankia sp. CcI3
MRRKRETGNAGTVAPPSASPARPDPASEANPVGPETPSGPAARSGRGTSSAPGFGPVGGSGLTGPSIEPLDSGDPTELGQFTLLGRLGEGGMGTVFLGRGRPDVAEHAGRLVAVKVIRPDLARVPEFRARFRREADIARRVARFCTAEVLGVVDPPDGRPYLVTEYIDGLTLAQTVAADGPLRSADLERVAVSVAAALTAIHGAGLVHRDLKPSNVLLSALGPRVIDFGIARALDAPTMLSQEIQRIGTPAFMAPEQANGEPVTAAADVFAWGGLVTYAGTGSFPFGDGPTPVQLYRVVHREPLLDGLAPALRPIVEEAMRKDPATRPSAQELFLRLVGMGPTTHPDPEVTRVIRAGVSMPAPPQRTDPDRCAPGQMSAPGGSASSGSVGAGPPVDLSARDRGRWNWRRVALLAAPLLAVLLIAALIPFALTTGSDRRPSREETAARVALAAEAVRNSDANLAARLSLAAYRISPVREARAALRTSFAAATATVLDGHTQSALGVDISRDGRLLASTGADNLVQLWDISARSHPVKLATLARHTSWTLDAAFSPDGRLLATVSYDRSVILWDLGDPRHPVELSVILGHNGWVLDAAFSPDGKVLATSGYDNTARLWDVTDPRRPSQLSVLDRHTSWVNEVAFSPNGHLLATASADRTARLWDVTDPRRPRPLAAITAHTDYVWAVAFSPDGRRLATGAYDGTARIWDITNPSRPAATASFPADEKWVFDVAFSPDGRTLATAGWDTTVHLWDVTEPGRPPAIGTITGHGDWVQALAWTPDSHSIATASDDYTVRISRIGDADLIAAACADPSKQITDAEWQRHISDVPYQPVC

SEQ ID NO: 15920 - protein, 364 aa, Oryza sativa Japonica Group
MAQRSPGPAHRTVTDLSVRPSCLVSPVAVRANGNTHENAEKGARRGRWTFWRQELRRQSCVSIVASQAATVALHYKASKPEQQTTCAAEETSMRWREMGWRPAEEGSSSGTSSTQITCAGGSRRCRRRAQPPYWGSRTPTQRTHGRGMARRAASEWSSSGPTPLALAPAEATTSGERWSAMEAERCLSPALAPNRGCGDVVATRMDVRWCGDSMHRSCPARHLAKQVAGGVLAGLGPGQAQWGSVSLRPRKEGGLQVGISDVFAVPGDLNLTLLNHLISPSPASTSSAAATSSTLASYAADGYARARGVGACAVTFTVRGQLLHGCRHRSHRFWNQVMGDEARKQAPPLGIRSARARLRRCCRW

SEQ ID NO: 15921 - protein, 563 aa, Synechococcus sp. WH 7805
MTYVLDRLADLGIGHVFGVPGDYSFPLNDAVEVHPRLQWVPSANELNAAYAADGYARRRGAGIVCTTYGVGELSALNGVMGAMAERVPVFHLVGTPSVRIVRQGLICHHTLGDTRYDRFEAISAAAGCVSARLTPENVVVELERVIDKALEDSRPAYLTVPMDLALMPITGTPIQGTPMGAVDQHASVAVELEAVLDLVMGRLAEAARPLVMPTVTLKRFGLVETFAAFLEASGLAYATTPMDKSLLSEGHPAFLGMYNGARSTPAALQGVVEDADLLIDFGGLVMEDLNTGLWSGHLDASRVISLHADWVQAGDQVFTSVSISEVLAGLIKRFQATGSRPSHWGEQRPVQPEPLLPLRGEGDQPTGSASFYGRLQRFLRPTDLLVTDTGTCMLKLNAMRLPDGVAIESQTLWGSIGWATPAALGCALADSERRVVLVTGDGAHQLTVQEIGVMGFTGAKPVVIVLNNGLYGVEALLSETGHAYNDLPPWRYAQLPEAFGCQGWWSGRVSTVAELEQALVAINAHDGGAYLEVMIPPEESQPLAETLIETMHQTATPHPEAAE

SEQ ID NO: 15922 - protein, 451 aa, Mycobacterium sp. JLS
MARDAAEVEVMAKQLKEDGVRFSIAAYTDLHGNIKGKMVPIDHFVQMAGGSELFTGAALDGLPQDVSDEELSAHPDLDRGFVLPWRKDIALFLSDLYVGGEPFEASTRNILGRQMKAAEELGYVFNLGVETEFFVLEDGPVGPSALSERDTLEKPCYAVPMLLDNFGWLQELVDYMNELGWDVYSFDHEDAQGQFEIDFAYADGLSMADRVSFFRLMANEVARRHGAYVSFMPKPFADRTGSGAHFNMSLAGLDDGHNVFESADDPRAAGLSDIGYHFAAGIVRHAAAICAVIAPTVNSYKRLVRQGSMSGSTWAPIFASCGNNNRTNMLRIPLGGGRVECRAVDSAANPHLAAALLLAAGLEGVREQLELEHFHTDNLYEVDAGEYEKRGLSLLPRTLEEAVDAFEADPFTKQVCGEKLWQSFIDYKRSEWTSYATAVTDWERDRYLKFF

SEQ ID NO: 15923 - protein, 489 aa, Montrouziera sphaeroidea
GLGVSALETKNLGRIAQIIGPVLDVAFPPGKMPNIYNALVVKGRDTVGQEIDVTCEVQQLLGNNRVRAVAMSATDGLMRGMEVIDTGAPLSVPVGGATLGRIFNVLGEPVDDLGPVDARTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEEHYETAQRVKQTLQRYKELQDIIAILGLDELSEDDRLTVARARKIERFLSQPFFVAEVFTGSPGKYVGLAETIRGFKLILSGELDSLPEQAFYLVGNIDEATAKATNLEMEKNLK

SEQ ID NO: 15924 - protein, 173 aa, Zea mays
MYPLEMEGNSNPKTTNKPKYSKFTQQELPACKPLLTPEIVIAAFALIGALFVPIGLASLHASRQVVELVHRYDASCVPVDDKVGFIQNSRTDKTCTITMTVPKYMKSPIHVHYLIDGFYQNHRRYVRSRSDKQLRYKSAAHLTSDCVPEGDTADHAPIVPCGLVAWSLFNDTY

SEQ ID NO: 15925 - protein, 489 aa, Acalypha insulana
GPGVSALEKKNLGRIAQIIGPVLDVAFPPGKMPNIYNALVVKGRDTVGQEINVTCEVQQLLGNNRVRAVAMSATDGLMRGMEVVDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLSETIRGFKLILSGELDSLPEQAFYLVGNIDEVTAKATNLEMENNLK

SEQ ID NO: 15926 - protein, 465 aa, Candidatus Protochlamydia amoebophila UWE25
MVEHYDLAVVGAGPGGYVAAIRAAQMGLKTICIDKRETLGGTCLNVGCIPSKTLLHSTDLYSTLKQHGLEQAIEVSDLKVNFTKLMERKRNVVKGLIEGIALLFKKNGVIYLKGEAQFLDAHTLQVKNGTHIDEIKANYILLATGSESTSLPHLPFDEKNIVSSTGALNLATVPPRLLVIGGGVIGVELASVYNRLGSSVTIIEMSDRLCPAMDIALSKYLFQILKKQGIEIKLSTKMMTAVLQPNETILTIEQNEQLQNISGEVVLVAVGRRPYTQGLALDKVGIQIDKKGFIPVDGFFRTSQPHIFAIGDLIEGVMLAHRASQEGITVVEWLKGERQSINYLAIPNVVYTNPEVASVGLTEQEASESGLTLLTGTTYFRGNSRARCTDEIEGFVKLIGEKKSGRLLGMHIIGAHASELIAVGTLAIQKQINLKDLAETVQAHPTLSETIKEAALQALGKAVHG

SEQ ID NO: 15927 - protein, 440 aa, Ashbya gossypii ATCC 10895
MAKRRHKNRTHVKPSEEELKQIPKSMVIRVGQTSLSNHSLNQLVKDFRMIMQPHTAVRLKERKSNKLKDFVVMCGPLGVSHLFIFTQSEKTGNVSLKVARTPQGPTVTFQVLDYSLGKDIKRFLKHPKSLGKDDILNPPLLVLNGFDIKNEDEGRANVEKVVVSMFQNIFPPLNPARTQLSSIRRVFMINKDQETGELSLRHYAIDIRQVDISRNLKRLYRSKNKLNKSVPNLHKKDDIASLILDHDVGAYTSESEVDDDAIVRIIDQRDTRVAAKEPVAANGEEDGDVDMEDAQDDDVEEPALEDDTPQPKKRAIKLTEVGPRLTLKLVKIEEGICSGKVLHHEYVQKTDAEIRALEKRHAQKLKLKEQRRKEQEENIARKKAVKDAKKQRKLERRKLRETAPEGEKPAESSADDSSSEDDYSDVPEDLDSDLFSEVDN

SEQ ID NO: 15928 - protein, 404 aa, Candidatus Protochlamydia amoebophila UWE25
MPSQSGTCKHFKTGLQNMRTDIKVPSMGESITEVMIGQILVTNETFVKTDAEILELETDKVNQVLFAPKTGVITLSVQTGDRVKIGALIGFIEEESQIEKNVPQKEDKEISAEILEQKDSITSSKPSFETVEKDALGTLRLTKESYLSDLQIEELSPSQIAQDLEQTAKTFERQETRQPLSKIRQVIANRLIEAQQTMAMLTTFNEVDLSEIISLREKHQEIFIKKYGIKLGFMSFFVKAVVSALKAFPTVNSYLDQQDIVERHYYDIGIAVGTERGTFVPVVRQCDQQSFAQIELAIDLFAKKARDGKIAMDDLQGGGFTITNGGVYGSLLSTPILNPPQCAILGMHKIEKRPVVMEDQIVIRPMMYLALSYDHRLIDGKESVAFLVHIKNALEDPSRLLLNL

SEQ ID NO: 15929 - protein, 177 aa, Physcomitrella patens subsp. patens
KKKNKEEVKKELLDAIAPLDRGAEASDEEIDRVDKIARELEALNPTKEPLKSPLLNGKWKLIYTTSASILKKNRPNLLRPNGAIYQAINADTLRAQNLQTWPFFNQVTANLDPVNSKKVIVNFDFFKIAGLISVKAPGRARGELEITYLDEELRVSRGDKGNLFVLIMDDPSYRVPV

SEQ ID NO: 15930 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKTVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 15931 - protein, 198 aa, Streptococcus pneumoniae
GIEDILVVTGKSKRSIEDHFDSNFELEYNLKEKGKTDLLKLVDEATGMRLHFIRQTHPRGLGDAILQAKAFVGNEPFVVMLGDDLMDITDEKAVPLTKQLMNDYEKTHASTIAVMPVPHEDVSSYGVIAPQDEGSNGLYSVETFVEKPAPEETPSDLAIIGRYLLTPEIFEILEKQAPGAGNEIQLTDAIDTLNKTQR

SEQ ID NO: 15932 - protein, 446 aa, Oryza sativa Indica Group
MAAPPATASAPSLRPSAASPRAAAARSVAVPSGPRTVVPRRDGGRFLGVRAAKAVSGVQSGTVVDDGVQRPWKLSDARLVLEDGSVWKAKSFGASGTQVGEVVFNTSLTGYQEILTDPSYAGQFVLMTNPHIGNTGVNPDDEESNRCFLAGLIIRNLSICTSNWRCTETLEEYLMKRNIMGIYDVDTRAITRRLREDGSLIGVLSTDQSRTDDELLEMAKNWKIVGVDLISGVTCDAPYEWSDKTDSEWEFKKGQSTESFHVVAYDFGIKHNILRRLTSYGCKITVVPANWPASEVLNLRPDGVFFSNGPGDPAAVPYAVKTVQEIIGKVPVFGICMGHQLIGQALGGKTFKMKFGHHGGNHPVCDLRSGRVDISAQNHNYAVDPESLPEGVKVTHINLNDNSCAGLQYPKMKLLSLQYHPESSPGPHDSDLAFGEFIEMMKNNRL

SEQ ID NO: 15933 - protein, 475 aa, Oryza sativa Japonica Group
MAFHVFLIAALLLLPLPAAFSKAVRTQSLLANPLSPDPITQEQQLSLAAPRTNASTLHFRLAHREHFALNATASDLLAHLLARDAARAAALLAAPNNATRPRRRGGFAAPLLSGLPQGSGEYFAQVGVGTPATTALMVLDTGSDVVWLQCAPCRHCYAQSGRVFDPRRSRSYAAVDCVAPICRRLDSAGCDRRRNSCLYQVAYGDGSVTAGDFASETLTFARGARVQRVAIGCGHDNEGLFIAASGLLGLGRGRLSFPSQIARSFGRSFSYCLVDRTSSVRPSSTRSSTVTFGAGAVAAAAGASFTPMGRNPRMATFYYVHLLGFSVGGARVKGVSQSDLRLNPTTGRGGVILDSGTSVTRLARPVYEAVRDAFRAAAVGLRVSPGGFSLFDTCYNLSGRRVVKVPTVSMHLAGGASVALPPENYLIPVDTSGTFCFAMAGTDGGVSIIGNIQQQGFRVVFDGDAQRVGFVPKSC

SEQ ID NO: 15934 - protein, 198 aa, Streptococcus pneumoniae
GIEDILVVTGKSKRSIEDHFDSNFELEYNLKEKGKTDLLKLVEEATGMRLHFIRQTHPRGLGDAILQAKAFVGNEPFVVMLGDDLMDITDEKAVPLTKQLMNDYEKTHASTIAVMPVPHEDVSSYGVIAPQDEGSNGLYSVETFVEKPAPEETPSDLAIIGRYLLTPEIFEILEKQAPGAGNEIQLTDAIDTLNKTQR

SEQ ID NO: 15935 - protein, 213 aa, Opitutaceae bacterium TAV2
MLRAFRGGIGLAVISIMKIKTAVFEKSAPNLATSPVWGCREFAFIGRSNVGKSSLLNLLTEQKDLAKVSATPGKTRMINFFKINNAWSLVDLPGYGFAKVAQHKRSDFNQAVARYLEKRDNLACVFVLIDSRLPPQQIDLDFIQWLEGTGRPFALIFTKTDKQSPTQTRAKISLFTEALAEWRTEPPPILTSSSKTKSGRREILEFIAGMLAS

SEQ ID NO: 15936 - protein, 399 aa, Bacillus anthracis str. Sterne
MYWNDGNEGSEYRMISHLFQTYGRRTVEFVKGNGTKVIDNNGKQYLDFTSGIGVCNLGHCHPTVMKAVQEQLNDIWHISNLFTNSLQEEVASLLTENIALDYVFFCNSGAEANEAALKLARKHTGKSLVVTCEQSFHGRTFGTMSATGQNKVKEGFGPLLPSFLHTPFNDIKALKEVMNEEVAAVMVEVVQGEGGVIPADLSFLKEIETLCKKFGSLFIIDEVQTGIGRTGTLFAYEQMGIDPHIVTTAKALGNGIPVGAMIGRKELGTSFTAGSHGSTFGGNYVAMAAAKEVLQVSKRLSFLKEVQEKGEYVLQKLQEELQHVECIQNIRGKGLMVGIECTHEVASFIEQLEKEGLLVLQAGPNVIRLLPPLIVTNEELEQAVYMIKKVVCTKNVSII

SEQ ID NO: 15937 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDEKAVPLTKQLMNDYEKTHASTIAVMPVPHEDVSSYGVIAPQDEGKDGLYSVETFVEKPAPEETPSDLAIIGRYLLTPEIFEILEKQAPGAGNEIQLTDAIDTLNKTQR

SEQ ID NO: 15938 - protein, 713 aa, Opitutaceae bacterium TAV2
MPNSRSNNSKNNGTGPPSSKSSPLNAMPDAADTAAHLPPVASPPAHPPARFPIHFSSMHPPAETSAFATPAAPSSPARPRLLPGIQSPSDVKGLAFGQLPQLAQEIRDEIIAVTSRNGGHVGPNLGVVELCLALHRVFDTPRDSFVFDVAHQGYIHKLLTGRGGEFFRNLRQTGGASGFLSRAESEHDAFGAGHAGTALSAALGMATARDLRGGDEHVVALCGDAAFTCGVTLEALNNTVSSTKRLIVILNDNEWSIARNVGAMARYLNRLSTHPTYNKIHGDLEKFFTSLPGGPDMHRLWMKWKRETKDFFVESSLFEKFGLRYLGPINGHNLEELIKNLEFAKSCDVPVLVHVHTKKGLGLEVAMKSPEKFHGATPYDPTTGANLRPAGGGRPAYQEIFGQALLRFARADKRIVGITGAMPSGTGLSLLATELPGQFFDVGIAEEHAVIFAAGLATKGIRPVVAIYSTFLQRGYDQIIHDVALQNLPVTFCMDRAGLSPNDGPTHHGLFDLAWLRCVPNAVVMQPKDEDELVDMLHTSLQLKGPGFIRYPRGAGTGATIKETPALLPVGQAEVLREGTQIMIWALGNRVSDALAVAARLEAEEGVSAGVVNARFVKPLDRALLLNHAGRIRLLVTMEDHVLAGGFGSAVLEALQEGACREAGGGGIPAVERIGWPDQFIEHGSSAESLREAHGLSPGAIYQRVLDRWRGLS

SEQ ID NO: 15939 - protein, 141 aa, Brassica napus
MRKRERENPCSLCGHYHKYEEGEVCGICGHRMPDPSDVPAPQVHVSAFPSEILPDFLFLGSYDNASRSELLKTQGISRILNTVPMCQNLYRNSFTYHGLSDEKVLQFDDAIKFLDQCEKDKARVLVHCMSGKSRSPAVVIA

SEQ ID NO: 15940 - protein, 142 aa, Dehalococcoides sp. CBDB1
MERTLLLVKPDGVNRGLSGEILGRMEKLGLKLIGLRMLQMDAVLADKHYAPHRARPFFKDLVTYITSGPITAAVFEGENAVEKMRKAMGATDPAKSEKGTVRGDLGINIEQNTVHGSDSAENAKHEISLFFSESELVNYDRR

SEQ ID NO: 15941 - protein, 364 aa, Mycoplasma mycoides subsp. mycoides SC str. PG1
MSKKMNSTPKKDGFWMPGEWEKHDQCWMIWPERSDNWRLGAKPAQRVFVNVANAIAKYEKVTMLVSHQQFENARNLLDQNVRVIEMSNDDSWMRDVGPTIVKNKDGEIRGVDWVFNAWEGFKGGLYFPWDKDDAIARKVCEICNIDYYRTDFVLEGGSIHTDGDGTLYTTEECLLNENRNPDLTKEQIEENLKEYCGVEKVIWLPLGVYNDETNGHVDNLLNVVSPGHVVLTWTDDTTDPQYERSKLAYDILTNTLDAKGRKIKVTKLHQPGPLFITKEEAEGIDVCDTMSREPEQRMPASYANYYIANNAIILPIFGDKYDDLAVKTLQSVYPNHKIETVMAREILLGGGNIHCITQQQPTTK

SEQ ID NO: 15942 - protein, 365 aa, Mycoplasma mycoides subsp. mycoides SC str. PG1
MNKVRHFIDTQDLSKKEIFEIFRLMKMLKEARYCGAVPELLKNKTLAMIFEEPSTRTRVSFEAAMTLLGGHAQYLKPGELHLGVRESLYDTTKVLSHMCDGIMCRALKNETVLNLAKYADVPVLNGLTDYNHPTQAICDVFTMLEYMPATKNLEYEDIKFEDIKVVFIGDRTNVCSSTMHITTKLGMNFVHISPKRYQSPQEWIDIANENIKQANSGSVLVTDDLEQVRGADIVYTDLWWWVDQEDEAEERVKAFKPTYQVTPELMEKAGKQALFMHCLPASRNVEVYDEVIDSDQSIAFEQAENRLTAQMGLLVYYLYPQIDKSSNAVKDYYRGKVEAFMEHQDRSWKQRYTYNNDYAETKNKK

SEQ ID NO: 15943 - protein, 457 aa, Agrobacterium tumefaciens str. C58
MLSNSLIELDRAHLVHPVSSFRGHEKLGVRVLKSASGATVTDMTGHQLIDGFAGLWCVNAGYGHDSIVEAAAKQMRELPYATAYFDIGSEPAIRLASELADRAPGDLNHVYFTLGGSDAVDSTIRFIRYYWHAKGQPQRDQFISIEQGYHGSTTAGSGLTALPAFHAGFGVPYDWQHKIPSHYAYRNPAGSDPAAIIASSLQILKDKIEAIGPDRVAAFYAEPIQGSGGVLVPPPGWIKAMRELCSSYGILFVADEVITGFGRTGPLFACADEDIVPDFITAAKGLTSGYVPMGAVFMADHVYDTIADFAGEAAIGHGYTYSAHPVSAAVGLEVLKLYEGGLLENGRRAGQRLMAGLEGLRNHPLVGDVRGRGMLAAIELVTDKDKKTPLPAAAAPARKVFDRAWENGLIVRAFANGILGYAPPLCCTDGEIDAIVERTLKTLDQTLEDPAVRAAMA

SEQ ID NO: 15944 - protein, 521 aa, Bordetella petrii
MANYLPSSPAWLAFSQAAKSASRGGERLRIIEAAGLRVDLTAQPQSDSLDNAAQDLLAQQNFDAARAQLYDGGEANWTERRPAWHTALRADNPPPAVAQDILAERERVRRFVRELDQSLAYDCVLHLGIGGSDWGPRMVTRALRHGGLRRNIQFASNVDSHAVADAIGQLDPRRTLVIVASKSFTTTEPLANAEVAMNWLRDAGVADPIKHVVAVTANVDAALDFGISPDRVFRFWDWVGGRYSLWSAIGLPIALALGNEALDQLLAGAAAMDQHFLQAPLRKNAPLQMALAGLANRSVLGYATLAITPYDSRLMHLVPWAQQLEMESLGKVASRDGTPVGVPTGPVVWGMPGTDCQHTFFQWLHQDTTGAPVDFIVCERPDHAYARHHNMLIANCLAQRSALLRGKSYEDILQEIREHEPDLQRAEVLARHRVHPGGRPSNLIVLPRLDAYSLGALLALYEHKVFAQGVLWGINPFDQWGVEFGKLLAKRIIRELDAPSADTSGDQDPSTRYWIDSLSRR

SEQ ID NO: 15945 - protein, 641 aa, Oryza sativa Japonica Group
MHARCAFRLTRLRREPDAEPGRAGKQGKSVCAAKVHEGGAGAGDAQMGTYKCCIFFTRRFALSDASTPGDVRMLFTRHAGGAPYMGIDELRRYLAASGEAHVDADTAERIIDRVLQERSRTPRFGKPSLTIDDFQYFLFSEDLNPPICHSKEVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 15946 - protein, 769 aa, Chlamydomonas reinhardtii
MSQGHRDAGAAACRTIIVTNHCPPIMRKRDIWRVDQFHLLRKVGSGYASTVYLGTCRTSGNQVAVKLYHKQKLSELNHFQVAREITIHSSLDHKNIIQLWAAFEDQYGIYLVFEYASKGDVFTEVERRGGQLDEAETVRAVVYPFLSALDYLHSRCIIHRDIKPENLLFTATGVLKVADFGLSINFSQERPVTRVGTLDYMAPEVVVCPDKHRPQDHKELKHLHYTPLVDAWAVGVLAYELIVGRPPFDKGQKKATIAEILNSEPFIPPWLSEGATHFIRWSLTKEVGKRPSVQQLAEHPWIVSHMKQSVLAPARRQLVKTDSFVEPRQLGFRGSNAPGAGEPSGPSKEPPRPLQVSSVAQGGRFLGHSSSMSAMDGMRYRDIHLDSVTGGMASAATEALKSVKRVSDGDGTTGGRPSAAGGRVSRAGTARNSGTGQAPLSRMNSMSAQAVVAAAAAAMASGSFGGAAHGSEDSPKGGRALTREELYASLTAPLGGRGSPVLARSFTAGRASPAPQQMAPLPTNAGRKSGGGGLGSGRSSLSGQATGAPPSRGAAELAHDLSRLRVDSAASGGGGAAGPSTSASGAVPYSPGKGSSGIRPSPPQAPSPTARGLRTGSPLIPSRLSQSFTSPVSPLAAGSNASAGTPHLSRLGKTSNSGIVPAVATANTPGSARPPAGMDAHSSAASSAAAAGAQSSPHQPAAAAAGSSLTVSTTPASPGGSSGYGQTRASPRELPGERDPELEDSEVEDEPETERSPSKSKSLFKKIFS

SEQ ID NO: 15947 - protein, 589 aa, Citrus sinensis
MDTANAMGSTGQPGSAPAPVRGGASVGTLGRHLARRLVEIGAKDVFSVPGDFNLTLLDHLIAEPELNLVGCCNELNAGYAADGYARSRGVGACVVTFTVGGLSVLNAIAGAYSENLPVICIVGGPNSNDYGTNRILHHTIGLPDFTQELRCFQAITCSQAVVNNLGDAHELIDTAISTALKESKPVYISISCNLPGIPHPTFARDPVPFFLAPKVSNQLGLEAAVEATADFLNKAVKPVLVGGPNIRVAKAQKAFIELADATGYPIAIMPSGKGLVPEHHPHFIGTYWGAVSSSFCGEIVESADAYVFVGPIFNDYSSVGYSLLIKKEKAIIVQPHRVTVGNGPSLGWVFMADFLSALAKKLRKNTTALENYRRIYVPPGIPVKRAQNEPLRVNVLFKHIQDMLSGDTAVIAETGDSWFNCQKLRLPENCGYEFQMQYGSIGWSVGATLGYAQAAKDKRVIACIGDGSFQVTAQEISTMIRCGQRSIIFLINNGGYTIEVEIHDGPYNVIKNWDYTGLVNAIHNGEGKCWTAKVRSEDELTEAMKAATGEQKDSLCFIEVFVHKDDTSKELLEWGSRVSAANSRPPNPQ

SEQ ID NO: 15948 - protein, 235 aa, Brassica napus
MGSGEWHVEKRSTLRNDSFVKESGSAPETGCLSIVVLGASGDLAKKKTFPALFNLYRQGFLNPDEVHIFGYARTKLSDEELRDRIRGYLVDQKNADALSKFLQLIKYVSGPYDSEEGFQRLDRAISEHEISKRSSEGSSRRLFYLALPPSVYPSVCKMIKTCCMNKSDLGGWTRIVVEKPFGKDLDSAEQLSSQIGELFDESQIYRIDHYLGKELVQNMLVLRFANRFFLPLLET

SEQ ID NO: 15949 - protein, 445 aa, Oryza sativa Indica Group
MEAGRKLAARHPHGRSRTAHNMSSSSLRKKSDAALVRKVPVAPLRPLLANLQEVFLATKLAVLFPAVPLAIAAQCFRFDQVWVFALSLLGLIPLAERVSFLTEQIALYTGPTVGGLLNATCGNATELIIALFALLKGKIEVVKCSLLGSVLSNLLLVLGTSLFCGGVVNLGARQPYDRNQSDVSTALLFLAVLCHSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGTIEPTSQSWGLSVSFISIILLPIVGNAAEHAGAIIFALKNKLDITLGVALGSATQISMFVVPLSVLVAWIMGVQMDLDFKLLETGSLFMAVLVTAFTLQDGTSHYLKGILLLLCYIVIGACFFVARQPAGHANSNGALLDVPTGSMSVQAA

SEQ ID NO: 15950 - protein, 341 aa, Bordetella petrii
MTDRYQRIQQELRQAPRKWLVTGCAGFIGSNLLETLLKLDQTVVGLDNFATGHRHNLDEVRNSVEPAQWARFTFVEGDIRDLAACQRAAEGVDHVLHQAALGSVPRSLNDPITTNDVNIGGFLNMLVAARDAKVKTFVYAASSSTYGDHPGLPKVEDTIGKPLSPYAVTKYVNELYADVFARSYGLASVGLRYFNVFGKRQDPEGAYAAVIPKWTAAMIRGDDVVINGDGETSRDFCFVENAVQANLLGALAPEEGVNQVYNVAYGGRTTLNQLYKFLAQTLGGEGVRYDKPPVYADFRAGDVRHSQADIAKGGKLLGYQPAYDILRGLQTAMPWYIRFLR

SEQ ID NO: 15951 - protein, 424 aa, Bordetella petrii
MRIDEVKLAVVGLGYVGLPLAVEFGKKRPVIGFDINVKRIDALKAGHDHTLEVDDAELAEAKHLTYTADRAELAKANVYIVTVPTPIDDYKQPDLTPLVKASETIGAVLKRGDIVIYESTVYPGATEEDCVPVLERVSGLKFNEDFYAGYSPERINPGDKAHRVNTIKKVTSGSTPEVADLVDTLYNEIITAGTHKASSIRVAEAAKVIENTQRDVNIALINELALIFNKMGIDTEAVLQAAGTKWNFLPFRPGLVGGHCIGVDPYYLTHKAQAIGYHPEIILAGRRLNDSMGSYVVSQLVKCMTKQRIHVQGARVLVMGLTFKENCPDLRNTRVVDIVNELGEYNVDVDVYDPWVDPEEARHEYDITPVAQPEAGKYDAIILAVSHHQFVEMGAAAIRKLGKAQHVLYDLKYVLSSDESDLRL

SEQ ID NO: 15952 - protein, 157 aa, Apium graveolens
ILGFWILDVANNMMQGPCRALLADMSGHNHKKTRTANSYYSFFMAVGNVLGYAAGSYTDLYKVFPFTKTKACDVYCVNLKTCFIFAIILLLVLTTAAMTLVKERPLVLSHQSNADQDEEDEEEVSMPFFGQILSALGNLSRSMWMLIVVTSLNWIAW

SEQ ID NO: 15953 - protein, 462 aa, Trichodesmium erythraeum IMS101
MTLPDGPSLSPLQRRLRTWKFIFSPLSAIEERYSEYGDIFRTNTNSLYPFIYFCNPKAIQQIFTADPDTFTSGSINGILKYFVGLNSLLLQDGDRHKRQRKLLMPPFHGDRMRKYGDLIYNITSNVISQWKIEQPFPIRKSTQEISLKVILAAVFGLDQEGKSYEKLRVLMSDLLDSMSSPLSSTFLFFNFLRKDWGPWSPWGRFLRKKQELHELIIAEIQTAKKEGNHRDDILSLLLEARDEAGNAMSDEEIKDELLTMLFAGHETTASALAWALYWIDMIPSVGEKLMAELATIPSNSDQVAITKLPYLSAICQETLRIYPIAMNAFPRVVQKPIEIMGYQLEPGMVAIVPIYLTHHREDIYPEPKKFKPERFLERQFSPYEYLPFGGGSRRCIGSAFALFEMKLVLATILSQWELKLLPNQRISPVRRGLTMAPPANMRMVVKPKKSWQKVSQPILTSG

SEQ ID NO: 15954 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDENAVPLTKQLMNDYEKTHASTIAVMPVPHEDVSSYGVIAPQGEGINGLYSVETFVEKPAPEDAPSDLAIIGRYLLTPEIFDILEKQAPGAGNEIQLTDAIDTLNKTQR

SEQ ID NO: 15955 - protein, 371 aa, Oryza sativa Japonica Group
MASGISRTPATGVTAGGGDDEEAAWLHALELISGFTVSMTLKAAIQLGLIDALTAAADGRALTAGELVAQLPAVDDAEAATSVDRMLRLLASFNVVRCSTEAGPGGDPLRRYSPAPVCRWFTAGDNHQGSLAPRLMLDVDEDNLSTWHQMAAAVVSGGPSAFERAHGMPLFEYMGTNHRFNMLFNQAMSQQSMMVMNKLLDRFHGFDGISVLVDVGGGTGVTLKMIISRYKHITGVNFDLPHVISQAPSLPGVNHVAGNMFESVPKGDAIFLKSMLLRNDEECIKILKNCHYALSDNGKVIVVDIVLPETPKPVPEAQNPLRMDVMMLNNLRGGKIRTEQEYAKLAMDSGFSGSFRTTYIFANFMAIELCK

SEQ ID NO: 15956 - protein, 322 aa, Caulobacter crescentus CB15
MSRPPAIDTRPASAPPAVPAQRPGDVIAYLVLVHRYPAQFKRLFRAIHDPDNYYLVHVDKNSGPALQAEIRDFLAAYPNAAVLESKKALWGGYSLVDAELRGMETLLEMGRDWDFFINLSGQDFPLMTQKRIRAFLAQNRGREFIRVLDQARMRPDTMGRVLQHVVELKGRIVDTLVTRLFLDGATPYIGTQWKIVSRAFCDFVCHDPSVDRYKAFYRNTFIADEGFFQTVMMNTDVHGEIINDDKRLIDWIPDGDIKLRPRTFVAADVVQLTAGADLFARKFDMQEDSEILDLLEAHLRTQDAANVAVTPEMIGARLLEEA

SEQ ID NO: 15957 - protein, 235 aa, Nicotiana tabacum
MDSDKEGTKGGTKTPIADSDSEIEHEPVGEKNVSRQMSESSLYTTEDEEEDETNNKIELGPQCTLKEQFEKDKDDESLRRWKEQLLGSVDINSVGESLDPDVKILSLEIKSPGRPDIVLPIPEDGKPHSPWFTLKEGSKYSLKFSFQVSNNIVTGLKYTNTVWKTGIKVDSTKQMIGAFSPQLEPYTHEMPEDTTPSGMFARGSYSARTKFLDDDNKCYLEINYTFEIKKEWQAT

SEQ ID NO: 15958 - protein, 175 aa, Triticum aestivum
MATAEAGEKKMIMLKSADGEEFEVEEAVTMESRTIRHMIEDDCADKGIPIPNINSKVLSKVIEYCNKHVLAKTVDVSSGATCATASDTMAPAALAEDLKIWDAEFINVDPDTLFDLIKAASYLNIKGLLDLTCQTAADMISGKPPEEIRNFFNIQNDYLPEEEEKIRRENPWAFQ

SEQ ID NO: 15959 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDENAVPLTKQLMNDYERTHASTIAVMPVPHEDVSAYGVIAPQGEGINGLYSVETFVEKPAPEDAPSDLAIIGRYLLTPEIFEILEKQAPGAGNEIQLTDAIDTLNKTQR

SEQ ID NO: 15960 - protein, 525 aa, Cucumis melo
MASSMAAVGVLRLPTSSSSSSSSSNGGTNRARRTSLRSLSFGASQISGDKIDFRGFGLGSRRVSGGRVAPSIVSPKAVSDSKNSQTCLDPDASRSVLGIILGGGAGTRLYPLTKKRAKAAVPLGANYRKIDIPVSNCLNSNISKIYVLTQFNSASLNRHLSRAYAVIWWLQNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPVPDFTFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGENVKIVNGDNVQEAARETDGYFIKSGIVTVIKDALIPSGTII

SEQ ID NO: 15961 - protein, 504 aa, Xanthomonas axonopodis pv. citri str. 306
MTQTNGFDALHAHAQRLRGAAIPALLAAEPERPTQYARQVGPLYFNFARQKYDRAALDALFAIARERDLSGAFQRLFRGEQVNVTEQRAALHTALRGDLTDAPVASEAYATAEEVRQRMGSLIQQLEATDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHTALMANVLAQTEALANGQDSSDPHRSYPGGRPSTVILLDALTPQALGALISMYEHSVYVQSVMWGINAFDQFGVELGKQLASQLLPALKGESVDVADPVTRELLNKLRG

SEQ ID NO: 15962 - protein, 437 aa, Nostoc punctiforme PCC 73102
MKKDVFRDAQRSKIGVLVTTHACNPWVSPIPNSQFPIPNTQYPIHSQGNMESLTSRMQDVQSPIIPVVGELIKNSPGTISLGQGVVHYNPPPEAIEFLSKFLADPANNLYKSVEGIPPLLTAIAGKLQAFNGIEINGENCIVVTAGSNMGFMNAILAITNPGDEIILNTPYYFNHEMAIAIAGCRAVLVATDENYQLRPEAIAQAITPKTRAIVTISPNNPTGVVYSEAALRQVNQICDTHRIYHISDEAYQYFTYNGVKHVSPGAFGKSKYTISLFSLSKAYGFASWRIGYMVIPKHLFVAIKKVQDTILICPPVISQYAALGALQAKEEYLQSNIGAIFQVRQLVLDSLNRLEGLCSITPANGAFYFFLKVNTQMDAFELVKRLIQEHKVAVIPGTTFGMDDGCYLRVAYGALQKETAKEGIERLVQGLETIVRS

SEQ ID NO: 15963 - protein, 505 aa, Vinca major
MAIVDFLAAFLIFILTQKLIQTLFRRTYRRKLPPGPKGWPVIGALPYLGTMPHTSLAYMAKKYGPVMYLKVGTNDMVVVSTPDAARAFLKTLDINFSNRPPNAGATHLAYGAQDMVFAHYGPKWKLLRKLSNLHMRGGKALEDWSNVRISELGHMLETMYESSKKGEAVVVAEMLTYAMANMIGQVILSRRVFVTKGSDSNEFKDMVVELMTSAGLFNIGDFIPSIAWMDLQGIEGGMKRLHKKFDVLLTKLLEEHKESSSKRKGKPDLLDYVLANRDNSEGERLTTTNIKALLLNLFSAGTDTSSSIIEWALSEMLRNPSILKRAQHEMVQVIGRNRRLVESDISRLPYLQAICKETFRKHPSTPLNLPRIATEACEVNGYYIPKGTRLSVNIWAIGRDPDVWENPLEFNPDRFLSGKNAKIDPRGNDFELIPFGAGRRICAGTRMGILLVEYILGTLVHSFDWNLPSSVTKLNMDESFGLALQKVVPLAALVTPRLPINAYSP

SEQ ID NO: 15964 - protein, 525 aa, Cucumis melo
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 15965 - protein, 258 aa, Dehalococcoides sp. CBDB1
MSSLAEAPIQDPGFDSEEAHKRKQYMVDLFVVQAKNYDFHDDVFGLYAHRFWMRTVLKIIGKFMKGRTSTKMLDLACGTGFVTFNTARNFENIDIDSFDISPDMLAVAKERYEKYFKGRSIKFWQGDAEVPFGENKYDLITTSFAYRNFANKGLATENVFRALKPGGLFIIQDLTKPEHHPMRGLYIFYMKYVLPLFTSILGTEKSAARWLYKSAMMMPTNGQIAKLMESKGFEKCQYKSLSLGIACVIWGFKPEKSE

SEQ ID NO: 15966 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITNDKAIPLTKQLMNDYEKTHASTIAVMPVPHEDVSSYGVIAPQGEGINGLYSVETFVEKPAPEEAPSDLAIIGRYLLTPEIFEILENQAPGAGNEIQLTDAIDTLNKTQR

SEQ ID NO: 15967 - protein, 255 aa, Dehalococcoides sp. CBDB1
MSSINVSVKDPGFESEEAQARKRYMLQLFGFQAKHYDLHDDIMGMGIHRRWGKEMVLEILTYTRNMPQVKMLDLACGTGFVTFNTLRYMKNVDIDAFDITPEMVEVAKGRLKKNFADRSVKFWVGDAEIPYGDAKYDVIGTCFAFRNFANKNLAAANIFKALKPGGLLVLQDMTKPEKQPMRGIYLFALKNLMPVMARIIGTEKKSARYLANSVLAMPSNAEITAILQNQGFINIKSRYQSGGMGTLTVAYKPES

SEQ ID NO: 15968 - protein, 518 aa, Cucumis melo
MHKISSQEKNQCFGFWGDSSLGRNGRWKQIQRNASSRNNSDSSSSSRARSLHPELLILFSCSEVNEETTTLQAPIFEAPRADPKKVASIILGGGAGTRLFPLTSQRAKPAVPIGGCYRLIDIPMSNCINSGIEKISSNAVNSFSLNRHLARIYNFGNGVNFGDGFVEVLAATQTSGETGKKWFQGTADAVRPFIWLFEDAQTKNVEHTLILSGDHLYRMDYMDFVQRHIDTNADITVSCIPMDDSRASDYGLMKIDDTGRIIHFSEKPKGSDLEEMQVDTAVLGLSDEDARKNPYIASMGVYIFRTDLLLKLLTWSYPACNDFGSEIIPAAVKDYKVQAYLFNDYWEDIGTVKSFFDANLALTEQPPKFEFYDPKTPFYTSPRSCPPSKVEKCRIVDAIISHGCFLRECTVEPLIVGVRSRLEYGVELKDTMMMGAYYYQTESEIASLLAEGKIPIGIGENTKIRNCIIDKNAKIGRNVVIANTDDVQEADRPEEGFYIRSGITVTLKNATIKDGTII

SEQ ID NO: 15969 - protein, 205 aa, Triticum aestivum
PRVRLARKFIKECWGKCGCGKQCGNRVIQRGITCNLQVFFTNEGKGWGLRTLDGLPKGAFICELVGEVLTSSELYERKAKNSKHVDQVLLDASWGSEGVLRDEEALCLDLTFYGNVGRFVNHRCYDANLVIIPVEVETPDRHYYHLALFTAKKIEAFEELTRDYGIDFDGTDDLNKAFDCMCGSKYCRGGPKNSRKRTRASASRN

SEQ ID NO: 15970 - protein, 135 aa, Brassica napus
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPGAC

SEQ ID NO: 15971 - protein, 494 aa, Citrus sinensis
MVLSKTFSESDESIHSTFASRYVRNSLPRFTMPENSIPKEAAYQIINDELMLDGNPRLNLASFVTTWMEPECDKLMMAAINKNYVDMDEYPVTTELQNRCVNIIARLFNAPLEDSETAVGVGTVGSSEAIMLAGLAFKRKWQNKRKAEGKPFDKPNIVTGANVQVCWEKFARYFEVELKEVKLSEGYYVMDPAKAVEMVDENTICVAAILGSTLNGEFEDVKLLNDLLTEKNKETGWDTPIHVDAASGGFIAPFLYPELEWDFRLPLVKSINVSGHKYGLVYAGIGWVVWRNKEDLPEELIFHINYLGADQPTFTLNFSKGSSQVIAQYYQLIRLGFEGYRNVMENCHENAMVLKEGLEKTGRFNIVSKDEGVPLVAFSLKDNKRHDEFEVAELLRRFGWIVPAYTMPADAQHITVLRVVIREDFSRTLAERLVLDITKVLHELDSLPSKVLVPASEQNGRNGKKTEIETQREVTTYWRKFVSERKANNKNKIC

SEQ ID NO: 15972 - protein, 559 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIASGGGRMNVTMDRYENDWSVVKRGWDAQVLGEAPYKFTNALEAVKKLRAEPKANDQYLPPFVIVDESGKPVGPIVDGDAVVTFNFRADRMTMIAKALEYENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLIEVVDN

SEQ ID NO: 15973 - protein, 463 aa, Lactobacillus acidophilus NCFM
MGKKNKVPQLSRSMTAGQMEMISLGGAIGVGLFMGSTSTIKWTGPSVLLAYMFVGLILYIVMRALGEMLYINPGTGSFADYATEYVHPLAGYLAEWANVFEYIVVGMSEVVAATEYLKYWWPNISALWSGVIIIAFLLLANLASAKAYASLEFWFAMIKVITIILMIILGFIVIFFGVGNGGKPIGFSNLWAHGGFFTGGVKGFFFSMSIIVGSYEGIELLGISAGEVANPQKAIVKSVKSVLLRILIFYVGAIFVIVTIYPWNKLSSLGSPFVTTFAKVGITAAASIINFVVLTAALSGANSGIYSSSRMLFKLSHDNEAPSVFKHISKRIVPDRAIMGISGGIFIGFILNIIASQFNHSASDLFVIVFSSSVLPGMIPWFVILLAELRFRRHNQDMMKDHPFKLPLYPFSNYFAFLMLLVIVIFMFINPDTRISVITGALVLIVATIVYLVRHKDEFSKNN

SEQ ID NO: 15974 - protein, 473 aa, Citrus sinensis
MAGLTLVYDLVLYISISTVIFFIIKRSRSRRLRLPPGSLGLPFLGETLQLIAAYKTENPEPFIDVRVKRFGSIFTTHIFGEPTVFSADPETNRFILQNEGKSFECSYPGSVSNLLGKHSLLLMKGSLHKRMHSLTMTFANSSIIRDHLLVVIDRLVRLHMDSWTDRVLLMEEAKKITFELTVKQLMSFDPNEWTESLRKEYVLVIEGFFTVPLPIFSTTYRRAIQARTKVAEALSLVVRQRRKESEPGERKNDMLEALLAGDDGFSDEEIVDFLVALLVAGYETTSTIMTLAVKFLTETPLALAQLKEEHDEIRAKKSKQEPLEWNDYKSMPFTQCVVNETLRVANIISGVFRRAMTDINIKGYTIPKGWRVFASFRAVHLDHDHFKDARSFNPWRWQNNSGATSPVNVSTSFGGGPRLCPGYELARVELSVFLHHLVTRFSWVPAEQDKLVFFPTTRTQKRNPIIVQRRNEN

SEQ ID NO: 15975 - protein, 205 aa, Chlamydomonas reinhardtii
MVDLTRPIVWFYLPVTITWICFVISVGNPQYFIDYNWLWLLFRSMSPYFWSALGVALAVGMSILGAAWGIFITGSSLVGAAIRVPRITSKNLISVIFCEAVAIYGVIVAIILQTKIERVDPVDGVYDKYALAAGYSIFGSGVTCGFANLVCGMCVGIVGSSCALSDAQNSTLFVKILVVEIFGSALGLFGVIIGIIMSGGVKWAA

SEQ ID NO: 15976 - protein, 270 aa, Corynebacterium glutamicum ATCC 13032
MTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 15977 - protein, 366 aa, Pseudomonas syringae pv. tomato str. DC3000
MGFNCGIVGLPNVGKSTLFNALTKSGIAAENFPFCTIEPNTGIVPMPDPRLAALAAIVNPKRILPTTMEFVDIAGLVAGASKGEGLGNKFLANIRETDAIAHVVRCFEDENVIHVSNSVDPKRDIEIIDLELIFADLDSCEKQLQKVTRNAKGGDKDAVVQKGLLEQLIAHFSEGKPARSLMKSMSNDDKAVIRGFHLLTTKPVMYIANVAEDGFENNPLLDVVRAIAEEEGAMLVPVCNKIEAEIAELDDGEEKDMFLEALGLEEPGLNRVIRAGYEMLHLQTYFTAGVEEVRAWTVRVGATAPQAAGVIHTDFEKGFIRAEVVAYDDFIQFKGEAGAKEAGKWRLEGKEYIVKDGDVMHFRFNV

SEQ ID NO: 15978 - protein, 572 aa, Oryza sativa Indica Group
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKDMSKFWSVCWNLRDALSSECHGLMIETLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPELVFFLCSEDVFLCFRLVSTQKLIDLSMQVVGAWCKHMCVS

SEQ ID NO: 15979 - protein, 313 aa, Pseudomonas syringae pv. tomato str. DC3000
MSKMMVFTGNANPDLARRVVRQLHIPLGDVSVGKFSDGEISTEINENVRGKDVFIIQPTCAPTNDNLMELVVMADAFRRSSASRITAVIPYFGYARQDRRPRSARVAISAKVVADMLTVVGIDRVLTVDLHADQIQGFFDIPVDNIYGSPVLVDDIEDQRFENLMIVSPDIGGVVRARAVAKSLGVDLGIIDKRREKANHSEVMHIIGDVEGRTCILVDDMVDTAGTLCHAAKALKEHGAAKVFAYCTHPVLSGRAIENIENSVLDELVVTNTIPLSAAAQACSRIRQLDIAPVVAEAVRRISNEESISAMFR

SEQ ID NO: 15980 - protein, 441 aa, Bordetella petrii
MNAPTGLPDLSHLWMPFTANRQFKSQPRMLAGAKGMYYTSVDGRQILDGTSGLWCVNAGHCREEIVQAIARQAGSLDYAPGFQLGHPLAFEAASAVAGLMPQGMDRIFFTNSGSESVDTALKIALAYHRARGDAQRTRLIGRERGYHGVGFGGISVGGISPNRKTFSGALLPAVDHLPHTHSLEHNAFSKGQPAWGAHLADDLERIVALHDPSTIAAVIVEPMAGSTGVLVPPQGYLERLREITAKYGILLIFDEVITGYGRLGAATASEFFGVTPDLITMAKGISNAAVPAGAVAVRREVHDAIVNGAQGGIEFFHGYTYSAHPLAAAAILATLDLYRREQLFTRARTLAPAFEAAAHTLKGAPNVIDVRNIGLVAGIELAPRDGAPGARAAEAFQKCFDSGLMVRYTGDTLAVSPPLIIEESQIAEMFQSIGKVLKEIA

SEQ ID NO: 15981 - protein, 811 aa, Zea mays
MLLILVFLLSFSSLDLQISGATTDTLTLGQSLPWNQTLVSKGGNFELGLFSPGNSKKHYIGIWFKKVSKQTVVWVANRDSPILDPSASRFTLSNRGELLLHATPSNTLLWSSNASSPSPRTTVATLQDDGNLVVRSNASSALVAWQSFDHPTDTWLPGARLGYDRARGVHSFLTSWTDADNPAPGAFSMEIDPRGQAKFDLLAGGTHQYWTTGVWDGEVFENVPEMRSGYFEGVTYAPNASVNFFSYKNRVPGIGNFVLETNGQMQRRQWSPEAGKWILFCSEPHDGCDVYGSCGPFGVCSNTSSAMCECPTAFAPRSREEWKLGNTASGCVRRTKLDCPNDGFLKLPYAVQLPGGSAEAAGAPRSDKMCALSCLRDCSCTAYAYEAAKCLVWNGELVSLRTLPNDQGVAGAVVLHVRVAASEVPPSAAHHSWRKSMVILSSSVSAVVLLLAGLIIVVAVAVVVRKRRGKGKVTAVQGSLLLFDYQAVKAAARDFTEKLGSGSFGSVYKGTLPDTTPVAIKKLDGLRQGEKQFRAEVVTLGMIQHINLVRLRGFCSEGNKRALVYDYMPNGSLDAHLFKNSSGSKVLSWSQRFGIAVGVARGLSYLHEKCRECIIHCDIKPENILLDEEMGAKVADFGMAKLVGHDFSRVLTTMRGTMGYLAPEWLAGAPVTAKADVYSFGLLLFELISGRRNNGSSEAGSNSAVYFPVHAAVRLHAGDVAGLLDDKIAGDANAKELERVCMVACWCIQDEEGDRPTMGLVVQQLEGVADVGLPPIPSRLHMLAMMNKCAVGGEAEVEPCSNSGSKIDTEV

SEQ ID NO: 15982 - protein, 495 aa, Bordetella petrii
MKKLTHFIAGQACEGRSGRYAEGFNPATGEVSSSIPLASPAEVDAAVAAARAAFPAWSEMPALKRARILFNFKTLLDKHQDELAALITAEHGKVFSDAKGEVVRGIEVVEFACAAPQLLKGQYTDQIGGGIDNWSMRQPLGVVAGITPFNFPMMVPCWMFPVALACGNTFILKPSERDPSVSLRLAELLTEAGLPDGVFNVVQGDKQAVDALIAHPDVEALSFVGSTPIAEYIYAEGTRRGKRVQALGGAKNHMVVMPDANLDQVTDALIGAAYGSAGERCMAISVAVAVGEVADTLIERLTPRVRALVIKNGMEADAEMGPLVTAQHRAKVVGYIEDGVAAGAKLVVDGREQAFAGKGFFLGGTLFDQVTPQMNIYREEIFGPVLCVVRVPDFAAAVELINAHEFANGVACFTSDGGIARAFARQIKVGMVGINVPIPVPMAWHSFGGWKRSLFGDHHAYGEEGVRFYTRYKSVMQRWPDSIDKGAEFTMPVAK

SEQ ID NO: 15983 - protein, 463 aa, Corynebacterium glutamicum ATCC 13032
MSVLIVGMSHRSAPVSLLERLSMDDSVRGETTQALLGRASLSEALIVSTCNRLEVYTVTSSFHTGVNDVVEVLHEASGVDIETLRGYLYVRYADAAAEHMLVVTSGLDSMVLGEQQIIGQVRTAYQAANEYGSVGPALHSLTQTALHTGKRVHSETAIDDAGASMVSFAVDRALVQMGLDSEAEAPLSGKTALVLGAGAMSSLAATHLGRAGISNLIMANRTLERAERLAEHSLEAGVPAEVVEYDQRASAYNRVDLVVSATGADDFTVKPEDIPEGASLMLVDLSMPRDIDDACADLPGVDLVNIERLHKASREGGSGMAPSEEEALAIVREELDSFTSEQRIRDIVPAVSALRRQAASVGSDELDRLRQRAPGISEVEWGEVEKTVRRVVDKLLHEPTVRVKELAARSGSISYDSALQELFGLESLASTAAPATTSVNASELPDAGIVAFVNAPSATQTRE

SEQ ID NO: 15984 - protein, 427 aa, Magnaporthe grisea 70-15
MTGSTEYATGATADPEVGYPKGHLGHLTDSETKALSEFKVLVTENGLYTPGPPPSHDDQTLLRFLRARRWVPQDAFKQFKETEEWRSTTRLDTLYDTIELDSYEQSRVMYPQWTGRRDKRGIPVYLFEIKQLDSKAVAAYEKGADDTYSRAHADGSTPPKLLRLFALYENLTRFAQPLCTEMPDRPHPQTPITLSTNIVDVSGVSLRQFWNLKAHMQAASTLATAHYPETLDRIFVIGAPFFFSTVWGWIKRWFDPITVSKIFILSQAEVLPVLSSFMEVENIPKQYGGKLEFKWCDQPNLDPAIKERATWEQGFDNFPKGPVLWKVLDEERLECVAVGSVNQKQRNIRVCTLPRSFKGVVSSNQPYHKTEAAAAASDIAAVETGVQKLDIQEAKSDSEAVTSSKEEIIAEKGASSVDAPAASAKAA

SEQ ID NO: 15985 - protein, 502 aa, Bacillus clausii KSM-K16
MINKLQLPLQTMNLVLGFMVWVIISALLPFIQEDIAIPADRVAILTAIPVVLGSVLRIPLGYYANVVGARMVFITSFILLLFPVYFISIATSFTHLVVGGLFLGIGGAVFSVGVTSLPKYHLKEKLGLVNGIYGMGNLGTAITTFAAPVIATQIGWSATVQLYLILLLVFVALNAVFGDRKETKVKTPIMEQVKGVYKNDKLWYFSLFYFITFGSFVAFTVYLPNFLVSHFELPKVDAGLRTAGFILIATFLRPVGGWLADKFKPLFLLMGVFIGMTLAAVVLAFSPSLALYTVGCLTIAVCAGLGNGIIFKLVPFYFNKQAGIVNGIVSMMGGLGGFFPPLMLSFIHSVTGQYSIGFMALSQVALASFVLVVWMYYQDKLTVASQVFNSTGQGILVTDAKKRIHAVNPAFTRLTGYEEEEVLGRNPNLLKSGRQSSAFYQIMWTEIMEKGSWQGEIWNRRKNGEEYLELLTINAVKDETGDIVHYVGTFSDITDHPPRKHA

SEQ ID NO: 15986 - protein, 324 aa, Pseudomonas aeruginosa PAO1
MSRIFADNAQSIGNTPLVQINRIAPRGVTILAKIEGRNPGYSVKCRIGANMIWDAEASGRLKSGMTLVEPTSGNTGIGLAFVAAARGYKLILTMPASMSLERRKVLKALGAELVLTEPAKGMKGAIQKAEELVAGDPGKYFMPQQFDNPANPAIHEKTTGPEIWNDTEGAVDVLVSGVGTGGTLTGVSRYIKNTRGKPILAVAVEPVTSPVISQTLAGEEVKPAPHKIQGIGAGFVPKNLDLSLVDRVEKIGDDEAKNMALRLMQEEGILCGISSGAAMAAAVRLAEEPNMQGKTIVVILPDSGERYLSSMLFDGLFSEQELTQ

SEQ ID NO: 15987 - protein, 443 aa, Rhodobacter capsulatus
MTTSQFRPGVHPGRLPPEGYCTAFADVAPPLTAHQAQVAAARCYFCAEAPCTTACPSDIDVPLFIRQILTGTPEAAARTILSQNIMGGMCARVCPTETLCEGACVREAAEGMPVEIGALQRFATDRLQAAGVHPFTRAPRTEKSVAVVGAGPAGLACAHRLAMLGHEVTVYDARLKPGGLNEYGIAAYKAPGGFAAREVAWLLQIGGIAVLENWKLGRNGSVADLLAEHDAVFLGMGLAGVNALTIPGAEHATPATEFIAHLRQAGDLATVPVGRRVVVIGGGMTAVDAAVQAKLLGAETASIVYRRSQAEMPASAHEQEHAQKNGVRIVPNAAPVAIRKDDQGYEVEFARTETQGGKLVQLDDTLRIKADQIFTAIGQTLGPVPEGLTITGGKIEIDAQGRTGMAHVWAGGDCATGGEDLTVTAVAQGRDAAEDIHAFLMGA

SEQ ID NO: 15988 - protein, 444 aa, Propionibacterium acnes KPA171202
MTVDHAEQGLGVVSEAAAQVDGLGLALTDHPQIRGALVLSTCNRVCLIVETSPEAVAQGFDEAALRRCIADHGANVLAESAQLVCENDAVWRLFRVAAGMESMVFGEREVAGQMKRALSEARREQTVSYTIGHVVEEALKTSRHVATETALAAEGRTVVAVGLDLVAQRMDLDGARVLVMGTGSYAGASCAQLSSRGVAEIQVHSASGRAAGFARRHRVSEALDIDAALAQADLVVTCRGSGVPALSAEAARRAVDARRGRDLMVLDLAISGDVEEPVPAGVEVIDLETIRQAVPASAEAERAAAEHIIATGVRHFAVDLERRRMAPAVVALRDVISDLVTAELERLPEEGSVPVDEVAASLRRLAASMAHIPSARARMASEQGLGDRWLNSLSDVLGIDVDIAAPVIDMSSFANADCMTCPVTGLRVEDLATDAAPRGEERTS

SEQ ID NO: 15989 - protein, 282 aa, Oryza sativa
MAGGGQAAASLLTKLAQAAAGLGIAASAASTALYTVDGGQRAVVFDRFRGVLPETSSEGTHFIVPWLQKPFIFDIRTRPHSFSSTSGTKDLQMVSLTLRVLARPDIDRLPDIFTSLGLEYDEKVLPSIGNEVLKAVVAQFNADQLLTERPHVSALVRDSLIRRAAEFNIVLDDVAITHLAYGPEFSQAVEKKQVAQQEAERSRFLVARAEQERRAAIVRAEGESEAARLISEATAAAGTGQIELRRIEAAKEIAGELARSPNVSYIPAGDSSQMLLGLSGAR

SEQ ID NO: 15990 - protein, 177 aa, Agrobacterium tumefaciens str. C58
MRIDAISIGKNPPDDINVIVEVPVGGHPIKYEMDKDAGALIVDRFLYTPMTYPGNYGFVPHTLSDDGDPIDVLICNTRPLVPGCVINVRPIGVMIMEDDGGKDEKILAVPAPKLTQRYDKVHNYTDLPEITLKQIEHFFEHYKDLEPGKWVKMGGWQDVDVAKKLIVEAIERYKTQG

SEQ ID NO: 15991 - protein, 447 aa, Streptococcus pyogenes MGAS8232
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCVCTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMVGPAGAWMVSIGALISITGLNMGESIMVPRYGAAIADEGLLPAAIAKQNQNGAPLVAILVSGAIAIVLLLTGSFENLAKLSVVFRFFQYIPTALAVMKLRKDAPDANVIFRVPFGPIIPILAVIVSLVMIWGDNPMNFVYGAVGVIIASSVYYLMHGRNHQMDQMPPEEQI

SEQ ID NO: 15992 - protein, 225 aa, Zea mays
MSEAAVRVIGLWPSPFVIRVLIALKLKHVEYEFVEEVVGSKSELLLASNPVHKKIPVLLHHGKPLSESLIIVQYIDEVWSSGAPAAILPADPYARAVQRFWAQYVDDKMHPAIRVLKGTYDGDKEQAAGQLSAALQLLEEAFAQLGQGKRYFGGDSVGYLDIALVSHVGWVKAVEKIAGVTLLDEAKVPNLVAWADRLCAHPAVVDAIPDADKFVEFSVTYGSFS

SEQ ID NO: 15993 - protein, 251 aa, Mycoplasma mycoides subsp. mycoides SC str. PG1
MITIKNQEQIQKMKIAGQVLAKGLNLLKSMIKPGVNCLDLDKAFEEFIKQNGCESNFKNYQGFPKTICISINDQLIHGIPKNRILQNGDIVSIDAGCMYQKWHADSAFTMVCGIANNKKNDILIRVTEKALDLAIAELKPGIRVGTIGSIIQNYVESHNFSVSRDYTGHGIGLALHEDPYIPNYGIPNTGVRLQENMVICIEPMVQMGTYKTKLADDNWTVYSADHSMTAHFEHTILITKDGCEVLTKEER

SEQ ID NO: 15994 - protein, 246 aa, Zea mays
MSEEDKTAASAEQPKRAPKLNERILSSLSRRSVAAHPWHDLEIGPDAPAVFNVVSTSITLEPFDVLYVWCCGEWGLRLSGTIYGKVVEITKGSKVKYELDKKTGLIKVDRVLYSSVVYPHNYGFVPRTLCEDNDPLDVLVLMQEPVIPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 15995 - protein, 453 aa, Staphylococcus epidermidis RP62A
MNDTDRTHKENKLEQDITLPYLKKAVIFSITFGFFGVNMAFALQSAMMGRIFQTLGANPNNLGWFFILPPLVGMIVQPLIGYYSDRTWTRFGRRMPYLLIAGPIGAIVLVLLPNAGSFNFGYASLMALSFGAVMTLLMDLTSNACMQPYKMIIGDMVNEKQRDMAWSWQQIFSNLGGIIATVLPFLLTMLGMSNVAPKGEVPMTVKLAYYIAAAVLLIASIWTVISVREYEPKTYNYYHGINEKNRNNKLNLLQLLKKAPKQFWQISVVQFFNWFALMYLWTYSTGAIAKNVWNVTDPSSAGYQAAGNWYGVLYCIQFLSSVIFGFVIARSKPSQRKFWYSFGLLFGGIGLISIFFIHNQWLLIFSFILIGINNLTMNTQPFTLLTEAIDGENSGAYLGLFNTSICLPQIVASIVSFGLYPLLGSSMPAMLLLAGIMMLLGAVSVKFINAKFE

SEQ ID NO: 15996 - protein, 425 aa, Pseudomonas syringae pv. tomato str. DC3000
MAFLALGINHKTASVDVRERVAFTPEQLVDALQQLCHLTESREAAILSTCNRSELYIEHEHLGADSILAWLANYHHLSLEELRASAYVHEDDAAVRHMMRVASGLDSLVLGEPQILGQMKSAYAVAREAGTVGPLLGRLFQATFSAAKQVRTDTAIGENPVSVAFAAVSLAKQIFSDLQRSQALLIGAGETITLVARHLHDLGVKRIVVANRTLERASILAAEFGAHAVLLSDIPAELVNSDIVISSTASQLPILGKGAVESALKLRKHKPIFMVDIAVPRDIEPEVGELDDVYLYSVDDLHEVVAENLKSRQGAALAAEQLVSVGAEDFMSRLRELAAVDVLRAYRQQSERLRDEELSKAQRMLANGSNAEDVLIQLARGLTNKLLHAPSVQLKKLSAEGRVDALAMAQELFALGEGSTDKTPQ

SEQ ID NO: 15997 - protein, 488 aa, Lactobacillus acidophilus NCFM
MKTLEKVNYKGFIWPLAVGIVLWLITPWRPGGLSVQAWEMFAIFVATIVGCITKPLPIGGTTLLGMVVTVLVGLAPVKDVVNSKGVVIQTGILSSFGNSAAWLIAMAFIMAHGISKTGLGNRVAYVMIEKFGKRSIGIGYAITGLELMMGALIPSNSARTGGVTWPVVESISKSYDSKPNDPSRKKIGAYLDFMAFHANILSTALFITGAAPNLVAQQMAAQKGYQMSWVSWFWAALVPVLVATVIIPLVIYKMYPPEVKETPNAKNWADDKLKEMGPISKPEKIMATVFCLAILLWVLSGFFKIPQLDSAFVAFLAVTLLLITGVLSMEDALHETGAWNILIWLSILIFMAGKLISYGFIAWFAKFIQSEVHGINWGLVLVVLILLMFYTHYFFASGTAHMTALYLPFLTVATAMGAPLGLSAMLLAFTGVINASTTHYANGPASILATTGYVKQSEWWKMNFILGLIYMVIFGIVGTIWMKIIGIW

SEQ ID NO: 15998 - protein, 489 aa, Sacoglottis sp. Hammel 18390
DPGVSAFEKKNLGRIAQIIGPVLDVAFPPGKMPNIYNALVVKGRDTVGQQINVTCEVQQLLGNNRVRAVAMSATDGLMRGMEVIDTGAPLNVPVGGATLGRIFNVLGEPVDDLGPVDARTTSPIHRSAPSFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 15999 - protein, 237 aa, Chlamydomonas reinhardtii
MIGTAVPVFLALIAGITAPYGRYVRSGWGIFLNARVAWLTQEIPSLIVFVVMLFLQHPLSARTVLSGAFCAHYVYRSIVFPFIIRGGKPTPLSVWAMSFVFCIWNGFIQGWCFARQMTSDTPVWNPRVMVGLAVWLFGWLNVMRADLILINLRKPGESGYKIPHGGMFNFVSAGNYASEICEWSGFALAAGTLPAAAFAMFAFCNLSPRGHHHHRWYREKFKGEYPASRRAVIPFVW

SEQ ID NO: 16000 - protein, 264 aa, Glycine max
  misc_feature (109)..(109): Xaa can be any naturally occurring amino acid
MDSLVESGWQYLVSNFSDFQLACIGSFIVHETVFFLSGLPYILLERTGLLSNYKIQTKHNTPEAQGKCIAWLLFYHSCVNFPLMMFSYRVFKFMGMQSSFPLPSWYYYXKVVSAQILFFFIIEDFVFYWGHRILHTKWLYKNVHSVHHEYATPFGLTSEYAHPAEILFLGFATFIGPALTGPHLITLWLWLVLRVIETVEAHCGYHFPWSPSNFLPLYGGADFHDYHHRLLYTKSGNYSSTFVYMDWIFGTDKGYRKLKALKET

SEQ ID NO: 16001 - protein, 489 aa, Cratoxylum cochinchinense
GLGVSALEKKKLGYITQIIGPVLDIAFPPRKMPNIYNALVVKGRDTIGQEINVTCEVQQLLGNNRVRAVAMSATDGLMRGMEVIDTGSPLSVPVGGATLGRIFNVLGEPIDDLGLVDTRTTSPIHRSAPAFIQLDTKLSIFETGIKVVDLLAPYRRGGKIGLFGGAGVGKTVLIMELINNIAKAHGGVSVFAGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPKIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 16002 - protein, 396 aa, Candida glabrata CBS 138
MTYVASTTAPVNIATLKYWGKRDAKLNLPTNSSISVTLAQEDLRTLTSAATSSEFKEDKLWLNGKEESLSSERTQNCLADLRALRRQLEEKDSSLPPMSQWKLHIVSENNFPTAAGLASSAAGFAALVMAIAKLYELPQSASDISKIARKGSGSACRSLFGGYVAWEMGEKADGSDSKAVEVAPLEHWPNMKAAVLVVSADKKDTPSTSGMQLTVNTSDLFKERITNVVPKRFEAMKKAILDKDFPTFAELTMKDSNSFHATCLDSFPPIFYINDTSKKIIKLCHLINEFYGETIVAYTYDAGPNSVLYYLEENEEKLFAFIYTLFSKVDGWQSKYNSEELSKFTSTFNNQVKGKFQFDLDDTIQENVSRVILTRVGPGPQDTKECLINEETGLPK

SEQ ID NO: 16003 - protein, 137 aa, Glycine max
MDHDKTGCQAPPEGPILCINNCGFFGSAATMNMCSKCHKDMLLKQEQAKLAASSIGNIMNGSSSSTEKEPVVAAAAANVDIPVIPVEPKTVSVQPLFGSGPEGSGEAKLKDGPKRCSSCNKRVGLTGFNCRCGDLFC

SEQ ID NO: 16004 - protein, 379 aa, Triticum aestivum
  misc_feature (237)..(237): Xaa can be any naturally occurring amino acid
  misc_feature (253)..(253): Xaa can be any naturally occurring amino acid
MAQPSAAARKPSAAPTVVLTLVLALASASLLFLLVHLSPSSPSAHPHPHRRLRLRGAHLRHGGATPHQIPFDPVIADLEHRLDDREWERLAAAGLHAPGMESAPVPEDLADYEDEYINDAARFNMTLRVAALFPKIDVDPADDAVTGAELAAWNLASARREVLHRTARELDLHDRDHDGRVAFSEYERPSWAWRFDDNNSTSDGMGWWKEGHFNAADMDGDGFLNLTEFNNFLHPAXYYQPKANTLVVQRRSXRERDKDNDGKLNFQEFYNGLFYSVRHYDDETSTDDSNGSDAPARKSFSQLDLDNDGLLSADELKPIIGKLHPAENFYAKQQADYVISQADTNKDGQLSLNEMIENPYVFYSALFTEDDYGSHDELR

SEQ ID NO: 16005 - protein, 246 aa, Medicago truncatula
MIAAATATDMLWLCNSKPSARVMVLSCQAGEKAVSCGVTNADSIDELSDIKDLHLRTVEELGVDRDVISKHLEELEQLLKGIAMMKELTPRTQDYLVSFGECMSTRIFAAYLNKIGVKARQYDAFEIGFITTDDFTNADILEATYPAVAKRLHSDWVSDPAIPIVTGFLGKARKSCVRTTLGRGGSDLTATTIGKALGLQEIQVWKDVDGVLTCDPNICPQAQPVPYLTFDEAAELAYFGAQAFVE

SEQ ID NO: 16006 - protein, 1065 aa, Bacillus cereus G9241
MDKKVSGIPQPKTYGPLGNLPLIDKDKPTLSFIKIAEEYGPIFQIQTLSDTIIVVSGHELVAEVCDETRFDKSIEGALAKVRAFAGDGLFTSETHEPNWKKAHNILMPTFSQRAMKDYHAMMVDIAVQLVQKWARLNPNENVDVPGDMTRLTLDTIGLCGFNYRFNSFYRETSHPFITSMTRALDEAMHQLQRLDIEDKLMWRTKRQFQHDIQSMFSLVDNIIAERKSSGNQEENDLLSRMLNVKDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKNHETKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSKRGEADASGDFEEQLEQWKQSMWSDAMKAFGLELNKNMEKERSTLSLQFVSRLGGSPLARTYEAVYASILENRELQTSSSERSTRHIEVSLPEGATYKEGDHLGVLPINSEKNVNRILKRFGLNGKDQVILSASGRSVNHIPLDSPVRLYDLLSYSVEVQEAATRAQIREMVTFTVCPPHKKELESLLEEGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDEREGLISLHTAFSRLEGHPKTYVQHVIKEDRIHLISLLDNGAHLYICGDGSKMAPDVEDTLCQAYQEIHEVSEQEARNWLDRVQDEGRYGKDVWAGI

SEQ ID NO: 16007 - protein, 199 aa, Arabidopsis thaliana
  misc_feature (158)..(158): Xaa can be any naturally occurring amino acid
  misc_feature (167)..(167): Xaa can be any naturally occurring amino acid
  misc_feature (178)..(178): Xaa can be any naturally occurring amino acid
SPPPPPVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTEYVLTPKVIIGLLVGDMLPYWFSAMTMKSVGXSAALKMVEXVRRQFNTIPGXLMEGTAKPDYATHGGILFKYF

SEQ ID NO: 16008 - protein, 147 aa, Medicago truncatula
MATQVGYVKSVFPVATTRKISHCQSSLLPCRIGYTARVSHVPLVKKVSSDAVRISCCSNNARESDFGAEKLEETEKSYSVVMKFGGSSVANAVRMKEIANLILSFPEERPIIVLSAMGKTTNKLLLGRCRYINNLIKSLYISYCYSK

SEQ ID NO: 16009 - protein, 43 aa, Glycine max
NNNILHLNIEVSRKVNWLCTTSADTDNLVVCDTSKVVKVYSIT

SEQ ID NO: 16010 - protein, 345 aa, Triticum aestivum
  misc_feature (67)..(67): Xaa can be any naturally occurring amino acid
  misc_feature (108)..(108): Xaa can be any naturally occurring amino acid
  misc_feature (116)..(116): Xaa can be any naturally occurring amino acid
MPNVKSAAGAGAIPAGSSGGDGEVEAGFAKLQGEDFEYYMQTYSIMLGRNSKKSTVDVDLSSLGGGXMNISRHHARIFYDFQRRRFALDVIGKNGCLVEGVLHLPGNXPVKLDSQXDLLQIGDKKFYFLLPTRSIFASFAARQAPVIPPQIPPLAYARPGHPRVSDFHDRFSEGDYGRDSDDIGNGVGEGGMKGKLKRTKKSPGDLDIYGGHRINVEAIGTLGEDNRSEIRSRGDKDVDNQHLQTEEKEVVSSVATVLSDLCGPGEWMPMKTLHTELMDQFGNVWHHSRVRKYLTADDWSVIEAKGRPWYGLLGLLRKYPEHFVINTKSKGRAISEFVSLVSLLS

SEQ ID NO: 16011 - protein, 312 aa, Escherichia coli
FGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNK

SEQ ID NO: 16012 - protein, 666 aa, uncultured marine bacterium 583
MEFDANLIAPALGVLGLLIVFFIYQWIKKQPGGSGAVQKIGEQIHIGSIVFMKREYKMLSMFALVLLVLLYIFLGPASALCFLVGAVASATAGYIGMNTATIANVRTAQAAHEEGSAAALTVAFFGGSVMGLSVAALGLLGLGGLYYFFGEAHSEALHGFAMGASVVALFSRVGGGIFTKSADVGADLVGKLEAGIPEDDPRNPAVIADNVGDNVGDIAGMGSDIFESYCGSMIATIAIASTLSVVALDKLGNQSELMFLPLALASLGLVCSVIGIVFVKMSSNKSPESALRMGTIGSALLFIITSYFLINQLEVSNSIWAAVLMGSVGGIIIGLVTEYYTAGKPIRDIAESGKTGAATVMIKGLAIGMQSVVIPVLMICLIIYVANLFVGLYGVGIAAIGMLATVGMTMAIDAYGPIADNAGGIAEMSGLGEETRKITDSLDELGNTTAAIGKGFAIGAAALAALAIITAYTETVSANSTDFILKLNSAEVLIGLFIGGTIPFLIAALTMTAVGDAAFEMIEEVRRQFKEIKGLLEGTAEPDTAKCIDIATTAALKKMILPGVIAVSAPVLVGFLISPEALGGMLAGALLGCVLMALMMANAGGAWDNAKKHVEKGNFGGKGTDVHTATVVGDTVGDPFKDTSGPSMNILINVMAIVSLVIAPLL

SEQ ID NO: 16013 - protein, 616 aa, Glycine max
  misc_feature (530)..(530): Xaa can be any naturally occurring amino acid
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKXAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 16014 - protein, 520 aa, Coprinopsis cinerea okayama7#130
MTRTINCAQLLLRYKLNMVLSSLVDTVRAASSSLASSLTESVTAPKKDPVILKLGPNPTIHEITAPVLDWSTTPLAPDYDGSYVKILDDVFEPWECDKLIALAESDAEWKQAAVHYGLRPDQNYVNTDYRNSERILRFDHDAAEKLYERLLPYVQELLEIKPGDKWEGVVGPPGRVQGTWKLVGLNERLSFLRYGKGNYFRGHCDGQQKLPDGRMSRVTIQIYLGNDDVEGGSTRFTGNAGRVYDVMPKKGRVLIFQQRNLFHSGEDVISGTKYALRSDFMFRQHLDDHPDEVSAPLLDWSTTGLGDEYDGCYAKIIDNVFTPEECAALVALAESGSKWEKAAVHYGMGPGESYVDTSYRNSERILRFDKDAAEKIYQRLLPYVPEIVEIKPGGRWQGIIKDRWFGIEGSWKLIGLNERLSFMRYGPGHFFKEHCDTHVHLPSPDGRKSWVTVQVYLEDEGVEGGATRFHAEDNGRFFDVAPKKGRVLIFQQEKLLHSGANVVKGLKYNMRSDFMFTQCS

SEQ ID NO: 16015 - protein, 81 aa, Zea mays
MSDKGRPLPKFGEWDVNDPASAEGFTVIFNKARDEKKTGGKPGSPGKSTDGHAKSGGGGGDPSKPQPKKWLCCMQSPAVDS

SEQ ID NO: 16016 - protein, 347 aa, Coprinopsis cinerea okayama7#130
MLALNLPNIKLLGVSTTHGNASSYYTALNAARCLFAFGAKPGEIYVYPGADKPLILPAKHDPEIHGVDGLGGVEGLPALDDPRVLQFFKVDEDGKRVRALEAMSGIIRQTWNGGKGEKVTVVSTGPMTNIALFVSVYPDLLDAVEEFVFMGGAVGMGNRSAVAEYNIMCDPHAAQIVLDVPVKKTMVPINVTHTAIVTRDVHRRLLSPHTPAVSHSSSPDEPLPNPTTLNLRHTLSTLISFFAAAYKSTFGFDDGPPLHDALTIAYISKPELFKATRYRVDVELTGTHSLGETVVDIWRYKKCDESWGRTGRNCLVADFLNVPGFFNLLLEAVETCDKVSPLNKNSG

SEQ ID NO: 16017 - protein, 524 aa, Oryza sativa Indica Group
MEKSSELWLLWAVFSSSLVFLYLTIRRRSGAGAGGKPPLPPGPTPLPLIGNLLDLRGGVIHDKLAALARVYGPVMMIKLGLNDAVIISSRDAAREAFTRYDRHLAARAIPDTFRANGFHERSAVFLPSSDERWKALRGIQGTHIFTPRGLAAVRPVRERKVRDIIAYFRDHAGEELVIRQAIHTGVLNLVSSSFFSMDIAGMGSETARELREHVDEIMTVFAQPNVSDYFPFLRRLDLQGLRRSTKRRFDRIFSILDDIVERRLVDRGERGGEGGASSNSSKSKHQYDGGDFLDALLELMVTGKMERDDVTAMLFEAFVAGGDTVAFTLEWVMADLLRNPPVMAKLRAELDDVLGGKDQSAIEEHDTARLPYLQAVLKESMRLHSVGPLLHHFAAEDGVVVGGYAVPRGATVLFNTRAIMRDPAAWERPEEFAPERFLAREGKAPVDFRGKEADFIPFGSGRRLCPGIPLAERVMPYILALMLREFEWRLPDGVSPEELDVSEKFMSVNVLAVPLKAVPVKVIN

SEQ ID NO: 16018 - protein, 488 aa, Oryza sativa Japonica Group
MAAAAATAAAHLLSTPPSASPVHPPPHARILCAHRTKGVATLSCRASLGPDGSLAGLAAAAAAAPRVEPRGRPYLREHSCLIFPPLRAAAARSPSSSSSAAPSSAPSPRVTYSHFLKLLAQEGFLVVSVPYNVTFDHEAAAREVYERFHGCYGALLSSGLPAAGLSAMDIAELPLYSVGHSNGALLQLLVGSYFSEKIPKANAIVSFNNRPASEAVPYFEQLQGYNFENGEENKPFLVYASAFRSPKGDAWKALFDLAGGLIQVYDQEAMLSLSKFVDQLPSVMNQVTEGVSEFKPTPPENREFCKNSYNVPNTLLVKFSIDAIDDTEIVEDVLKPRVESIGGQIKKVILSGTHLTPCIQALTKTILQDVKWQVGSEYTPADALAQGLKSLALNETRAVPKISDQDWGAWARVFPLGLLSQHLLYNAFNPWSKETYPVSAPSSIKVSVRYQLSSPKPTKPQRTGQAQDLLRLAPVKSDILGTNQDANQ

SEQ ID NO: 16019 - protein, 351 aa, Aspergillus oryzae
MYRQSFAPPPAQSPPLHHPVPQHVSTVPMMRSPPPPTSQQSQTSGYGNNPYQPAPAQGGSGTYAPGFGGFINDPTAQMGFQVGKTAMMAGQEYMEQNLNRYVSIPALKHYFNVSNSYVLNKLALVLFPWRHKPWSRQQSRVTAASTGPNGQISHQQYSTMFLPPRDDLNSPDMYIPVMALVTYILLSAMLAGFRGNFHPELLGSITTTAIAVIVFEILCLKLATYILSINNESQLLDLVAYSGYKFVGIIITLVTSEVLTPGRGTGGWVGWVVFIYTFLANAFFLLRSLKYVLLPDSATDARTGSMHTVARSQRNRRTQFLFIYSYVIQFIFMWVLSREGPTASNVAGSAS

SEQ ID NO: 16020 - protein, 201 aa, Triticum aestivum
  misc_feature (51)..(51): Xaa can be any naturally occurring amino acid
  misc_feature (154)..(154): Xaa can be any naturally occurring amino acid
VTSTTSLYKKACSHRSGIPGISSTHASERIVPPLQSGLKSEILWALNALGXVSFKEKDDLRRDTTPLAKVPGLLDALLQVIDDWRDIAMPRDHTKPPRVITLGVNTTISGFGLENVGTVYWERTTPPNDQSKIQSSPYHKEEDLHDSCFDEDGXLFNTDDARAGNRSHPARLSGGPPTNEPAHFFFSCPNKIDTFSVGPRE

SEQ ID NO: 16021 - protein, 636 aa, Pseudomonas putida KT2440
MIRLSNLTLQRGPQRLLEGAEMTLHAGHKAGLIGANGAGKSSLFALLRGELSPDAGDCQLPGDWRIAHMRQEVDTLDRLAVDYVLDGDVRLRKVQAELAAAEQAHDGTALARLHSELESADGYTADARARKLLAGLGFTNEQMDRRVGDFSGGWRMRLNLAQALMCPSDLLLLDEPTNHLDLDAILWLEDWLKGYPGTLLLISHDRDFLDAVVDHVLHVEQRKLNLYKGGYTAFERTRAERLAQQQQAYEKQQAQRAHMEKYIARFKAQATKARQAQSRIKALERMEELSAAHVDSPFDFVFRESQKISSPLLSLSEGRLGYGDKAILDKVKLQLTPGARIGLLGPNGAGKSTLIKNLAGELEPLSGRLVRGENLAVGYFAQHQLDSLDDKASPLLHLQRIAPTEREQTLRDFLGGFDFHGARCDEPVVNFSGGEKARLALALIAWERPNLLLLDEPTNHLDLEMRLALTMALQEFAGAVVVVSHDRHLLKSTTDDFLLVADGKVDTFDGDLEDYSRWLVEYRQRSAPASTAPANPDKTDKKAQRQAAAALRQQLAPHKKAADKLETELNQVHAQLAEIETALGDGGLYDAARKDELRDLLARQTKLKQREGELEEAWMEALETLESMQAELEALS

SEQ ID NO: 16022 - protein, 148 aa, Zea mays
MAATVVTTTTSKAARTKSGLISRILQRCKSGLSVGSGRSPSPSGCFPVYVGPGRERFVVRAECANHPLFRRLLDDAEREYGYAAQGPIALPDCGVAAFLDVLCQMERAGADGEVAVASTPICGMNSGSKGRAAGYRMLLSPVNGWWKE

SEQ ID NO: 16023 - protein, 328 aa, Oryza sativa Japonica Group
MADSPSPRLDEEDAFGRDFNSSPSPTAPPARSGEKRPFGDLDDDDEDVFASKKGKTKVEESAPGAATGMILSLRERTVKIILRHVRWNGRLPNQKFKSGIQHFRTFQLYLLEPIQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVET

SEQ ID NO: 16024 - protein, 264 aa, Candidatus Protochlamydia amoebophila UWE25
MHITIIGCGNMGSGIAKRLSMNHQISLYDHYPATAESLTKQIQATAYADLFSAIEEADLILVAVKPQNLDDLTERLAPLLKPHQTIVSILAGINYKTLKHRFSQSIVVRMMPNLALIHGKGVIGLVENDQLTDKLKMQLKALFDPLGSVYWLPESKIDALTALTGSGPAFIFALVESMIEAGIYMGFQMTDAKSLIFQMLKGSLALLETTDKHPADLKWQITSPAGMTIEGLKTFEDYGVRSGIIHTFLASFNKIKQVSDSLKN

SEQ ID NO: 16025 - protein, 159 aa, Candidatus Protochlamydia amoebophila UWE25
MPNQPIAQIETTQGTIEVALRPDVAPKATENFIKHAKDGYYNGVIFHRVIKGFMIQGGDPTGTGRGGESIWNKPFEDEVSDNVKFDRPGLLAMANAGPKTNGSQFFITTAATPWLNKKHTIFGEIIKGYDVVQKIENTQTGPGDRPVEEQKIINITIKE

SEQ ID NO: 16026 - protein, 480 aa, Oryza sativa Japonica Group
MEGFCFARCRFTRLVVAMQLVMGVLVICISMASLHRFYTTDALLPGGLDDPARCARFHGAVAGGYSGFDIRALADRVDEVLVQLAELQDKLEATALKIGKKTKKRKGKGKLQQQENMTMTEFQRFLEDEVIHPLYGAHIVLRLIRIPRPDPDGGAPAVDPLVNFFAAEETRKYVTAKRNREGRPGAYGANRTYGSIGHACVVMRRELDEYMSYDVGALCPDDWDLGQRLMLGGCDPLPRRRCLARASKLFRRPLPINESLWALPDDGNVRWSRYHCRGYRCLSARNPRRGYDRCVGCFDMDREKQRWMQGSNGTTLADFRMEEVLAVKPGEIRVGLDVTVGTGSFAARMRERGVTVVTTAVNLGAPFAETVALRGLVALYAGLGQRLPLFDNSMDMVHTGGVLDGWVDLQMLDFVLFDWDRVLRPGGLLWVDKFACARKDLDDYMYMFLQFRYKKHRWVVSFKSRDEVYLSALLEKPLRS

SEQ ID NO: 16027 - protein, 295 aa, Medicago truncatula
SFSLYESSFARIDNNDEHELHKELISMEDNDAMNSGSVQSMMIEKSFCFASVLEKEKLTMLGEEHTTKMLIRRWDFWLYYIAYFCGGTIGLVYSNNLGQISQSLGHGSLTSSLVTLYSTCSFFGRLLAAVPDLFSSKIHFARTGWFAAALIPTPIAFILLAISGTKTTLQLGTSLIGLSSGFVFSAAVSITSELFGPNSVGMNHNILITNIPLGSCLYGLLAALVYDSNATSRRDSIWLREMSMCMGRKCYMQTFIWWSCISIVGLVSSFLLFLRTKQAYDGYERNKTRNRIQAS

SEQ ID NO: 16028 - protein, 472 aa, Gymnadenia conopsea
MSSPKCFSCAMAIPRFVSSIAFMVIGLAIFVIVASVLLVSSPIFSSFQDYFLSVDHARESQPPILSSFADNRPEMFVSEPRSPKGEPTDLIFKDDSTKEPVSGSDAVNYDVNSTASDANLCDLYHGKWVYDPRGPLYTNISCPLITQMQNCQGNGRPDKDYESWRWKPDQCDLPRFDARKFLELMRGKTLAFVGDSVSRNQMESLLCILCHVDMPKNRGNRRMHRWYFKSTSTTIVRIGSSWLVHKTSEPMAFAPEGVAKVHLDLPDEYFMEFLPEFDVVVLSSGHWFAKPSVYVLNGTIVGVQLWKPPQNALVDTRITNIEAFEMSVETAVEAIAAHPNFTGVAIFRSYSPDHYEGGAWNAGGSCTGKVSPVGELVRNEYTEVMHEKQVSGFGRAVEKAGKKSNLVFMDITEAFGYRPDGHPGPYRSPDPNKKTKRGPHGEPPPQDCLHWCMPGPIDTWNELLPEIISKRF

SEQ ID NO: 16029 - protein, 145 aa, Pseudomonas putida KT2440
MKTVEQILKTKSQHQTVYTIGPDDSVLDALKLLAEKNIGALPVVEGGQVVGIVSERDYARKLVLKGRSSAATPVREIMSAPVVTVEPKQKLDFCMNLMTDRHLRHLPVVDNGRLLGLLSIGDLVKETIDEQASLIKQMEQYIRGE

SEQ ID NO: 16030 - protein, 258 aa, Oryza sativa Indica Group
MAQQQQQQGSGSGSASASSSSSGLHLLASPFGDTTYTKVFVGGLAWETTSERLRRFYDRFGEILEAVVITDRHSGRSKGYGFVTFRDPESARKACEDPTPVIDGRRANCNLASLGRAQPAVPLGRPRSAGSYFGVPVPRGVYVGGYGQHRTLPLGYYQGFPVPQYSYTTYGTEYIYPQVPLDCSRTKEQCCCICSTGSYLASNPPCIHKVVLIMVIRCTWNHDVAPMDGTMIQEQRLLLSVLLGYILCLNGTATIAAA

SEQ ID NO: 16031 - protein, 201 aa, Zea mays
  misc_feature (48)..(48): Xaa can be any naturally occurring amino acid
  misc_feature (107)..(107): Xaa can be any naturally occurring amino acid
  misc_feature (153)..(153): Xaa can be any naturally occurring amino acid
YVHGLEPLLYLSEVHEKGVHDLWRAPTDEICLPLMVSLCQLNYLRLPXPCLMALPADLKTKVLHFLPGVDLAKVECTCKEMRNLALDDSIWKKLVFKYKNYGKGCRXASKSAKAIFGEAWQANKRWQKRPNPTFWYNGWGNNSFSRPLRLPLXGGNLDRLPFIGNHGSVGRHFRNKRRNILLNCILDGHRSPPQLPLKPCQ

SEQ ID NO: 16032 - protein, 367 aa, uncultured marine bacterium 583
MAQRDYYEVLGVKKGANEAEIKKAYKRLAMKYHPDRNAGDKASAEKKFKEVRKAYDVISDPQKRSAYDQFGHAGVEQQGAGGFGGGNPFGAGGFGDIFGDIFGGGNTKPDNRGPDLRYDLEIDLRQAAEGDTVKIRVPKNDTCDTCSGTGAKPGTSVKTCGNCHGSGQVQMQQGFFAIQRPCNQCHGTGEKIDSPCRTCSGQGIVRKQKTLSVKIPAGVDTGNRIRLSNEGEAGLRSGPSGDLYVQIHVKDHQIFQREGNDLYCEVPIDFATATLGGSIEVPTLDGKLKINIPSGTQTSKLFRLRGKGMPAMRYNGSGDLLCQVKLETPVNLNSKQKQLLKDFSSSCNAKQYPESNSFFGKMKSFFE

SEQ ID NO: 16033 - protein, 330 aa, Rubrobacter xylanophilus DSM 9941
MSLPEIALITTGGTIAARPLPSGEVVVADSGEELLASVPELAEVARVRLVELFRIDSSLMTPQDMLEIARRVRALDRDESLAGFVVAHGTDTMEESAYLVDLLYAGERPVVFTGAQRNADDPAPDGPGNLLDAARIAASPEARGLGAVVAMAGRIDAARDATKVHTTSLEAFSSLDRGKLGEVADGAVRIFRSRPRPLNLSATDAVEPRVALVKLAAGMDGALLRAAREGGTAGIVLEALGLGNANPGVVREVELCTEAGLPVLVVSRVPSGSVAPVYGDGGGSDLARAGALFGGSLIGQKARILLMVALAARRRSGTPLEELLAPHLRI

SEQ ID NO: 16034 - protein, 425 aa, uncultured marine bacterium 583
MQIKQIKAREVLDSRGNPTVEADVILNNGVFGRAMVPSGASTGQREALELRDGDKNRYLGKGVTQSVININHEINDALVDMKISNQQDIDQKMIDMDGTETKSRLGANSILAVSLACAHANANNNKQSLFRSFNFSETYQLPVPMMNIINGGEHANNSIDIQEFMIIPAGAPSFKEALRYGAEVFHHLKKLLDQGGFNTAVGDEGGFAPDLSSNEEALKVILKAIESAGYEAGKDIFIGIDAASSEFYNNGTYNLTSEGLKLSNEEFTSYLASWVEKYPIISIEDGMDENDWVGWEMLTKKLSDKVQLVGDDLFVTNSKILAKGIENNIANSILIKVNQIGTLTETFNAMKMASNAGYTCVMSHRSGETEDTTIADLSVATSCGQIKTGSLSRSDRLAKYNRLLRIEEELGDDAYYPGLSTFKHL

SEQ ID NO: 16035 - protein, 325 aa, Colwellia psychrerythraea 34H
MKAMIIKEIGSTEVFQLAEKAKPVAKAGHMVVEVKATSVNPIDTMLRSIELPWSANLPEILHGDVAGIVCEVGEGVTGFNVGDEVYGMAGGINGVDGALAEFMLVDALLMANKPKTLTMKQAAALPLVAITSYEALVEKMNVQQGDKVLIHGATGGVGHIAVQLAKVLGANVTSTYSSANEVLAKTLGADNLVDYKTESVADYVRAYTDGIGFDKVFDTVAGDNIEKSFEAAKLNGHVATILPIADPLQIALKSLSFHSVLVLIPLCHGINHASHGRILTEIATLVDAGKITPIIDESDFSIWEVAKAHDHLASGKALGKITLTV

SEQ ID NO: 16036 - protein, 502 aa, Nicotiana sylvestris
MEHSLMATRSYFLLFSSFTFLLILLSFPVEKSHALEAKETIESHFHTLQLTSLLPSSSCNTATKGKRRGASLEVVNRQGPCTQLNQKGAKAPTLTEILAHDQARVDSIQARVTDQSYDLFKKKDKKSSNKKKSVKDSKANLPAQSGLPLGTGNYIVNVGLGTPKKDLSLIFDTGSDLTWTQCQPCVKSCYAQQQPIFDPSASKTYSNISCTSTACSGLKSATGNSPGCSSSNCVYGIQYGDSSFTVGFFAKDTLTLTQNDVFDGFMFGCGQNNRGLFGKTAGLIGLGRDPLSIVQQTAQKFGKYFSYCLPTSRGSNGHLTFGNGNGVKTSKAVKNGITFTPFASSQGATFYFIDVLGISVGGKALSISPMLFQNAGTIIDSGTVITRLPSTVYGSLKSTFKQFMSKYPTAPALSLLDTCYDLSNYTSISIPKISFNFNGNANVDLEPNGILITNGASQVCLAFAGNGDDDTIGIFGNIQQQTLEVVYDVAGGQLGFGYKGCS

SEQ ID NO: 16037 - protein, 324 aa, Dehalococcoides sp. CBDB1
MLVNGNLTEELKIFTGNANPDLAKAVAEYLKVQMGKCEVFQFSNENIFVRIQESVRQKDVYVIQPTCSPVNQSIMELLIMMDALKRASSERITAVLPYYGYGRTDKKDQPRVPITARLVADLLTTAGASRILTVDLHAPQIQGFFNMPVDELTAENLLANYFKKKNIKDLVVVATDVGISKKARDFAAKLDAPLAIIEKRRMGNNDITRTINIIGDVEGKNALTFDDEIDTAGSLVGNVNILISKGVKEVYSCATHPVLSGPAIQRIATSPIKELVVTDSIPLTPQKKIDKITVLSIAPLIGEAIYRIHTGNSIGEMYDQMQME

SEQ ID NO: 16038 - protein, 696 aa, Coprinopsis cinerea okayama7#130
MSSSRPTPYQGKSLPDSSAASTASESIMAIDTVRERKKDSRGEREDEERTALIDAGGSNTPEVSADYGSIAPSGRFAIPGRAPRRKYALARRARYYIPSLAWIPQYNWSLLGGDILAGLTVGCILIPQSISYASSLAKLSPVTGLISASIPGIIYAFLGTSRQLNVAPEAALSLLLGQAIQEIRHEIGDPPEGGIDVVGLAVSSVINFQVGLICFLLGFFRLGFIDVVLSRALLRGFISAVAVVILVEQLIPMFGLTQLMRVVGPHTTLQKIAFIWDNVWEHSNQLTMVISFGALGSLVLFRMFKNQFQKTWWIYRLPEVLIVVVLSTYISGKVRWDKGGVDILGAVSVSTGDHFFQFPLANGNFKFVRATTSTAVLIAVAGFLDSIVAAKQNAARFGHSISPNRELVALGASNLVASFVPGTLSAFGSITRSRINGDVGGRTQMASIVCSLVVLFATFFLLPWLYYLPKCVLGAVITLVVYSLFAETPHDVMYYWKMGAWVDLAIMTMTFTACIVWNLEAGIVISMVLSLLLVVHRSSKTRMTILGRIPGTDRWKPLKDTPEAEEAVSGVLIVRIRESLDFANTSQLKERLRRLELYGPHKHHPSERPTRQEASVLIFHMADVDSVDASAAQILYELTEEYMKRDVQIFMTHVKAKPYQTFVKAGIVDMVGLDAFRETVADAVSIVERSAAPSRV

SEQ ID NO: 16039 - protein, 353 aa, Coprinopsis cinerea okayama7#130
MSLPKPREPGGPIRDYKYTQEISQMMFVFGEVQDPNPETVNLVEDIVRSQIIELIVQARAVTLRRGARFLSAEDLIFLIRHDRAKVNRLRTYLSWKDVRKHAKDSGPDGGGGVEVDGLEDGGDDKITAKAQKINFKLPWEIMTIYSEVLKTAGHEDDDEEDDDDIEAHEASIQRLKEADDATRQMTREEYQHYSDCRQASFTYRKGKRFREFLNLPPHLDLRANDDTIDIVGFLAFEMVRSLTIAGLAVKKSLEESILRDDYTTPKNGKRKAGGATLLGGPAEKRRREEEGEEEEYTLPVNTLFLPPPEARTALRPEHIQDAFTRMQTEWSHRRNAGMHNWRGGLVRTRISLI

SEQ ID NO: 16040 - protein, 377 aa, Streptococcus mutans UA159
MKIDKYSAILGSAIGFPEMEGLTDTRPLANLPFDGKYRLIDFQLSNLANAGIRSVYGIFRGQNIRSIFDHIRSGREWGLNTLLSHYFLGFYNTPEDSIYADKDYYDQILTYLKRSGSDQTIYMSCDILCNIDLQQVIHLHNANKRNITVVYKKLPINAISAANDILEIDETDTVTGRRDSQSGNETEKMSAGIYIVNTSWLIEQMEKENQKEEPINLRFLLRDLTVAEKALAFEYTGYLANISSIQSYYNANMDMLESQKFYSLLYSNQKVYTKVKNEEATYFAVDSTVKNAQFASGSIIKGTVDHSIISRNCHIANHSRVVNSVVFPKVSIGDGAVVENAILDKNVKIAPGVIIRGTGDKPIVIAKASEVVEDIIQ

SEQ ID NO: 16041 - protein, 381 aa, Streptococcus mutans UA159
MHMKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 16042 - protein, 99 aa, Prochlorococcus marinus str. NATL2A
MTSFQITFINELSGLKEIIDIPDDKYILDAACEQNIELPASCREGTCSTCVAKLEKGNVDQQDQSFLDDDQIEKGYILICKAYPLSDCIIRTHAEDQLY

SEQ ID NO: 16043 - protein, 391 aa, Oryza sativa
CLAAPRARRRREQRGARRDGRKENAAAAQPRLTRAAAKRAAAVTAVAVAAKRKRVALSELPTLSNNNAVVLKPQPAPRGGKRTASHAAEPKKPAPAPAPAVVVVVDDDEEGEGDPQLCAPYASDINSYLRSMEVQPKRRPAADYIETGRVDVTANMRAILVDWLVEVAEEYKLVSDTLYLTVSYIDRFLSAKAINRQRLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDPDTNPWSKKLQEVTGYRASELKDCITCIHDLQLNRKGSSLMAIRDKYKQHRFKGVSTLLPPVEIPASYFEDLNE

SEQ ID NO: 16044 - protein, 275 aa, Listeria monocytogenes
AAHGQTFIPPFDDPDIIAGQGSLAVEMVDLISTEQADYVFAGIGGGGLISGVATYLKAKSPITKIIGVEPDGAPSMTAALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGHDDITKFEYTKKVNRGNGPVIIGVLLQDKNDYEGLLDRVAAFDPSYIPINDNQTLYTLLV

SEQ ID NO: 16045 - protein, 636 aa, Aspergillus oryzae
MEALAPYIPPALLPLAQTLHDQVPLVGVALVSLGAIYLGYIYILGIKEAAVPFNVPIPPEVRANWKGKAWEDVQGEEKKVLEGQLRGSWNNKVILSYCPADGRILGNGIKPATTEDVDRAIQAAKMAQIEWARTSFAERRKVLRTLLKYVLEHQEELVTACCLDSGKTKVDASFGEILVTAEKLKWTIDHGEKALTPQSRPTNFLMMYKKNMVTYEPLGVVSACVSWNYPLHNFIGPIISGIFAGNGVVVKPSEQTAWSSAFFLEVVRGALSACGHSRDLVQSVVCLPEVADFLTSHPDISQLTFIGSRPVAHKVCESAAKALTPVTVELGGKDPAVILDDARTVSEISSIASILMRGVFQSAGQNCIGVERVIALPGVYDKLLNDVSSRIKSFRLGSVLLESKPEDPQQKPGAPDMGALISPASFDRLETLINDAVRQGASLICGGKRVNHPKYPHGHYFAPTLLADVTPSMRIAQTELFAPVFLLMRADSVPHAIAIANSTEYALGASVFGYNHVDIAACVSNIKAGMVSVNDFGSYYAVQLPFGGVKGSGYGRFAGEEGLRGVSNIKALCVDRFPKLMATRIPPRVDYPICKGDGSRQNGTGAWEMCKGVVETGYQLTLAGRVTGILRLLKNM

SEQ ID NO: 16046 - protein, 394 aa, Lactobacillus acidophilus NCFM
MPNLSNDLQSIINNRLNNLSASKIRAFDQKVSSIPGIIKLTIGEPDLATPDHVKDAAINDIQANDSHYAPQAGKPELLDAISNYLDRSIGVHYDPESEICVTVGATGALNDVFMTLLNPGDKILVPTPVWALYFQLIKMTGAIPIQIDTKKDGFVLTPEHLRHVLNGRGKGAKAIILTDPSNPTGRVYPEEILKELAKIIKEYKIYSITDEIYAELVYGDAKHHSLSEYIPEHNILISGLSKAYAMTGWRLGYIAGPKQIMKAIRKVNSFLITSVTDNVQMAAVEALNNGQNDPKEARKIYESRLRFMQTGLEKLGFEMATPQGAFYIFAKIPEKYGTDDENFAFELAQKAKVGVTPGRYFGKGGEGYVRLSYASSTEQLRESLQRITNFVDNL

SEQ ID NO: 16047 - protein, 189 aa, Triticum aestivum
MTRGYCRPTRPGAEARGHWAWVKGVKKFIFGEAGRDWRQSPQGNNKVRVRNQQAVLAEKREREMAASAATATAAAVGAGEVISVHTLEQWTMQIEEANAAKKLVVVDFTASWCGPCRIMAPVFADLAKKFPNAVFLKVDVDELKPIAEQFSVEAMPTFLFIKEGDVKDRVVGAIKEELTNKVGLHAAAQ

SEQ ID NO: 16048 - protein, 271 aa, Lactobacillus acidophilus NCFM
MCFNKSVILNNGEKIPQIQLGTWLINNDEVNKVVRQAVNIGYRGFDTAKDYGNESGVGKGIWNSDIERSDIFLTTKLPTAVKDYEGTKKAIDAALDKFGLEYIDLLLIHSPQPWIEVNRTNDRHFKGNLENWRAMEEAVKAGKVRSIGVSNFLQEDIENIVNNGTITPAVNQIEVHIGKVPVELMDYCKKLGIKIEAYSPLSHGKLLNDDQIIAYAKKYNVTPAQLMLAFDMQLGCIVIPKSDNVTEMKENLNINFKISDEDIAKLIKIKE

SEQ ID NO: 16049 - protein, 331 aa, Bacillus cereus G9241
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYIACAQEIMAQSFDQGIDFSSVVCVSGSGGMHAGLITGFAGTQSHIPVIGINVSRGKAEQEEKVAKLVDETSAHVGIPNFIPREAVTCFDEYVGPGYALPTPEMVEAVQLLAKTEGILLDPVYTGKAVAGLIDLIKKGTFKKEDNILFVHSGGSPALYANTSLFA

SEQ ID NO: 16050 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 16051 - protein, 205 aa, Pseudomonas mendocina
QQIVTLTYPHIGNTGTTPEDAESNRVWAAGLIIRDLPLISSNWRDKQPLDEYLKANGTVAIAGIDTRRLTRILREKGSQNGCILVGDDATEEKALELARSFPGLKGMDLAKVVSCTERYEWRESTWNLQSDSHPEIPASELPYHVVAYDYGVKLNILRMLVERGCRLTVVPAQTPASDVLALNPDGVFLSNGPGDPEPCDYAIKA

SEQ ID NO: 16052 - protein, 480 aa, Pseudomonas putida KT2440
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAEKLAAAVAKLKIGNGLEEGTTTGPLIDGKAVAKVQEHIEDAVSKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 16053 - protein, 205 aa, Pseudomonas mendocina
QQIVTLTYPHIGNTGTTPEDAESNRVWAAGLIIRDLPLTSSNWRNKQPLDEYLKENGTVAIAGIDTRRLTRILREKGSQNGCILVGDDATEEKALELARSFPGLKGMDLAKVVSCTERYEWRSSVWNLKDDSHPEIPASDLPHHVVAYDYGVKWNILRMLVERGCRVTVVPAQTPAAEVLALNPDGVFLSNGPGDPEPCDYAIQA

SEQ ID NO: 16054 - protein, 425 aa, Pseudomonas putida KT2440
MSKTNESLMQRRVAAVPRGVGQIHPIFVDTAKNSTVIDVEGRELIDFAGGIAVLNTGHLHPKVVAAVQEQLTKVSHTCFQVLAYEPYVELCEKINKLVPGDFDKKTLLVTTGSEAVENAVKIARAATGRAGVIAFTGGYHGRTMMTLGLTGKVVPYSAGMGLMPGGIFRALFPSELHGISVDDAIASVERIFKNDAEPRDIAAIILEPVQGEGGFLPAPKELMKRLRALCDQHGILLIADEVQTGAGRTGTFFAMEQMGVAPDLTTFAKSIAGGFPLAGVCGKAEYMDAIAPGGLGGTYAGSPIACAAALAVIEVFEEEKLLDRSKAVGERLTAGLREIQKKYPIIGDVRGLGSMIAVEVFEKGTHTPNAAAVGQVVAKAREKGLILLSCGTYGNVLRILVPLTAEDALLDKGLAIIEECFAEIA

SEQ ID NO: 16055 - protein, 205 aa, Pseudomonas mendocina
QQIVTLTYPHIGNTGTTPEDAESNRVWAAGLIIRDLPLISSNWRDKQPLDEYLKENGTVAIAGIDTRRLTRILREKGSQNGCILVGDDATEEKALELARSFPGLKGMDLAKEVTCDKPYEWRSSVWNLESDSHPEIAAADLPYHVVAYDYGVKLNILRMLVARGCRLTVVPAQTPASDVLALNPDGVFLSNGPGDPEPCDYAIKA

SEQ ID NO: 16056 - protein, 150 aa, Oryza sativa Indica Group
MATRMAAAVAAMVAAVAISLAAGGAAQSSPSTPSCASKLVPCAQYMNGTDTPPAACCDPLKEAVKNELKCLCDLYASPQIFKVFNINISDALRLSTRCGISQTTSMCPGNSPTNSPPASPSGGKNAGHRTMSVGLPGLMSLFLALWSVLA

SEQ ID NO: 16057 - protein, 343 aa, Kineococcus radiotolerans SRS30216
MSDEHAPVDPALVPRRELRGGATVPAIGIGTFGSDRYSPAEVAAAVAGAVAAGYRLVDCAAVYGNEAQVGEALAGAVAGGVDRDELFVVSKVWNDAHAPADAVASVHRSLRDLRLDHLDAVFVHWPFPNHHPPMADTDARDPRARPYDHDAYLALWGALEGLVDSGLVRHLGTSNTTVAKLDLLLRDARIPPALNEMELHPCFQQPELFAHCVRHGIQPVGYSPLGSPSRPERDRTPGDVVDTEDPVVVRIAREHGVHPALVCLKWAVARGQVPIPFSVKPAQYTANLRAVVEDPLTAQEVADLAAADRGERLIKGQVFLWPGAESWRDLWDEDGTIVGWTER

SEQ ID NO: 16058 - protein, 286 aa, Vitis vinifera
MEGKEEDVRLGANKFTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYSKGDGLGAEIVGTFVLVYTVFSATDAKRNARDSHVPILAPLPIGFAVFLVHLATIPITGTGINPARSLGAAIVYNKEHAWDDMWIFWVGPFIGAALAALYHQIVIRAIPFKTRA

SEQ ID NO: 16059 - protein, 189 aa, Methylobacillus flagellatus KT
MTTSLINTEIKPFKATAFHNGEFITVTDADLKGKWAAVVFYPADFTFVCPTELGDIADNYDELQRLGVEVYSVSTDTHFTHKAWHDTSDTIRKIKFPMIGDPTGAISRNFGVLREDQGLADRGTFVIDPNGIIQAIEVTAEGIGRDAADLVRKIKAAQYVASHPGEVCPAKWKEGEATLAPSLDLVGKI

SEQ ID NO: 16060 - protein, 516 aa, Dehalococcoides sp. CBDB1
MAVQDQLDNLNRLKKQAEMGGGEAKIEAQHKRGKLTARERIELLFDKGTFNELGAFASHRCRDFGLEKQRNAGDAVVTGSGLVNGRLVFTYSQDFTVLGGSISEVVGQKVAQVIDMAIRAGAPLIAINDSGGARIQEGVASLSGVGDILLRNTIASGVIPQISIVVGPSAGGAVYAPALTDFIFAVKGISQMYITGPDVIKTVTGEDISHEALGGAEIHAKKSGVAHFLCENEKECFEQVRELMGFLPQSNREKPPRGKNKDNEERKTRDLRDIIPDNPKRAYDMKKVITEVADEKEFFEVHKNYAQNIIVGFVRMGGQPAGIVAQQPSHMAGVIDINASLKAARFIRFCDAFEIPLVSFVDVPGFMPGTDQEHSGIIKHGAKLIYAYAEATVPKITVITRKAYGGAYIVMSSKHLRGDVNYAWPASEVAVMGAEGAVNIVSRKAITESANPEETRQKLLEEYREHFANPYQAAQLGYIDDVIDPADTRSKIIKALRSLENKILVNPPKKHGNIPL

SEQ ID NO: 16061 - protein, 524 aa, Aspergillus nidulans FGSC A4
MDITSGPVLKNEVAPDTKLVEDGPRRADGVTQLYEGNIFEATPEDRRQIGVVSASFLIFNRVIGTGIFATPSTILSLSGSVGLSLFMWVAGTLIAVAGTAVYLEWGTAIPKNGGEKNYLEYVYKKPKFLATAMFAAYAVLLGWAASNSVVFGQYILNAAEVEVDRWNQRGIGLACITAAFLIHGFALNWGLRLQNLLGIVKLIIIIFVIVTGWVALAGHTKIETPHNFQNAFEGTTGSGYGVVMALYNVIWSFIGYSNANYALSETKNPERTLKIAAPVAIGSVGVLYMLCNIAYFAAVPKDQFLASGNIVAATFFGNMFGSRAERVMSVFVALSAFGNVLSVIFSQGRIVQELGREGVLPFSKFWASNKPFKSPAAGLFEHWVVSVIIMLAPPPGDAYNFLVNLISYPLAIVNVFVSAGLIYIYLTKEKNFPNWAPGIRATLPVTVFFCLSNIYLVVAPYIPPSAGQSVYEELPYYLHCVVALGIFALGAIYYLVWAVAMPRLGGQTANKLASTKPSRRAYYE

SEQ ID NO: 16062 - protein, 251 aa, Dehalococcoides sp. BAV1
MAIILKTEKEIAIMRRAGHILAVALEEVKKNVRPGITTRELDEIAERELLRRGTTPSFKGYQGFPASLCASVNEEIVHGIPGGRVLKEGDIISLDIGNILEGFQADMAVTVGVGEISPAAQRLISATQAALTVGIVQARAGGHLGDIGAAVEEYAQSRGYGVVREYTGHGIGRNMHEDPQIPNFGRRGKGPELKKGMTLAIEPMLNIGTEKTKVAPDCWTVYTADGSLSAHFEHTVAITDGEPEILTLIEE

SEQ ID NO: 16063 - protein, 237 aa, Chlamydomonas reinhardtii
VDYFTLRRFLRARTYDFDRAIKMWTDHVNWRRENKVDSILQDFHFDERDKFLEAYPQGYHKLDKMGRPVYIQLIGKIKVPAIMECTNEERMFKFHVQEYERCVKVIMPIASKLAGRKVDQTFGIMDVKGGQVRLSMPARSVVGRFTKTDQDNYPEMLGHICIINAPAVFRMLWGLVKNMIDVRTQQKIEILGPNYMEALLKHMDIENIPEFLGGQSRGTLLDDVGPWSDPELMAANG

SEQ ID NO: 16064 - protein, 398 aa, Lactobacillus acidophilus NCFM
MLAAIVCALAGMCYAEFASAIPVAGSAYSYGNIVYGEFTGWIIGWALILEYMLSVATVAAGWSSYFSSFISPFGLKIPNAVSGPMNLSKGVYFDLVSVLVILIISILLSRGMKNSIKINIIAVFIKIAIILIFIFVGVQFIKPANYHPFLPYHFSGVIKGATTVFFAFLGFDVVSSSAAEVKNPKKNMPLGIIGTLAIAALLYFGVSIVLTGMVNYKQLNVSNPVAFALQYVHQDWVAELLSFGAMLGMATMMLTMIYSSSRLIYAMARDGLLPSTFSKLDKKHNSPQNALIAVTIIISLGAAFFSVDQLANLVNFGTLFAFTLVSFGILKLRKRTDITNDGFKVPGYPFLPIISGLICIFMICHLSSEVYLMAFIWLVLGAIIYFAYGYHHSQLDHE

SEQ ID NO: 16065 - protein, 556 aa, Chlamydomonas reinhardtii
MAPAPCALGPTSSTHQQSSGSHKSKGKGGLLSKLLGGWRSASSGGRGTSSLAPRPSSAPQWNGQVTGLNAPGSVACGATATVQGATAPPCGNQCTSAPFLGYATDLEKHYELGRELGKGGNGVVRIAKNLITGEEYACKSIRKKKKQGHLDSIRREIQVMTKLSGSLNIVKLEDVFEDEENVHIVMEHCAGGELWHRIGDSHYSERTVASFMRAVLRTLAQCHAQHILHRDIKPGNFMLLSGDDRAPLKAIDFGLAAPFDPEQLPRTDLGLEGTPWYMAPETLRGEWLPSSDLWAAGVMAFQMLCGRFPFDDKKNVYAPAITAIWRSVLNDELDFDKPWWAGISDEAKDFCKLLLNRDPKLRPTAKEALKHPWLRGNSSERSTGKKLGQSVVARIQRFASGSQLKRTVLQSIAAELLSHPELLAQMRLEHGGQLTEAALSDALAAMGFRLAPSEVTRLMEQVDMDGTGVIDKADFAASQMDWRYFQRNHAELAFREMDKDGSGVLTVPELLDALRARLPPEEVQTALELALQEAGSNGASAAASAGSSGDAMTGGI

SEQ ID NO: 16066 - protein, 405 aa, Vitis vinifera
MTKGHILTKLTDGSVPNTLVIANCEVVKPRVAAAEHIAQFNEEARSPFVKKFKTIIHPGEVNRIRELPQNSKIVATHTDSPDVLIWDVETQPNRHAVLGTPESRPDLILTGHKDNAEFALAMCPTEPLVLSGGKDKSVVLWSIQDHISTLAADPGSAKSTSKAGGGNDKPVESPSIGARGIYQGHDDTVEDVQFCPLSAQEFCSVGDDSCLILWDARSGTTPAIKVEKAHNADLHCVDWNPHDINLILTGSADNTVRMFDRRKLTSGGIGSPIHTFEGHTAAVLCVQWSPDKASIFGSSAEDGILNLWNHEKVNHMYLFQIDKKQAPNAPPGLFFRHAGHRDKVVDFHWNASDPWTIVSVSDDGESTGGGGTLQIWRMIDLIYRNEDEVLAELDNFKAHLATCSP

SEQ ID NO: 16067 - protein, 762 aa, Agrobacterium tumefaciens str. C58
MSDTTKTASTRTSVTDQEALDFHAQGRPGKLEITPTKPMATQRDLSLAYSPGVAVPVKAIAENPATAYDYTTRGNMVAVISNGTAILGLGNLGALASKPVMEGKSVLFKRFADVDSIDLEVDTEDADEFINCVRYLGPSFGGINLEDIKAPECFIIESRLRELMDIPVFHDDQHGTAIIAAAGLINAIELTGRDFKTTKLVCNGAGAAAIACMDLIKAMGFNPENITLCDTKGVIYQGRTEGMNQWKSAHAVKTDRRTLTEAMNGADVVFGLSQKGAFTEEMIRSMAPKPIIFAMANPDPEITPEEVSRIRDDAIMATGRSDYPNQVNNVLGFPYIFRGALDVRARQINDAMKIAAAQALADLAREDVPDDVAAAYQGNRPRFGSQYIIPVPFDPRLISAIPVAVAKAAIETGVAQREIPDLDAYARELSARRDPMASTTQRLYERVRRSPKRVVFAEAEEEQVMRAAISFTAQGLGTAILLGRDDIIKANAERAGIDLDRANIEITNARLSSRVDAYVDYLYARLQRGGFLLRDVQRLIHNDRNHFAACMVAMGDADAVVTGVTRNYSTALEDIRRCINTKPGHRVIGVSLVVSRNRTVFVADTAVHDMPNAEDLADIAEEAAHLARRFGYEPRVAMLAYSTFGQPVGERSDKVREAVKILDKRNVNFEVDGEMSADVALNHQRMQSQYPFARLSGAANVLVMPAIHSASISTKMLQELGGATVIGPLLVGLDKSVQITSMGAKDSDIVNMAAIAAYNAGR

SEQ ID NO: 16068 - protein, 264 aa, Lactobacillus acidophilus NCFM
MKDSLRNKVVVITGASSGIGRSIALESAGRGATVILIARRKDRLEEITAEAKELSGAEAYVFPTDMGKPESIEKTFDEITKQVKHIDFLVNCAGFGKFEEFMEQKMQDVTNMFQVNVLGLMYFTRLIGRVMMDQKTGQIINFGSIAGKVPTTKSAAYSASKAAVIQFSNVLRLELKPFGVKVMTVNPGPVYTNFFNVADKTGNYVKNVQEFMLDPDDVAWQVVHFFGSDKRELNLPLSLAVLAKLYNLFPTIGDKISLEFASRK

SEQ ID NO: 16069 - protein, 494 aa, Bacillus pumilus SAFR-032
MSSTTLQISSKLESFLQGTKKLYINGQFVTSHDNKTFSTPNPATGETLIDVYEAGAKDIDEAVKAAKKAFHGPWRSMSAAERARFMFKLADLMEENQEELAQLETLDNGKPINETTNADIPLAIEHMRYYAGWTTKISGQTIPVSKGYFNYTRHEPVGVVGQIIPWNFPLLMAMWKMGAALATGCTIVLKPAEQTPLSALYLAELVDKAGFPEGVINIVPGFGETAGNALTDHPDVNKIAFTGSTSVGKLIMEKAAKSIKRVTLELGGKSPNIILPDADLKKAIPGALNGVMFNQGQVCCAGSRVFVHRSQYDEVVDQMAEYATSLKQGAGLHQDTQIGPLVSKEQHERVLGYIEKGKSEGATAVVGGDCPYEAGYFVSPTVFKDVEDDMTIAKEEIFGPVLSAIPYDSIEEVVERANQSDYGLAAGLWTENLKHAHDIAASLEAGTIWVNCYNVFDAASPFGGYKQSGLGREMGSYALNNYTEVKSVWINLQD

SEQ ID NO: 16070 - protein, 412 aa, Cytophaga hutchinsonii ATCC 33406
MTKEFNVYQYPNGITLLHKQVLSTRIAHCGYIFDVGSRDEDLKTQGLAHFWEHMAFKGTDKRKTFQILSSLEQVGGDLNAYTTKEKIWFHASLPFTYLERAADVLTDISFNSIFPEKEIEKEKKVVLEEMHMYADNPEDAIQDEFETLIFPEHSLGYNILGTEKTLQSFTQQNLKSFLKKNIDTSRVAFVVLSPQSFTEVKYITDKYIPHVKAQHSAKVREKNRGFKPATLIKKIDASQTHCVIGSLGLNIKEERRLGLFLLSNLLAGPGMTSTLNMAMREKKGYVYTIESNFTSYIDTGVYSFYFATESKQFEKALDVFHKEIAKVREKKLSTVQLHRLKEQIKGQLIMAEENNSNFMQMMGKSYLDFGKIDSFDHIIKKIDGISAEVINDLANQLMNPARMSKLIYEPEA

SEQ ID NO: 16071 - protein, 396 aa, Saccharomyces cerevisiae
  misc_feature (1)..(1): Xaa can be any naturally occurring amino acid
  misc_feature (166)..(166): Xaa can be any naturally occurring amino acid
  misc_feature (237)..(237): Xaa can be any naturally occurring amino acid
  misc_feature (242)..(242): Xaa can be any naturally occurring amino acid
  misc_feature (247)..(247): Xaa can be any naturally occurring amino acid
  misc_feature (253)..(253): Xaa can be any naturally occurring amino acid
  misc_feature (271)..(271): Xaa can be any naturally occurring amino acid
  misc_feature (307)..(307): Xaa can be any naturally occurring amino acid
  misc_feature (319)..(319): Xaa can be any naturally occurring amino acid
  misc_feature (344)..(344): Xaa can be any naturally occurring amino acid
  misc_feature (346)..(346): Xaa can be any naturally occurring amino acid
  misc_feature (370)..(370): Xaa can be any naturally occurring amino acid
XNSIIQRISKFDNILKDKTIINQQDLRQISWNGIPKIHRPVVWKLLIGYLPVNTKRQEGFLQRKRKEYRDSLKHTFSDQHSRDIPTWHQIEIDIPRTNPHIPLYQFKSVQNSLQRILYLWAIRHPASGYVQGINDLVTPFFETFLTEYLPPSQIDDVEIKDPSTYXVDEQITDLEADTFWCLTKLLEQITDNYIHGQPGILRQVKNLSQLVKRIDADLYNHFQNEHVEFIQFAFRWXNCLLXREFQXGTVIRXWDTYLSETSQEVTSSYSXSSNDIKPPVTPTEPRVASFVTPTKDFQSPTTALSNXTPNNAVEDSGKXRQSSLNEFHVFVCAAFLIKWSDQLXEXDFQETITFLQNPPTKDWTETDIEXLLSEAFIWQSLYKDATSHWLHHHHHH

SEQ ID NO: 16072 - protein, 176 aa, Oryza sativa Indica Group
MVYYALYWWADLDNLTNLQPRYGCDDPTYPYYFKLRCENCGEVSAKATCVSLGEVVDLPNGRSTANLVQKCKLCGRDASIVMIPGLGTPLTIEQSQKGDRTCLMVFDCRGCEPIDFAFGNGWKAESLEGTSFDIDCSEGEFADYDEKGECPVGLGKLRSEFRVVKKQESRGKTKYV

SEQ ID NO: 16073 - protein, 316 aa, Bacillus pumilus SAFR-032
MKILLSISQFAGRTFAIWVIVFAFLGFAFPAEFSKIGSYIPFLLGIIMFGMGLTLSAEDFKELFRKPLYVLIGVLTQYTLMPLLAFLLAYGLRLPSEIAVGVVLVGCCPGGTASNVMTFLAKGNTALSVAVTTISTLLAPFLTPVFILIFAKSWLPVSPEALFLSIVQVVLIPIVLGVIVKLFFKKQVTYAVQALPLVSVAGIVMIIAAIVSANKEQILQSGLLILAVVILHNGLGLLFGYLIAKWCKMDIPSRRAISIEVGMQNSGLGAALATAHFSPLAAVPSAIFSVWHNLSGSWLATYWSKRGNAESEKKKS

SEQ ID NO: 16074 - protein, 260 aa, Pseudomonas aeruginosa PAO1
MIKSAEEIQRMSVAGALTAKVLEALDEVVRPGISTAEIDRFCERYIVDTLAAIPGSKGQYGYPFTVNTSVNEVVCHGWPSAQQILRDGDIVNVDVTVIKDGYFGDSSKMYRVGAIDRQAQKLLDVTRECLYRAIRVVRPDATLGDIGHAIQSHAEANGYSVVREYCGHGIGRKMHEAPQVLHFGRAGAGARLKAGMTFTIEPMINQGGHAVKLHKDGWTVTTRDRRLSAQYEHTVLVTERGCRVLTLRDEEREALADLAG

SEQ ID NO: 16075 - protein, 205 aa, Pseudomonas mendocina
QQIVTLTYPHIGNTGTTPEDAESNRVWAAGLIIRDLPLISSNWRDKQPLDEYLKANGTVAIAGIDTRRLTRILREKGSQNGCILVGDDATEEKALELARSFPGLKGMDLAKVVSCTEHYKWRESTWNLQSESHPEIPASELPYHVVAYDYGVKLNILRMLVERGCRLTVVPAQTPASDVLALNPDGVFLSNGPGDPEPCDYAIQA

SEQ ID NO: 16076 - protein, 440 aa, Vibrio parahaemolyticus RIMD 2210633
MNDFSYITDIQQSAIKQTRLIQIRGRVTQVTGTIIKAVVPGVRVGELCELRNPDQTLSLLAEVVGFQQHHALLTPLGNMFGISSNTEVSPMGKMHEVGVGDHLLGKILDGLGRPFDGAQSQEPSAWYPVYRDAPPPMQRKLIEKPISLGVRSIDGLLTCGEGQRMGIFAAAGGGKSTLLAKLIRSADVDVTVLALIGERGREVREFIEHDLGEDGMARSVLVVATSDRPAMERAKAAFVATSIAEYFRDQGKRVLLLMDSVTRFARAQREIGLAAGEPPTRRGYPPSVFAALPKLMERAGQSDKGSITALYTVLVEGDDMTEPVADETRSILDGHIILSRKLAAMNHYPAIDVLRSASRVMNQIVEPDHQAYAAHLREMLAKYEEVELLIKIGEYQHGADPRADLAIAQSDDIRAFLRQGTHEPSDLEGAIAQLKGIAGQ

SEQ ID NO: 16077 - protein, 393 aa, Methanosarcina mazei Go1
MRPPCDPSKFIAEAVKSIPPSGIRRFFDLVSGLEDIISLGVGEPDFITPWHIREMCIHSLEKGQTSYTSNSGLPELRDELTRTYYRRYGLDYNPESEILITTGVSEALDIAIRAVVNPGDEVIVVQPSYVAYVPSVIMAGGKPVIVSTHRDDDFSLTAEVLEPAITSKTKAIVLNFPNNPTGAIMQKEGMEDIADLVVENDLFLISDEVYECLTYEGTHVPFSSLEGMKDRTVMLNGFSKAYAMTGLRLGFAMGAPDIIHSMMMIHQYCMLCAPITAQVGAIEALRNGKGEMERMVREYDRRRHFIVNGFNRIGLECCNPKGAFYAFPYIGDTGLSSSDFAERLLNEKKIVTIPGDVFGEAGEGFLRCAYAASLDDIKKAIERMGDFVDGLKQ

SEQ ID NO: 16078 - protein, 398 aa, Hyphomonas neptunium ATCC 15444
MPSFKRIPDAGNLTGKVALVRVDFNVPMENGLVTDDTRLRAAVDTVQSLRTAGAKVALLAHFGRPKGERVAEMSLAPIAGAFAKVLGANVSFVADCKGDHVKSAIADLLPAGVILLENTRFYKGEEKGDMELAKEIAALGDLYVNDAFSAAHRRHVSTAVLADLLPAYAGVTMEAELDALDKALGAPERPVMAIVGGAKVSSKIDLLKNLVSKVDMLAIGGGMANTFLAADGVNVGKSLCEHDLAPTVREIQAAAKAAGCEILLPKDVVVAKEFKANAENRTCGLNEIGADEMVLDAGAATITYLSEALGRAKTVIWNGPLGAFEMTPFDTATVKVAETAAKLAKSGALVAVAGGGDTVAALNHAGVAQDFTFISTAGGAFLEWMEGKELPGVEALLK

SEQ ID NO: 16079 - protein, 516 aa, Hyphomonas neptunium ATCC 15444
MTDIVVPTLGESVTEATVGQWLKSAGDAVKKDEVLVELETDKVSVEVSASEDGVLSEIVAKEGDTVDIGALLGRLNANGAAKPAPAKEAPKAEAKAEPKAEPKAAEAKPAASSGGGASTDVKVPVMGESVAEGTIANFAKKVGESVKKDETIAEIETDKVALEVPAPADGVILEWLVKEGDSVTPGSVIARIGASGAAPAKAAEAPAKAEAPKAAAQPAATGDRPVSPSVRRISTEAGVSASDIPGTGRDGRATKADALAYVNQPKASASTMPDTAAKPPRETGPREERVRMTRLRQTIARRLKEAQDTAAMLTTFNDVDMSAIMDLRKQHQDAFVAKHGIKLGFMSFFVKACVNALKEVPAVNAEIDGQDVIYKNYYDIGVAVGTEKGLVVPVVRDADDLSLAGIEKAIAALGKKARDGDLTIGDMQGGTFTISNGGIYGSLMSTPILNPPQSGVLGMHRIEDKPIVRNGQIVIKPMMYLALSYDHRIVDGKEAVTFLVRVKEALEDPERMLLEV

SEQ ID NO: 16080 - protein, 205 aa, Pseudomonas mendocina
QQIVTLTYPHIGNTGTTPEDAESNRVWAAGLIIRDLPLISSNWRDKQPLDEYLKANGTVAIAGIDTRRLTRILREKGSQNGCILVGDDATEEKALELARSFPGLKGMDLAKVVSCTERYEWRESTWNLQSDSHPEIPASELPYHVVAYDYGVKLNILRMLVERGCRLTVVPAQTPASEVLALNPDGVFLSNGPGDPEPCDYAIQA

SEQ ID NO: 16081 - protein, 193 aa, Glycine max
MACTIDFRCLDEGFGGKTYKRKREQQSQPQHDAAADDVIDGASLMDTDDALPPPAKRSALPSSENPDKPAFGHPSYDGVIAGRVSGRKWKQVRQRRASAAQVSRKGTTFEQREREKVIKKAYKERMMELKEEIRLNKVEKRKKKEEREKKKQENIIRSGTKFQKITNPNTLKKIAKSKQRKQLRVVPDELVRK

SEQ ID NO: 16082 - protein, 65 aa, Glycine max
MTTSKRLADRKIARFEKNISKKSSENSKKGYAYPVGPIVLGFFVFVVVGSSLFQIIRTATSRGMA

SEQ ID NO: 16083 - protein, 476 aa, Xanthomonas axonopodis pv. citri str. 306
MFKQLWATKHPHASHEAADGLGLQRALGPWGLTALGIGAVIGGGIFVITGQAAADHAGPAIMLSFVLAAVCCAFCAMAYAEFAAMVPVSGSAYTYTYATFGELAAWFIGWMLVLEYGVSASAVAVSWTGYFLSLLEHFDIHLPAAFVSAPLDGKLQPTGAIANLPAAGIVLLLTWLCYVGIRKSSAMNMAMVILKTGLILLVIAVGWKYVDTSNWHPFIPANEGPGKYGMEGVLRGAAMVFFAYIGFEAVSVAAQESHRPQRDLPIGMILSLVICTVLYIAMAAVMTGLVPYTLLGTDEPVVTAVAAHPQLAWLRVVVEVGALIGLSSVVLVMIIGQPRIFMIIARDGLLPSIFTRIHPKYRTPHVNTVITGVGIALLAAVFPLDVLGELTSMGTLIAFAAVCAGVLILRRTHPELPRPFRMPAAWLICTAGVLSCLALLSAMTLHNWMLMGLWTLVGLVIYFGYGYRHSRLRDGR

SEQ ID NO: 16084 - protein, 321 aa, Magnetococcus sp. MC-1
MGIHNQPKRDLLSLFDLRDEEFTVLFQRATTLKRKLERHEPVHSLDGRTLAMLFEKSSTRTRVSFEAGMFQLGGKALFLSSRDIQLGRGEGVKDSARVLSRYVDGIMVRTFDHANVEIMAEYASVPVINGLTDTLHPCQVLADIFTFEEKRGSLKGKRVAWVGDGNNMANTWIQAAVRYGFHLTLACPLGYEPDGDILSAARKELAEREVDASLTLVRDPRQGVDRAHLVTTDVWTSMGQEGESDTRKAVFAAYQVDSGLMAAADAEALFMHCLPAHRGEEVTAAVLEGSQSVVWDEAENRLHVQKAILEFLMLGGVPAEA

SEQ ID NO: 16085 - protein, 1422 aa, Zea mays
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKIIYTFHDDSRRDKPSRGGRYTVKLGRAGRAQHVCFGNTASVRHISRLDLEASPDVFVMHLPALACALINAGLPNSRLVRDATPPPYRPPRRLTSHHTSRLPSAISPWPLPCPFTDTSPPQPPVDRSAIGMDAGSVTGGLAAGSHMRDELHVMRAREEPNAKVRSADVKTCRVCADEVGTREDGQPFVACAECGFPVCRPCYEYERSEGTQCCPQCNTRYKRQKGCPRVEGDEEEGPEMDDFEDEFPAKSPKKPHEPVAFDVYSENGEHPAQKWRTGGQTLSSFTGSGEWCAVPLTMMLACRKMGLLTNMSPRAVAGKDLEAEREMEGSMEWKDRIDKWKTKQEKRGKLNHDDSDDDDDKNEDEYMLLAEARQPLWRKVPIPSSMINPYRIVIVLRLVVLCFFLKFRITTPATDAVPLWLASVICELWFAFSWILDQLPKWAPVTRETYLDRLALRYDREGEACRLSPIDFFVSTVDPLKEPPIITANTVLSILAVDYPVDRVSCYVSDDGASMLLFDALSETAEFARRWVPFCKKFAVEPRAPEFYFSQKIDYLKDKVQPTFVKERRAMKREYEEFKVRINALVAKAQKKPEEGWVMQDGTPWPGNNTRDHPGMIQVYLGNQGALDVEGHELPRLVYVSREKRPGYNHHKKAGAMNALVRVSAVLTNAPFILNLDCDHYVNNSKAVREAMCFLMDPQLGKKLCYVQFPQRFDGIDRHDRYANRNVVFFDINMKGLDGIQGPVYVGTGCVFNRQALYGYDPPRPEKRPKMTCDCWPSWCCCCCCFGGGKRGKARKDKKGDGGEEPRRGLLGFYRKRSKKDKLGGGSVAGSKKGGGLYKKHQRAFELEEIEEGLEGYDELERSSLMSQKSFEKRFGQSPVFIASTLVEDGGLPQGAAADPAALIKEAIHVISCGYEEKTEWGKEIGWIYGSVTEDILTGFKMHCRGWKSVYCTPTRPAFKGSAPINLSDRLHQVLRWALGSVEIFMSRHCPLWYAYGGRLKWLERFAYTNTIVYPFTSIPLLAYCTIPAVCLLTGKFIIPTLNNLASIWFIALFLSIIATSVLELRWSGVSIEDWWRNEQFWVIGGVSAHLFAVFQGFLKVLGGVDTSFTVTSKAAGDEADAFGDLYLFKWTTLLVPPTTLIIINMVGIVAGVSDAVNNGYGSWGPLFGKLFFSFWVIVHLYPFLKGLMGRQNRTPTIVVLWSILLASIFSLVWVRIDPFIPKAKGPILKPCGVEC

SEQ ID NO: 16086 - protein, 493 aa, Xanthomonas axonopodis pv. citri str. 306
MYRMLKSLLRVKPIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGIAYIDPANWHPFIPENTGPGQFGWDGVFRAASIVFFSYIGFDAVSTSAGETKDPQKNMPIGILVSLAICTIIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLARPFRVPLAMVICPLGALACLFLFFQAFQEHWKVFVGWTVIGLAIYFGYGIHHSRLAKRA

SEQ ID NO: 16087 - protein, 359 aa, Dehalococcoides sp. CBDB1
MYHNVTLIPGDGIGPEISEATRRVLEATGVKFNWEVVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSAEALRLIEFIKENKKVEIRTDSGISIKPISVFGTERIFRWAFKYAKDNNRKKVTAVHKANIMKYSDGLFLAVGRKVAEEYPEIEFEDRIVDNMTMQLVKTPTQFDILVCPNLYGDILSDLCAGLVGGLGVAPGANIGDEYALFEPTHGSAPKYKGLNKVNPMAMMLSGVLMLRYLKEEKAADKLENAIAAVIAEGKSVTYDMLSPDKQAVAVGTSQVADAIIAKMK

SEQ ID NO: 16088 - protein, 112 aa, Magnetospirillum magnetotacticum MS-1
MLREHGTERAHTSPLNAEKRPGRFVCAGCDLPLFSSRTKFESGTGWPSFFEPLPDAVGTQVDTAYGMRRTEVHCRRCGGHLGHVFEDGPKPTGLRYCMNGVSLRFEPAAGPA

SEQ ID NO: 16089 - protein, 391 aa, Magnetococcus sp. MC-1
MSDKVSSIMSTYGRYPVAFERGEGVRLWDTNGRVYLDFLSGIGVNNLGHSHPTVVKAVQEQVAKLTHTCNLYRIPNQEALAARLVATCFADQVFFSNSGADANEAAIKLVRKYMKDRGQPGRYEIITATNSFHGRTMATLTATGQEKVQSGFEPLVPGFRYVPYNDMEAMEKAVGPYTAAIMVEPIQGESGVRVPDADYLNQLRALCDRKDILLVLDEVQSGMGRTGKMWAYQWSDIEPDIMTSAKALASGVPMGACLARRGVAAAFAPGSHGSTFGGNPLSAAAALATLDVMLAPDFLPTVQARGDYFMNALRQLAQGRRMVKQIRGRGLMVAMELNAPGEEVASIALSRGLLINCCMGTVLRFLPPLVVSEQEIDQGLAILGEVLSDLF

SEQ ID NO: 16090 - protein, 286 aa, Streptococcus mutans UA159
MITLKSQREIEAMDEAGDFLASIHIGLRDLIKPGLDMWKIEEYVRRRCKEENYLPLQIGVDGQLMDYPYATCCGLNDEVAHAFPRHYILKDGDLLKVDMVLGGPIAKEDLDVSKLNFDNVAQVKKYTDSFRGGVADSCWAYAVGDVSQEVKNLMAVTKECLYRGIEKAVVGNRIGDIGAAIQEYAEANGYGVVRDLVGHGVGPTMHEEPNVPHYGRAGRGLRLKEGMVLTIEPMINTGTWEIDTDMNTGWAHKTLDGGLSCQYEHQFVITKDGPRILTSQGQEGTY

SEQ ID NO: 16091 - protein, 476 aa, Agrobacterium tumefaciens str. C58
MNEQSRKITPVLLAGGAGSRLWPVSRDQLPKQFQPLVGNLSTYQQTLKRVGDKSLYSEPLVITNEDFRFFARRQAEEIDLPATVVLEPARRDSAAAMAAAAVLAERREPGCLVLALAADHVVLDVDKFSEAVKLGAKAADQGNIVVFGLVPTEPRTSYGYIKPGDAIDGEKDLSTVDAFVEKPDVTTAISYLEKGYLWNSGNFLFRSDVMIAELKAFAPEILAAVTQAVEQYESDLGFVRLHQASFEASPKNSIDYAVIEKTKRMAVVHGHFRWSDIGSWDAIWEIADKHDNDNALEGDGVFIDSEGCLIHSTQLLTTVVGAKDLVVVATKDAVLVVPKNRVQDVKGLVDTLKGGDHAPQTQTHKRVYRPWGYIEHMYVDQRYRVGHITVDPGHRISFQKHYHRSEHWIVVKGTATVTIGEETRLLTENQSVYIPIGQPHRLANEGQIPLELVEIQTGAYLGEDDVIRIEDDYKRQ

SEQ ID NO: 16092 - protein, 492 aa, Xanthobacter autotrophicus Py2
MAAPQPLSRPATARFPLLRDKMLIGGAWVDADSGATIEVNNPATGEIIGTIPKAGAAETRRAIEAASEAFKTWRATTAAERAAKLHKLADLITQNADELAAILTTEQGKPLAEAKGEIGASAGYVRWFAEEARRLYGDVIPSPWGNRRILVTKEPVGVVTAVTPWNFPSSMLSRKIGAALAAGCTVVAKPSELTPYSGLAWGVLAEMAGIPAGVVNIVVGEAPAIGGEMTSNPLVKKVTFTGSTPVGKLLMKQSADTMKKISMELGGNAPFLVFDDADLDLAVEQAIASKFRNVGQTCVCANRFYVQAGIYDAFAAKFAEASKKLKVGNGLDEGVVAGPLIDDRALAKVERLLKDALDKGATVLTGGKQPALGGTFFEPTVLAGATQDMAFARDEIFGPLAPLFKFETEEQAVSYANDTEYGLACYFFTKDLGRAFRVAEKLEYGQVGINAGVITTEVAPFGGVKESGMGREGSKYGCDDYLNIKYMCVGGL

SEQ ID NO: 16093 - protein, 339 aa, Salmonella typhimurium LT2
MKSIVIEKPNTLTIETRALPQPAPGEVRIKVKLAGICGSDSHIYRGHNPFAKYPRVIGHEFFGVIDAVGDNVNHDRIGERVSVDPVISCGHCYPCSVGKPNVCTSLVVLGVHRDGGFSEYAVAPARNAHRIPDNIADHHAVMVEPFTIAANVTGQVNPTEQDVALIYGAGPMGLTTVQALKGVYQVKTVIVVDRIEERLAMAKQSGADWTLNNGQHSLAEFLQQKALKPTLIVDAACHPAILQEAITLASPAARIVLMGFSSDPCEIVQQGITGKELAIYSSRLNANKFPVVIDWLNKGLIDPDKLITHTFDYQHVTDAIELFEKDQRQCCKVLLTFAK

SEQ ID NO: 16094 - protein, 383 aa, Coprinopsis cinerea okayama7#130
MQNKVTVVSGEAAREAIYTYKGLNLLEAFKFVSGSLPVVKDANPADLAIVLKRLMELQRNESLSNIRALAAKEMADDYTFIQKLRKIYDDLDDSTTPTTVLFPWLPSPSMIKKVWSAKKVYDIIVNAINERRMSGIRQDDTLQLLLDHDDSRYTIVSFIMGFIIAGARATGVTASWLLIYLGGYPEWRTKVVEEIEALLQNHSSNPSSDPLSARLATVPLEAWESDMPILESAIREVTRIAQPHVAMRLNEGPDVLIDNKLIPHGSYVLYPFSDIHLDPDVYPEPWTFNPGRTPPTDVPLSFVGFGGGRTVCVGNRLAKLELKLIVAMYLLSYDHSVVKRSNIKEPVFRGAVPKPNWNDGLTCRPEDKSQDMFFAHSRTSVQV

SEQ ID NO: 16095 - protein, 418 aa, Bacillus pumilus SAFR-032
MAEIKVPELAESISEGTIAQWLKQPGDYVEQGEYLLELETDKVNVELTAEESGVLKEVLKDSGDTVQVGEVIGTIAAGEAGGSESAAPAPEQESAPAPKDEPAAAQKEEAVKEEPKSGNGRTIASPAARKLAREKGLDLSEIPTVDPLGRVRKQDVASYQKNEAPASAPKAAPKANAAVQNEQAGKPVERERMSRRRQTIAKRLVEVQQTAAMLTTFNEVDMTAVMDLRKRRKDAFLEQNDVKLGFMSFFTKAVVAALKKYPLLNAEIQGDELVLKKFYDIGIAVAANEGLVVPVVRDADRLSFAGIEKEIGHLAKKARDNKLSLNELQGGSFTITNGGTFGSLLSTPILNSPQVGILGMHKIQLRPVAIDEERFENRPMMYLALSYDHRIVDGKEAVGFLVTIKNLLEDPEQLLLEG

SEQ ID NO: 16096 - protein, 152 aa, Synechococcus sp. WH 7805
MASERTFIAIKPDGVQRGLIGEILGRFERKGFKLVGLKQLTPSRELAEQHYGVHKERPFFAGLVDFITSGPVVAMVWEGDGVIASARKLIGATKPLEAEPGTIRGDLAINIGRNVIHGSDAPETAQFEIGLWFQASELSDWTPSDQGWRTEG

SEQ ID NO: 16097 - protein, 80 aa, Oryza sativa Indica Group
MVANGDAPARGSAAAAASLRRRRTTSSGTGGGGASTMLQFYTDEAAGRKMSPNSVLIMSIGFIAVVALLHVFGKLYRTST

SEQ ID NO: 16098 - protein, 589 aa, Lactobacillus acidophilus NCFM
MKKTKIVSTLGPASNDIETITALANAGANVFRFNFSHGDHEEHRSRMNMVREVEKNTGKLLGIALDTKGAEIRTTEQEGGKFTINTGDTIRISMDDTKKGNKDMIHVTYDGLYDDTHVGGHVLIDDGLVDLLIKEKDDAKRELVCEAQNTGLIGSKKGVNAPGVEIRLPGITQKDTDDINFGLKEGINFIFASFARKAQDILDIRKLCEAAGADYVKIFPKIESQEGIDNADEILQVSDGLMVARGDMGVEIPFMEVPFVQKNLIRKANALGKPVITATQMLDSMQENPRPTRAEVSDVANAVLDGTDATMLSGESANGLYPVNAVKAMAEIDERTEKQMLKRNTLALQRFEAYKGSNVTEAIGESVVRTAQELGVKTIIAATNSGYTARMISKYRPNADIVAMTFDEKIQHSLAVVWGVQPVLTDKPKSTDDMFEKAAEVAKEKGYVKDGDLVIIVAGVPVGDSGTTNLMKLQIIGNKLVQGLGVGNGSVIGKAVVANSAEEANSKVKEGDILVAKTTDPDYNPAIKKASGLVVEASGLTSHAAVIGLSLGIPVVVGATDATEKISDGSTITVDARRGAIYQGEISNL

SEQ ID NO: 16099 - protein, 282 aa, Oryza sativa Indica Group
MSIPGNGHLPASTDLPDHSSSASDPEADYRPISAAATDSDTDTDPDPAPHHRLGSIGNGVSELDLDSGGDDDHCEGADGEDTVAVRRRKAWGLGRRRPMQAEMLLLLGKFVDKSFGVTFVCSCCCMEGILVKPLKRRVPGKSQQHDIFLSLRTTAATPFSIRESTGSEPPISRLRRRPTGVQNPNPNPSEEEGGGGGRRGEMVYYALYWWADLDNLTNLQPRYGCDDPTYPYYFKLRCENCGEVSAKATCVSLGEVVDLPNGRSTANLVQKVLCHSTRPLVP

SEQ ID NO: 16100 - protein, 641 aa, Prochlorococcus marinus str. NATL2A
MLISLVNASTDFGIKNLFKNLDLHVNKKERLGLIGPNGSGKSTLLRVIAGIEPLMEGERRCLPSLRISLVGQETSYNSEKSVLEEVLEGCGEKRKLLLNFSQLSRKIAQNPEDEDLLKKLGQASELMDAAEAWNLEQQCQDVLRRLGIKDLDKPVKELSGGYRKRVGLAAALVSNPDVLLLDEPTNHLDASAVEWLQNWLDHYKGALVLITHDRYVLDRITNRMVEINNGETRKYSGNYREFLQQKVEQEQSEASTKKKFQGVLRKELAWLRQGPKARSTKQKARIQRIAEMQAKPKSHVKANLEMNSLSRRIGKIAIEAEGVGLSLNNKENNLDLLCDFTYSFSPEDRVGIIGPNGSGKSTLLDLISGKRLPTSGKIKLGETVHIGYLDQHTNDLNQGSGLNRKVIDFVEEAALRIDHGGKQITASQLLEKFLFPPSQQHSPLQKLSGGEKRRLALCKMLIQAPNVLLLDEPTNDLDIQTLSVLEDFLDDFKGCVVVVSHDRYFLDRTIDRIFNFENGYLRRYEGNYSRFLDHKILEERNNETKERAKIVNNSKNKRGQEIKLVSKNDPRRLSFKEARELKELDLRLPMLEKKKIYLEKKITDNDVDISEISHQLAELIESIQEYEDRWIELSELSESAK

SEQ ID NO: 16101 - protein, 720 aa, Petunia integrifolia subsp. inflata
MMTEVHDAGRPRVVIFNGSQLQREAIIPFASRSSCFHHQLCSRGHLLIIFLLLVSPFNDAAVDVDGDDNDNLIIDHVPDAKSSSEALLNFKSSLSTSSPRGHEVLGSWIPSNSPCSGNNGNWLGVLCYEGDVWGLQLENLDLSGVIDIDSLLPLHFLRTLSFMNNSFKGQCLIGISLEPSSHCTCPIIASPVRSRMMLPGYDLSQEALFGKQPIQRQHPHLPGYLLPQVFELSLENNRFTGSIPHFPPNVLKVLNLSNNQLEGPIPPALSLMDPTTFSGNKGLCGKPLESACNSPSQEANNPDSRNSSTISGQSSTDVIRKSPTRLSKVMLIVAVCLVVLCLLIVLILIIRRRSHSSSQNPQPVESNYSNNDRDQNAFTSSAPDDHVTLSGNSTYSNNQHSNSNKAEAPTAAVVGKLSFVRDDRPRFDLQDLLRASAEVLGSGNLGSSYKALLMDGQAVVVKRFKQMNHVAKEDFHEHMRRLGRLTHPNLLPLVAYYYRKEEKLLVYDYASNGSLASHLHGNQSRLDWSSRLKIVKGVAKALAYLHNELPSLALPHGHLKSSNVLLDKYLNPVLMDYTLVPLVNLAQVQHLLVAYKAPEYAQQGRITRKTDVWSLGILILETLTGKFPTNYLALSTGYGTELATWVDTIIRDNESAFDKEMNTTKDSQGQIRKLFDIGVACCQEDLDTRWDLKEVVQSIQSLNDKDHGHSNSDQMHDAGV

SEQ ID NO: 16102 - protein, 327 aa, Hyphomonas neptunium ATCC 15444
MAGTVKLEGGVTLDGPRGRIYGSILETVGATPLVRAEKFAKAEGVDADILFKLEFFNPLASVKDRIGLAMILGLEAEGKLKPGGVLIEPTSGNTGIGLAFVAAAKGYRLILTMPESMSVERRKMLAYLGAELVLTPKEKGMGGAIARANELLAEIPGAVSPSQFDNPANPAIHEKTTAEEIWSDTAGAVDAIVSGIGTGGTFTGVGRVLKPRKPSLKMFAIEPEASPVLSGGAPGPHMIQGIGAGFVPGNADTSLIDEIVKVSNEESFAMARKLAKTEGIPGGISSGAAAAAAVRIGKRPEMAGKTIVVILASFAERYLSTALFDGV

SEQ ID NO: 16103 - protein, 174 aa, Pseudomonas putida KT2440
MLAAYHGDPAARSVDEVLLCYPGILAIIHHRLAHHLYKAGLPLLARISSELAHSATGIDIHPGAQIGPSFFIDHGTGVVIGETAIIGERVRIYQAVTLGAKRFPSDESGTLHKGLPRHPIVEDDVVIYAGATVLGRITIGKGSTIGGNVWLTRSVPAESNITQANLQLDCQDKN

SEQ ID NO: 16104 - protein, 205 aa, Pseudomonas mendocina
QQIVTLTYPHIGNTGTTPEDAESNRVWAAGLIIRDLPLISSNWRDKQPLDEYLKANGTVAIAGIDTRRLTRILREKGSQNGCILVGDDATEEKALELARSFPGLKGMDLAKVVSCTEHYEWRESTWNLQSDSHPEIPASELPYHVVAYDYGVKLNILRMLVERGCRLTVVPAQTPASDVLALNPDGVFLSNGPGDPEPCDYAIQA

SEQ ID NO: 16105 - protein, 455 aa, Mycobacterium tuberculosis
MSAVALPRVSGGHDEHGHLEEFRTDPIGLMQRVRDECGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSACLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPACVRYRRRTGVHHHH

SEQ ID NO: 16106 - protein, 491 aa, Candida glabrata CBS 138
MKPELKNPDLIKGLGYINGEWVKDSNEFFEVDDPSTGEIIAKLPEHDIAVVDRAVDAAYDAFQKYKNTLPRQRATWLRNLFNLMTENAEDLAKIITWENGKSLPDSRAEIKYAASYYEWYAEEAPRIYGATIQPSIPNNRVITKRQPVGVCGIICPWNFPSAMITRKVGAALAAGCTVVVKPDSHTPLSALAMTVLVEKAGFPKGVFNVVLSQHNTPKLGKRLCEHPKVKKVTFTGSTRIGKTLMEQASSTLKKCSFELGGNAPFIVFDDADLDLAVDQAIASKFRGMGQTCVCTNRFYVQDTIADEFAEKLVTKVKQFKIGDGMKEGVTHGCLTNAKQADKVDEHKKDAIEKGAKVLLEGGRMPDLGKNFYAPVVLKNVPQSAMVAKEETFGPLCPIFTFKTVEEVLGYANDTELGLASYVFTKNVNTLFTVSEALEAGMVSCNTGLFSDSSVPFGGVKESGFGREGSLYGIDDYTTVKSIIIGNLPDSL

SEQ ID NO: 16107 - protein, 269 aa, Candidatus Protochlamydia amoebophila UWE25
MRIGILGCGYVGQAAAVFWKNQSHFLTVTTRQIEKINFLQTFAHQVHQLTDDNILPFLANQDILLVSVAAASSRDYQNTYLETARRIIELLPQTPSLKQIIYTGSTSVYGDFQGNWVDETTLLNPLNEQSYCLSQTEQFFLKAPSSVNVTIFRLGEIYGPGRWITDRVIRMHQYSFPGTGNQLTNVIHLTDIVRALDFALQNKLHGIFNLCNDFHIPRKLFYEQLLQSAHLPSIQWDANKPSLHGGNKKVSSSKLKKLGFSFLENGPAR

SEQ ID NO: 16108 - protein, 352 aa, Arabidopsis thaliana
MATAMEEPRKLRGHKSTATCCIASRDRPGIVLTSGEDGCICWFDLRCKDVQFIIDVGTEPVSSLCFKTGNENILYASCGNEIKSFDVHTLSATSWKPLESYNYNKDEVNQVVCNGRSSFLASADDSGDVKIIDLGQKCLYKTLRAGHTSPRKNVSNQHLNETYKICSSVQFIPWRPWEVITGGLDSKLVLWDFSKGRSQKIIDFGSDTNNNSGQCLNPAFVHSIAIPEMDMVDKLDKICAVARGDGIVNLINIESELSRKGTSSKGSSSSSSNNVVKREKGRFLISGGNDKTVKIWDCFKCLDPNNNNNNSDLLHLNINLSKKVNWLCTNQSDSENLVVCDTTRVVKVYSIS

SEQ ID NO: 16109 - protein, 358 aa, Bordetella bronchiseptica RB50
MTHQIAVLPGDGIGPEIVEQAERVLKALDLPLELRQAPVGGAAFDQFEHPLPPATLELAQGSHAVLFGAVGDWKYDTLPREFRPEQAILGLRKALGLFANLRPAILYPELASASSLKPEIVSGLDILIIRELTGDIYFGTPRGVRTAADGAFAGEREGYDTMRYAESEVRRIARIGFESARKRNKKLCSVDKANVLETSQFWRDLVIEVSRDYPDVELSHMYVDNAAMQLVRNPRQFDVIVTGNLFGDILSDEAAMLTGSIGMLPSASLNAAGQGLYEPSHGSAPDIAGQGIANPLATILSAAMLLRYSLNLAPQADRVEAAVRKVLADGLRTADIHEAGTTKVSTSQMGDAVLKALG

SEQ ID NO: 16110 - protein, 276 aa, Zea mays
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTLIFVFAGQGSGMAFSKLDRRRPDDPGGA

SEQ ID NO: 16111 - protein, 205 aa, Pseudomonas mendocina
QQIVTLTYPHIGNTGTTPEDAESNRVWAAGLIIRDLPLISSNWRDKQPLDEYLKANGTVAIAGIDTRRLTRILREKGSQNGCILVGDDATEEKALELARSFPGLKGMDLAKVVSCTERYEWRESTWNLQSDSHPEIPASELPYHVVAYDYGVKLNILRMLVERGCRLTVVPAQTPASDVLALNPDGVFLSNGPGDPEPCDYAIQA

SEQ ID NO: 16112 - protein, 205 aa, Pseudomonas putida
QQIVTLTYPHIGNTGTTPEDAESNRVWSAGLVIRDLPLVASNWRSTMPLSDYLKANNVVAIAGIDTRRLTRILREKGAQNGCIMAGDNISEEAAIAAARGFPGLKGMDLAKVVSTTENYEWRSTVWDLKTDSHATIEASELPYHVVAYDYGVKLNILRMLVERGCRVTVVPAQTPAADVLALKPDGVFLSNGPGDPEPCDYAIQA

SEQ ID NO: 16113 - protein, 375 aa, Oryza sativa Japonica Group
MAITVSIYLVKMPIYLETRGTSRISLVVHHIRRRTHSSSSSRLRFQRGGGAEQRRGMAAAQGSGVPAALALSSGHTMPSVGLGVWRMDSPAIRDLIHSALRIGYRHFDCAADYQNEAEVGDALAEAFQTGLVKREDLFITTKLWNSDHGHVVEACKDSLKKLRLDYLDLYLIHFPVATRHTGVGTTASALGDDGVLDIDTTISLETTWHAMEDLVSMGLVRSIGISNYDIFLTRDCLAYAKIKPAVNQIETHPYFQRDCLVKFCQKHGILVTAHTPLGGSTANTEWFGSVSCLDDPVIKSLAEKYGKTPAQLVLRWGLQRNTVVIPKTSKEERLQENFAVFDFAISDEDMEKMRSIDRKYRTNQPAKFWGIDLFA

SEQ ID NO: 16114 - protein, 309 aa, Mycoplasma mycoides subsp. mycoides SC str. PG1
MNKVIYLAGGCFWGVEAYFSKLKGVIDAENGYANGISEKTKYYSLAKTLHAETVKVTYDPNQISLEELLVHYFRIIHPDSLNKQGNDVGTQYRTGVYYTDINDKKVIELVFLEYKKQYDEFYVELEELKNYMTAEDYHQDYLDKNPTGYCHVNLNVDFNLTDKEQELIKLIRKELSLDELSLNVLKYSATEKPHTSEFNDEHRKGIYVEKITKEVLFASNTKFNAGCGWPSFANPINSKAVEYKADYSHNMHRVEVRSKTGDNHLGHVFNDGPKEMGGLRYCINGAALEFIPYEEMDEKGYSEYKKFLD

SEQ ID NO: 16115 - protein, 375 aa, Vitis vinifera
MSNDKDQFNIADLGAALPAAAAALSAEDRAGLVNALKNKLQNLAGQHSDVLETLSPNVRKRVEFLREIQGQHDELEAKFFEERAALEAKYQKLYEPLYTKRYEIVNGVVEVEGVTNEAPMDQEEDKATEEKGVPNFWLTAMKTNEVLAEEISERDEGALKYLKDIKWYRIDNPKGFKLEFYFDANPYFKNSILTKTYHMIDDDEPILEKAIGTEIEWYPGKSLTQKLLKKKPRKGSKNAKPITKTENCESFFNFFNPPQVPEDEEDIDEDVAEELQNQMEQDYDIGSTIRDKIIPHAVSWFTGEAVQGDEFEDIEDDDDEDGDDEDEEDEEDEDEEEDDEDEDEEEEDKSRKKKSGRSRAGEGQLGERPPECKQQ

SEQ ID NO: 16116 - protein, 537 aa, Arabidopsis thaliana
MAGQKQELPVSGEPLAVESPMTNKKKKKSKKNKHTEENHEVEEVPQEVTNGVEEELSNKEKKKKRKREEKESEKNKKKDVPEKKLEAEDLGEGESEQQKVVVTGKGVEEAKYAALKTFAESNLPENVLDCCKTFEKPSPIQSHTWPFLLDGRDLIGIAKTGSGKTLAFGIPAIMHVLKKNKKIGGGSKKVNPTCLVLSPTRELAVQISDVLREAGEPCGLKSICVYGGSSKGPQISAIRSGVDIVIGTPGRLRDLIESNVLRLSDVSFVVLDEADRMLDMGFEEPVRFILSNTNKVRQMVMFSATWPLDVHKLAQEFMDPNPIKVIIGSVDLAANHDVMQIIEVLDERARDQRLIALLEKYHKSQKNRVLVFALYKVEAERLERFLQQRGWKAVSIHGNKAQSERTRSLSLFKEGSCPLLVATDVAARGLDIPDVEVVINYTFPLTTEDYVHRIGRTGRAGKKGVAHTFFTPLNKGLAGELVNVLREAGQVVPADLLKFGTHVKKKESKLYGAHFKEIAADAPKATKITFDNSDDED

SEQ ID NO: 16117 - protein, 619 aa, Emericella nidulans
MRSIDQPLLTRLPSSGRAQTSQLPLTMYNAHRGMVPAPNSRLNELLDQLRQEFENQSRSTGEFEHQLTGQLQEMEMIRQKVYQLEQAQLKMKQDYEAEIRMLRHELESRGVQPVASHVAVPAQHGGPSQAPPPALGHGPSNLFGGIMANQGGSGPGLAPPPPQDQQPSQHTLQQPAAAAQPGAPQPPQSSFGGYQPWRCCYGPPPPPTASPGPGKRPRAPPGPATPQQAHQLAYPESRVSPQLARPTPPNQPVVRDRPGNMLANWNPEDLPPSQKKEGVDWYAVFNPEVQRVLDVELVHHLVHDSVVCCVRFSRDGKYLATGCNRSAQIFDVTLGQNVAVLQDESVDKSGDLYIRSVCFSPDGKYLATGAEDKQIRVWDIATRTIKHIFSGHEQDIYSLDFAGNGRYIASGSGDKTVRLWDIAEGKLVYTLSIEDGVTTVAMSPDGLYVAAGSLDKTVRVWDTTTGYLVERLENPDGHKDSVYSVAFAPNGKELVSGSLDKTIKLWELNLPRQQYNSAGKGGKCHRTFEGHKDFVLSVCLTPDGHWVMSGSKDRGVQFWDPITGNAQMMLQGHKNSVISVAPSPTGNLFATGSGDMRARIWRYASFPNPISLPKIWMLG

SEQ ID NO: 16118 - protein, 281 aa, Brassica napus
MSKEVSEEGHTQSHGKDYVDPPPAPFLDMGELKSWSFYRALIAEFIATLLFLYVTVATVIGHKKQTGPCDGVGLLGIAWAFGGMIFVLVYCTAGVSGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 16119 - protein, 280 aa, Hyphomonas neptunium ATCC 15444
MITVVGSVNLDFVASGKSLPHAGETVTGARLARHPGGKGANQALAARRLGADVRLVAAVGNDDMAEEALKLLRHGGVDLSATQYINGETTGVALIAVSAEGENQIIVCPGANDALDPGDVEGATIEHMMGVLEVPAATLLAAAERATGFVALNLAPAMKIPEALIARASLLIVNETEAAFYGPALHGPGRYVAISLGAAGAQLWKDGEMIASAAPPDVKVIDTTGAGDTFSAALTVSLIKGKSPEDALTYAVTAGSLACTKPGAQPSLPRRAEVEALLKS

SEQ ID NO: 16120 - protein, 430 aa, Synechococcus sp. WH 7805
MFDSLDLVIDTIVAREVLDSRGNPTVEAEVLLEGGASGRAIVPSGASTGAHEAHELRDGGDRYMGKGVIQAVNHIEERIAPALCGLSALDQAAVDAAMLELDGSDNKSSLGANAILAVSMANARAAANGLGLPLYRYLGGPMATLLPVPLMNVINGGAHAANSLDFQEFMLVPHGAPSFREALRMGTEVFHTLKGLLNDKGMSTSVGDEGGFAPDLGNVEAGEILVEAIEKAGYKPGEQISLALDVASTEFFADGRYAFDGGSFNSEEMVGQLEQLVEKFPIVSIEDGLAEDDWEGWKLLTERLGAKVQLVGDDLFVTNTKRLQQGIDSSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGKA

SEQ ID NO: 16121 - protein, 180 aa, Oryza sativa Japonica Group
MARDGASAAAAGGGGPPQQHPDVPRELLGVALHERPGLYFSILRAHRLVLQADSAFPQVMEKLQSYKARVTLNFEGFQYQLGDFCLRIGKCVPNNSETLRGIMMEVEYYPLSSIEKSRAVMEDFFDIWQETVAKKSLPGHFIHVESNFSEYGLSDHYSFQHTAVQYATCLQQLMAAVRPQ

SEQ ID NO: 16122 - protein, 448 aa, Zymomonas mobilis subsp. mobilis ZM4
MTDYDFDLFVIGAGSGGVRASRIAASHGASVAIAEEYRIGGTCVIRGCVPKKMLYYAADFAADLKKAQRFGWTLPEKKFDWATLRDVVLSDVTRLEGLYTQTLDNNHITHYKEHAVIDSANQIRLASGKKITARYILVAVGAEPAKLDILGAEYAVTSNEMFLLPSLPKRALVVGGGYIANEFAGILNSFGVETTIATHGDRILRGYDEEIAARLVEIGQGHGIDYRFNADIARIDKDSSGRLTTHFKDGSQIESDLVLFAIGRVAKSRDLGLDKADVKTNDRGAILVDEENRTSCPSIYAVGDVTDRVQLTPVAIREGQAFADRVFGHKAASVDYDTIPTAVFSHPPLASAGLTEEEAKKRYKNIKIYKSNFRPMRNALIDSPDRALYKMVVDGDSDKVLGLHLIGQDSPEIIQLAAVAIKAGLTKQAFNDTVALHPSSAEELVLMR

SEQ ID NO: 16123 - protein, 507 aa, Zymomonas mobilis subsp. mobilis ZM4
MARIANKAAIDAAWKQVSACSEKTLKQLFEEDSNRLSGLVVETAKLRFDFSKNHLDSQKLTAFKKLLEACDFDARRKALFAGEKINITEDRAVEHMAERGQGAPASVARAKEYHARMRTLIEAIDAGAFGEVKHLLHIGIGGSALGPKLLIDALTRESGRYDVAVVSNVDGQALEEVFKKFNPHKTLIAVASKTFTTAETMLNAESAMEWMKKHGVEDPQGRMIALTANPAKASEMGIDDTRILPFAESIGGRYSLWSSIGFPAALALGWEGFQQLLEGGAAMDRHFLEAAPEKNAPILAAFADQYYSAVRGAQTHGIFAYDERLQLLPFYLQQLEMESNGKRVDLDGNLIDHPSAFITWGGVGTDAQHAVFQLLHQGTRLVPIEFIAAIKADDTLNPVHHKTLLTNAFAQGAALMSGRDNKDPARSYPGDRPSTTILMEELRPAQLGALIAFYEHRTFTNGVLLGINSFDQFGVELGKEMAHAIADHPENSDFDPSTKALIAAALK

SEQ ID NO: 16124 - protein, 168 aa, Oryza sativa
  misc_feature (43)..(43): Xaa can be any naturally occurring amino acid
  misc_feature (130)..(130): Xaa can be any naturally occurring amino acid
  misc_feature (143)..(143): Xaa can be any naturally occurring amino acid
  misc_feature (145)..(145): Xaa can be any naturally occurring amino acid
MAAEGEKKMITLKSSDGEEFEVEEAVAMESQTIRHMIEDDCAXDNGIPLPNVNSKILSKVIEYCNKHVHAAAAAASKAADDAASAAAAVPPPSGEDLKNWDADFVKVDQATLFDLILAANYLNIKGLLDXTCQTVADMIKGKXPXEIRRLHIRPLREERSQVALIKQA

SEQ ID NO: 16125 - protein, 259 aa, Pseudomonas aeruginosa PAO1
MELTIFQVDAFADSPFQGNPAAVCPLDAWLDDERLQAIAEENNLSETAFVVGRDGDYRLRWFTPQVEVDLCGHATLATAWVLIHKLDDASPVLRFATRSGELSVRREGDSLAMDFPAKRPEPCATPDGLLEALGIAEAEVLKTDDYLVVVDDEKTIAALAPDFARLKGLPCRGVAVTARSQRFDFVSRWFGPNVGVNEDPVTGSAHTSLAPYWAQRLGKTRLSAEQGGARKGRLECDVRGERVVISGKAALYMSGTLHL

SEQ ID NO: 16126 - protein, 792 aa, Schizosaccharomyces pombe
MTFCTKYIQKVCEGLNTKINSFLVPPEENNDALFSKLSNLVSRLKSQTVIHNKSQILYFLYLLSPISQSSRDVSSHLLDESISNPINIPSTEVESSNFGQTRYDQVPENPQITDWDEGLENESSISIAHDSSRLNRSTETSSVQHTLITEADLLSSISYVLQGISTEYVQFKNELALLSKRIPVQYLLQMRALSETGLLYQELKVFSNYDPSVSQSIDGDNVSKAFINDQSLALQSLKSVISKELTNFLALIASLDSQIRADASLEKPMVTIRRCIAWTQVAKLKLRILSSVVNDNMNQENKKRLIQVVSKYNVHGDPLIQELSDKILTEITGPLYEMIENWIYKGELVDPYQEFFVKEKNGSESHDHQGQGDVVWKGKYFLDKELIPSFLSEELVDKIFLIGKSLNFARYGCGDFDWAQEHYQKLVKKLSYRDPHSLETVVDKAYTESINHLVYLMEEVFHLTDHLKAIKKYLLLGQGDFVDLLMESLGNSLDQPANTLFRHNLTASLESAIRSSNASYEPEYVLKRLDARLLELSHGETGWDVFTLEYKVDSPINVIITPYCSRQYLKIFNFLWRLKRIEFALAHSWRRVNLGERNVFRNLDYTKFEWHFVSCHLAEMIHFVCQLQYYILFEVIEISWQELQLAMEKPNATLDTYIEAHEKYVTSITHKGLLGGGKSRNEDSFLHQLHDILKVILNFHDAIELLYNFSCSLSNRIRINVPISTDALAAQYTPIKNELSNFTEEFQVRLQKLLHGLASHKDPEMRFLSVRLNYNEFYVSHRRRHDKDVTSQ

SEQ ID NO: 16127 - protein, 341 aa, Desulfovibrio desulfuricans G20
MSRYTELLRQLQEAPRTWLITGVAGFIGSNLLETLLSHGQTVTGLDNFMTGHRKNLDMVRDAVTPEQWSRFRFIEGDIRSLETCREACAGADYVLHQAALGSVPRSIDDPLLTNTCNIDGFVNMLVAARDADVRRFVYAASSSTYGDEPNLPKQEDRIGRPLSPYAVTKYVNELYADVFARTYGMECTGLRYFNVFGKRQDPEGAYAAVIPLWFAGLLRDQPVFINGDGETSRDFCHIDNTVQANLLAATAPDPEATNTVYNVAFGERTSLTELYGLIREEVARHNPHASEKEAQYRDFRAGDVRHSLADISRARTLLGYDPQISVRQGLRISGDWYAANL

SEQ ID NO: 16128 - protein, 205 aa, Pseudomonas fluorescens
QQIVTLTYPHIGNTGTTPEDAESDRVWSAGLVIRDLPLVASNWRNKLPLSDYLKANNVVAIAGIDTRRLTRILREKGAQNGCIMAGDNISEEAAIAAAREFPGLKGMDLAKVVSTKKQYEWRSTVWDLKTDSHATIEASELPYHVVAYDYGVKLNILRMLVERGCRVTVVPAQTPAAEALALNPDGVFLSNGPGDPEPCDYAIQA

SEQ ID NO: 16129 - protein, 547 aa, Acidithiobacillus ferrooxidans
MTENAPTELAITGMTCDGCAAHVRKALEGVPGVREAQVSYPDATARVVLEGEVPMQRLIKAVVASGYGVHPRSDGASSTNDGQELHIAVIGSGGAAMACALKAVERGARVTLIERSTIGGTCVNIGCVPSKIMIRAAHIAHLRRESPFDGGIQAVAPTIQRTALLVQQQARVDELRHAKYEGILDGNPAITVLRGEARFKDSRSVVVHLNDGGERVVMFDRCLVATGASPAVPPIPGLKDTPYWTSTEGLVSESIPERLAVIGSSVVALELAQAFARLGSHVTILARGTLFLREDPAIGEAITAAFRAEGIEVLEHTQASQVAYADGEFVLATGHGELRADKLLVATGRAPNTRRLNLEAAGVAINAQGAIVIDQGMRTNSPNIYAAGDCTDQPQFVYVAAAAGTRAAINMMGGSAALDLTAMPAVVFTDPQVATVGYSGAEAHRDGIETDSRTLTLDNVPRALANFNTRGFIKLVAEVGSGRLIGVQVVAPEAGELIQTAALAIRNRMTVQELADQLFPYLTMVEGLKLAAQTFTRDVKQLSCCAG

SEQ ID NO: 16130 - protein, 205 aa, Pseudomonas fluorescens
QQIVTLTYPHIGNTGTTPQDVESNRVWSAGLVIRDLPLVASNWRSTMSLSDYLKANNVVAIAGIDTRRLTRILREKGSQNGCIMVGENISEAAAIAAAQGFPGLKGMDLAKVVSTQEQYDWRSTVWDLKTDSHATIDAADLPYHVVAYDYGIKYNILRMLVERGCRVTVVPAQTPASDVLALQPDGVFLSNGPGDPEPCDYAIKA

SEQ ID NO: 16131 - protein, 253 aa, Rubrobacter xylanophilus DSM 9941
MRTVVVKVGGASVAGGALEDLPGVVSGGARVAVVHGGGRQLTRMLDSLGVPTSFREGLRVTDERTLEVAEMVFAGSVNKQLARGLLALGVPAAGVSGTDGPVLRVEPVPGLGRVGRVVAVETRLLETLWGGGFVPVVAPLGLGPRGAYNVNADDAAAALAVALGAGELLLLTDVDGLLRDDEPVPALTPAECERYVSSGVASGGMAPKLRAAAEAARGGVPARIINGGRRGALAGALAGGQVGTLVRQEGAFA

SEQ ID NO: 16132 - protein, 259 aa, Streptomyces griseus
MTDNDSDVRLAHRLAEIADTLAWEFFGGAPAVRHKSDGSPVSEADLAVEKALLAVLAAERPGDAVLTEESGSLGTRSSRRRWILDPIDGTIPFLAGERGWGTHVALEVDEELRTAVLSRPTERSRWWAVRGRGAFTSVRGEPLSAARPLRIPSAPLPLEAARVGGFLMPDSPVEPVRDRMRWVESSVCLVGDLLEGRVDAVIDEGGHVWDRAPAALLVHEAGGRVDDLRGGGRLDERWLVYAADGVADGLAGLLRDVGA

SEQ ID NO: 16133 - protein, 397 aa, Rubrobacter xylanophilus DSM 9941
MKPVMETYKRLGIAPVEGRGSWLIDERGDRYLDFIAGIATNSLGHGHPALVEAIKEQAEKLIHCSNLYRVPLQEEVARMLTEATDFDRVFFCNSGTESVEAAIKLARRHAHNTSGPHKHEVLTFTGSFHGRTYGGLTATAQPALHEGFAPMVGGFAYAPYGDLEAASSRIGPQTAAVLVEPIQGESGVNEPPEGFLEGLRELCDRHGALLIFDEVQTGVGRTGHLYAYQGIGVVPDAITSAKGLGGGVPVGAVLAKEEHAAALTPGSHGSTFGGNPLAMAAARAVLRVVREPSFLEEVRTKGAILKNGLRELAARVPGAQVRGRGLLLGLELGPELAPEVFRRCLQEKVLVNLVGGKTLRMAPPLTVSRTEVRYALCTFRGGVEALMEAAPAEAVVA

SEQ ID NO: 16134 - protein, 193 aa, Colwellia psychrerythraea 34H
MWTIPNQITLFRIVLIPIFLIIFYLPLSWSNFGAFAVFWLAAVSDILDGYLARKLNQSSAFGAFIDPVADKLMVVVALVMIAQDYSSWLVSIAAIIMIAREVFISALREFMSSIGKRDIIAVSNMGKYKTAAQMLGIMGLIWQPSYDIPLILFYLPHEVINYLSYAFYSIATVLTVTTWVSYFKAAWPELKGQ

SEQ ID NO: 16135 - protein, 317 aa, Rubrobacter xylanophilus DSM 9941
MIPQLDDTPPPPSPLAGRDCLTLAEFSPQEVRLILDEAVKIKGLQKARIPYRPLRGRTLAMVFQKPSNRTRVSFEVGMYQLGGHALSLSPQEIQMGKRESPSDTGKVLTRYIDAIMVRTFDHAELEELAAAAEVPVINGLTDTHHPCQALADLLTVREQFGRVEGTKIAYVGDGNNVAHSLAIGCALTGARLSIAHPEGHGPDGKVVRLSAELGEPPKLTQDPEEAVAGAQVVYTDVWASMGQEAEAEERRKRFAPYQVDERLMSLAADDAIFLHCLPAHRGEEVAASVIDGPRSRVFDQAENRLHAQKALLYLLLG

SEQ ID NO: 16136 - protein, 421 aa, Rubrobacter xylanophilus DSM 9941
MEEGMRVAYDVRAVREQFPALRREQDGRPVVYLDGPGGSQVARQAMDAMLGYMEGGGANLHGAFATSVETEEMISCCRREVAAFLNAAPEEVVFGQNMTTLTFALSRALARGWGAGDAVVVTELDHRANVDPWLLAARERGAGTRWVRVDTRTLTLQPEDVERAVDGAAVLVAVGLASNAVGTVNDVSAIAERAHAAGAVVAVDAVHAAPHMPLDREALGADILTCSAYKFFGPHVGIAVVRRELLERLQPYKVQPAPDGIPERLETGTQNHEGIAGVRGALEFVASLGRGAALRERLVSGMAAIEAHEAALAAELRAALREVPDLTLYAAPEGVPKTPTFAFRLGNLSPREVCVRLAREGIFAADGDFYASTLAERLGVRDSGGLVRVGLAPYNTREEMQRLLQALAGLSRGRTSRASGV

SEQ ID NO: 16137 - protein, 355 aa, Oryza sativa Japonica Group
MGAKTPYVVIVIVELIYTGMYIISKAAFNQGMNTFIFIFYRQAAASVLLLPLAIVLERSTGTLNLYNMGLKYTTSTVASAAGSSIPVMSFFLALLLRQEMIRLRSLPGSAKAAGVGLCLAGVLVIALYTGPTISPLIHHRVFAGGGHEASASGSGRTRWIVGTVLILLSNVTWLLWSMLMAPVLREYPNKLLATTWQCVISAAQSLAVAAVAAARDPAAWRLRLDTGLLAVAYSGVVVTAVAFYLMAWCIEKKGPVFLAMSTPLAFVFTVFCCIFFLGETVHAGSVVGGVLMVAGLYSVLWGKSKEQDKLTLATATPTVAAVEQKEAAAAAPDADASNSGSELHHGRLVSLEQQV

SEQ ID NO: 16138 - protein, 558 aa, Streptococcus mutans UA159
MYQALYRKYRSQTFDEMVGQEVVAKTLKQAVASKKISHAYLFSGPRGTGKTSAAKIFAKAMNCPHQADGEPCNNCDICHDITNGSLEDVIEIDAASNNGVDEIREIRDKSTYAPSRATYKVYIIDEVHMLSTGAFNALLKTLEEPTENVVFILATTELHKIPATILSRVQRFEFKAIKTKAIKEHLADILKKEGLSFDEEALSLIARRAEGGMRDALSILDQALSLTNDNDVSLEIAEEITGSISLRALDQYVADLLAHETQQALSDLDTIFNNGKSMSRFATDLLNYLRDLLVVQAGGENTHHGEAFDKNLTLSQETIFQMIDVVTKSLPEIKNGTHPKIYAEMMTIRLSENDQKVHSVQDLPDNVAQEIEALKSEIKELKKSLQSLEKGKPFKVTKVQKTSFRYKVDKDKVMTIMRETVADSQKSREYLEALKGSWNEILDSISPQDRALLMGSEPVLANSENAILAFDAAFNAEQAMKRSDLNAMFGNIMSQASGFSPKIMAVPRAEFDAIRSEFAHSLKADKDDSQEETTEATKEFIPEGFDFLADKIVLEEEP

SEQ ID NO: 16139 - protein, 308 aa, Salmonella typhimurium LT2
MARAMDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRSVY

SEQ ID NO: 16140 - protein, 696 aa, Pseudomonas syringae pv. tomato str. DC3000
MQTFFIAPTDFGVGLTSISLGLVRTLERAGLKVGFFKPIAQPHPGDLGPERSTELMARTHGLKPPKPLGLAHVERMLGDGQLDELLEEIINLYQQAAVGKDVLVVEGMVPTRSASYAARVNLHLAKSLDAEVILVSAPENEVLTELSGRVELQAQLFGGPKDPKVLGVILNKVRTEESMEVFAARLKEHSPLLRNGDFRLLGCIPYRAELNAPRTRDVAELLGAQVLNAGDYDQRRMSRIIICARTVLNTVPLLKPGVLVVTPGDRDDIILAVSLAAINGVPLAGLLLTSDTVPDPRIMELCRGALQAGLPVLSVSTGSYDTANRLNQLNKEIPIDDRERAEIITDFVASHLDASWLHQRCGTPRELRLSPAVFRYQLIQRAQAANKRIVLPEGNEPLTIQAAAICQARGIARCVLLARPEEVQAVAQAHGIELPPGLEILDPDLIRERYVAPMVELRKSKSLNAPMAEQQLEDPVVIGTVMLALDEVDGLVSGVVHSTANTIRPALQLIKTAPGCTLVSSVFFMLFPEQVLMYSDCIMNPHPSASELSEIALQSADSATAFGISPRVAMISYSSGNSASGEEVEKVREATQLARETRRDLLIDGPLQYDAAANEHVARQLAPDSQVAGRANVFVFPDLNTGNTTYKAVQRSADCVSLGPMLQGLRKPVNDLPRGAQVDDIVYTIALTAIQADTLS

SEQ ID NO: 16141 - protein, 533 aa, Lactobacillus acidophilus NCFM
MKIMVFIGIIMLAVAFSTMIQQRFFKIISVNYIAMAMGMILALIPQTNLLIENFSSEVFMGLIVAPLLFFEGQRTRLYSILRSWRAILGLTVIMIVLATITASFGIYLSLGVSLPLSFILAAISTPTDATATESVTHGLKLPKKIEFYLKDESLFNDASGIILLNMGVDWYIHQRLRVGAAIGNFLYSAGGGIIFGVLIAILLIFLRQKSPRSKYHLANSVLMPIEILFLLTPFFIYFLAEEIHVSGIIAVVAAGLVHNVESERSRLTNAAIFYNSKQISQLLTDILNGIVFIVLGIIIVRSMREDVFNKQTIEAIIIGIILYLANLIVRFLYCRFSPLIKGKISSKDAWIFSLGGIHGAVTFALAYTLSEMSVNIADLHLILISEITLILLSMIVPTILFRFILEPDKPDLDQRKEVDRVRVEMVQYAMEQMNKIYLPKKIKKQLEFDLRAQMNQTSIEDFIKELKYTAKQKELPEDEKDFRATVYRYAFRQERNYLGRIVQQEREYRHGFLVLYREILIAEVIFLGDEEID

SEQ ID NO: 16142 - protein, 492 aa, Zymomonas mobilis subsp. mobilis ZM4
MSFADLGLSKELLQAVAELGYEEPTPVQAAAIPSVLMMRDLIAVAQTGTGKTASFVLPMIDILAHGRCRARMPRSLILEPTRELAAQVAENFEKYGKYHKLSMSLLIGGVPMAEQQAALEKGVDVLIATPGRLLDLFERGKILLSSCEMLVIDEADRMLDMGFIPDIETICTKLPTSRQTLLFSATMPPAIKKLADRFLSNPKQIEISRPATANTLIDQRLIEVSPRSKKKKLCDMLRAEKDHTAIIFCNRKTTVRQLATTLEQQGFSVGQIHGDMSQPERGSELERFKNGQISVLVASDIAARGLDVKGISHVFNFDVPTHPDDYIHRIGRTGRGGASGEALTFVTPADEEAITAIEKLMGVEIPRLGNRKKNTYPSKSEETVSPKQAKPAQEKSATPSPRKAPRKTETPKKLPEDRLDSVESDFPKNQAPRNTASRPVSKARTQERALRPENLRRVKPVALETAIDWNGPIPPFLNYSVPKTTARNVKKD

SEQ ID NO: 16143 - protein, 451 aa, Mycobacterium smegmatis str. MC2 155
MTTLHDVPRVSGGEEEHGHLEEFRTDPIGLMKRVRSECGDVGWFQLADKQVVLLSGAEANEFFFRSSDSELNQAEAYPFMTPIFGEGVVFDADPERRAEMLHNTALRGEQMKGHAATIENEVRRMVESWGDEGEIDLLEFFAELTIYTSTACLIGVKFRNQLDKRFADYYHLLERGTDPLCYVDPYLPIESFRIRDEARANLVELVQEVMNGRIANPPKDKSDRDLLDVLVSIKDEDGTPRFSANEVTGMFISLMFAGHHTSSGTASWTLIELLRHPEFYAKVQAELDDLYADGQEISFHALRQIPNLDNALKETLRLHPPLIILMRVAQDEFEVAGRPIHKGQMVAASPAISNRIPEDFPDPDTFDPDRYDKPRQEDLINRWTWIPFGAGKHRCVGAAFAQMQIKAIFSVLLRDFEFEMAQPSESYRNDHSKMVVQLARPAKVRYRRRVR

SEQ ID NO: 16144 - protein, 542 aa, Nicotiana tabacum
MAARVFTSRLSRSLTSSSHLLSRGLIIVDKQKSHLGRIAAYQYSTAAAIEEPIKPAVNVEHTKLFINGQFVDAASGKTFPTLDPRTGEVIAHVAEGDAEDINRAVAAARKAFDEGPWPKMNAYERSKIFVRLADLIEKHNDQIATLETWDTGKPYEQAAKIEVPMVVRLLRYYAGWADKIHGMTIPADGPYHVQTLHEPIGVAGQIIPWNFPLLMFSWKIGPALACGNTVVLKTAEQTPLSAFYVAHLLQEAGLPEGVLNIISGFGPTAGAPLCSHMDVDKLAFTGSTDTGKAILSLAAKSNLKPVTLELGGKSPFIVCEDADIDTAVEQAHFALFFNQGQCCCAGSRTFVHEKVYDEFLEKAKARALKRTVGDPFKSGTEQGPQIDSKQFDKIMNYIRSGIDSGATLETGGERLGERGYYIKPTVFSNVKDDMLIAQDEIFGPVQSILKFKDVDDVIRRANNSRYGLAAGVFTQNIDTANTLTRALRVGTVWVNCFDTFDATIPFGGYKMSGHGREKGEYSLKNYLQVKAVVTPLKNPAWL

SEQ ID NO: 16145 - protein, 131 aa, Candida glabrata CBS 138
MSGGKGGKAGSAAKASQTRSAKAGLTFPVGRVHRLLRRGNYAQRIGSGAPVYLTAVLEYLAAEILELAGNAARDNKKSRIIPRHLQLAIRNDDELNKLLGNVTIAQGGVLPNIHQNLLPKKSAKPSASQEL

SEQ ID NO: 16146 - protein, 621 aa, Podospora anserina
MMKSFFSAAALLLGLVAPSAVLAAPSLPGVPREVTRDLLRPVEERQSSCHTAANRACWAPGFDINTDYEVSTPNTGVTRTYTLTLTEVDNWLGPDGVVKQKVMLVNGDIFGPTITANWGDWIQVNVINNLRTNGTSIHWHGLHQKGTNMHDGANGVTECPIPPKGGSRIYRFRAQQYGTSWYHSHFSAQYGNGVVGTIVVNGPASVPYDIDLGVFPITDYYHKPADVLVEETMNGGPPPSDTVLFKGHGKNPQTGAGKFANVTLTPGKRHRLRIINTSTHDHFQLKLQNHTMTIIAADMVPVQAQTVDSLFLAVGQRYDVTIDANKSVGNYWFNATFGGGLACGASLNPHPAAVFRYQGAPNTLPTNIGTPAADANCMDLNNLTPVVSRSVPTSGFTPRPNNTLPVSLTLGGTPLFVWKVNGSSINVDWDKPIVDYVIAQNTSYPPQANVITVNSVNQWTYWLIENDPTGPFSIPHPMHLHGHDFLVVGRSPDQPAGVPQTRYRFNPATDMALLKSSNPVRRDVAMLPANGWLLIAFKSDNPGAWLFHCHIAWHVSGGLSVQYLERPNDLRNGFSQADKNQHNNNCNAWRAYWPTNPFPKIDSGLKVKKWVGEHPDWYIKN

SEQ ID NO: 16147 - protein, 245 aa, Zymomonas mobilis subsp. mobilis ZM4
MFDLNGLTAVVTGASGGIGSAIAKALADQGAQVALSGTRESALKEVAAILPNDPIILPANLGQKEDVEQLVPRALEKLGKIDILVNNAGITRDGLMMRMKDEDWADVIALNLESVFRLSRAVIRPMMKTRFGRIINISSVVGQTGNAGQANYAAAKAGMIGMSKSLAREVASRGITVNCIAPGFIETKMTEILSEQQKEAAKSQIPAGRFGDIQDIAAAAVYLASKEAGYMTGQTLSVNGGMSML

SEQ ID NO: 16148 - protein, 181 aa, Solanum tuberosum
MASSVISSAAVATRTNVTQAGSMIAPFTGLKSAATFPVSRKQNLDITSIASNGGRVRCMQVWPPINMKKYETLSYLPDLTDEQLLKEVEYLLKNGWVPCLEFETEHGFVYRENHKSPGYYDGRYWTMWKLPMFGCTDTTQVLAEVQECKKSYPQAWIRIIGFDNVRQVQCISFIAYKPEGY

SEQ ID NO: 16149 - protein, 181 aa, Solanum tuberosum
MASSVISSAAVATRTNVTQAGSMIAPFTGLKSAATFPVSRKQNLDITSIASNGGRVRCMQVWPPINTKKYETLSYLPDLTDEQLLKEVEYLLKNGWVPCLEFETEHGFVYRENHKSPGYYDGRYWTMWKLPMFGCTDATQVLAEVQECKKSYPQAWIRIIGFDNVRQVQCISFIAYKPEGY

SEQ ID NO: 16150 - protein, 117 aa, Cryphonectria parasitica
MTVHNVETASQFKEILAKNPVVFVDWFATWCGPCKMIAPKIAEWSNEYTGVYFVKIDVDALPELAAEHNVKAMPTFHVFKDGNTTAAEEFVSAVPPKVQALIEKHNPGKKEGEEKAE

SEQ ID NO: 16151 - protein, 564 aa, Bordetella bronchiseptica RB50
MARGYAIGRAVVMGAAALEVAHYRIAPEDVAAESQRLTEALAKAQADLLQMADTLPEDAPRELGAMLNVHRLLLGDPLLAEQALALIAERHYNAEWALTAQGQILGQQFEAMEDEYLRERGGDVRQVIERALHVLAGTSAMLPDGAQLDGDDPLVVVAHDISPADMLRLRGGRFAAFVTDLGGPTSHTAIVARSMGVPAVVALGNVRELVRDGDMLIVDGADGVVVLNPSARILAEYQARQRVYADERAELALLRDEPAVTLDGIDIVLHANIELPEEASLSLACGAHGIGLFRSEFLFMGRPDLPGEEEQYEAYASVVKVMAGRPVTIRTLDIGADKTLDDEATVATNPALGQRAIRYCLARPEMFATQLRAILRASAHGPVRVLIPMIAHMHEVHATYAALESARRELDARGQPYAARVEVGAMVEIPAIAIAIEPFVQALDFLSIGTNDLIQYTLAIDRGDHDVAGLYDPLHPAVLRLVANTINAGERAGKPVAVCGEMAGDARLTRLLLGLGLTEFSMHPQQLLDVKREVRRAHSNALRVKVAAALNRALPIDPDTLDAL

SEQ ID NO: 16152 - protein, 333 aa, Kineococcus radiotolerans SRS30216
MNARPRVVLLLTGGTIGTAGGDDLDRLDYVDDGRALDDEEALALYRFPDEVEVSARRVARVPSTLVDEGFWAQLRARVLAVARDEPDVAGVVVTHGTATLEETAYVLHLTLATDLPVVLVGAQRPPTALGSDAQVGLLNAVRVAASPAARGHGVLVVMDDRVLSARDVVKTSNGGLDAFRARDHGALGDVDPYGGVWFYRRLLRRHTLGSPFSADPAPRWPRVEVVPVWAGADGRVVERPVADGARGLVVASLPPGMNPPAVEVAMSRAVAAGVVVVVGSRAATGRVTHRRAFAERGLVGSDTLSPPQARILLSLCLAAGMDRDAVVDAFATC

SEQ ID NO: 16153 - protein, 506 aa, Vibrio parahaemolyticus RIMD 2210633
MIYAQPGSENAIVNFKSHYDNFIGGEWVKPTGGEYFDNISPINGQAYCKVARSGEADINLALDAAHNIKAKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDIFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESISQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSIDPLGFF

SEQ ID NO: 16154 - protein, 223 aa, Streptococcus agalactiae NEM316
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNSMVNKVIVAGKNGLDILEK

SEQ ID NO: 16155 - protein, 262 aa, Zea mays
MLLLRGARAASAWAASTAVSAGASSSRSISIRLAPVAALSSGGRKRKGQRRGEAKPPSPPPPPPLPRQGETPSSKKKSGARPSGEGKKSRLVELEEARGPRRPEGGEARKGNTQQQQQQEEKAKAKRLVKWKCASGCGACCKLDKGPDFPIPDEIFADHPDDLQLYRSMIGSDGWCINYDKATRTCNIYQDRPSFCRVEPKIFDELFGVPRSRFDREACSACVDTIKMVYGDDSAELSNFKRVIREESNKLESKNQDTLLDA

SEQ ID NO: 16156 - protein, 326 aa, Ralstonia pickettii
MTQLDTTTLPDLSAIAGLRARLKQWVRTTPVFDKTDFEPVPGTAVNFKLELLQASGTFKARGAFSNLLALDDDQRAAGVTCVSAGNHAVGVAYAAMRLGIPAKVVMIKTASPARVALCRQYGAEVVLAENGQTAFDTVHRIESEEGRFFVHPFNGYRTVLGTATLGHEWLEQAGALDAVIVPIGGGGLMAGVSTAVKLLAPQCQVIGVEPEGADAMHRSFETGGPVKMGSMQSIADSLMAPHTEQYSYELCRRNVDRLVKVSDDELRAAMRLLFDQLKLATEPACATATAALVGGLKAELAGKRVGVLLCGTNTDAATFARHLGLG

SEQ ID NO: 16157 - protein, 400 aa, Dehalococcoides sp. BAV1
MKAVILAAGEGSRMRPLTFTRPKVMLPIAGKPILEHLLMEVSAAGIKEFVLVVGYRDEQVRSYFADGAKWGVKISYCQQTRQLGTAHALKQLENQLEGNFLVMNGDILAESADISALAAGSETTLSVLEVSDPSSLGVLETDGDRVRCIHEKSANPPTNLANAGLYLFTPRIFKAISGTPLSPRGEYEITSSIQLLIDNGTEVGYRRLVYWQDVSYPWDLLDVNASMLKNLAPCVYGTVEENVVIKGTVEIGEGSLVRSGAYIEGPVLIGKNCDIGPNCYIRPSTSIGDNCRVGASVEIKNSIIMDNTKIPHLNYVGDSVIGQNCNLGAGTKLANLRFDGADIIAGGVNTRRRKLGAVLGDGVETGINVSLNPGVLIGSGSRIGPGAVVSGLVEPNSYIG

SEQ ID NO: 16158 - protein, 475 aa, Neptuniibacter caesariensis
MHIWQFCLELETLMNQSMHEVIDQLHQDDKTHVWHHLTPGAAAEAGLPMFVEGEGLVIRDSQGKEYLDASAGGVWVTNVGYGRKEIADAMHAQLTKLNFFASSMAGVPATKFAKRLLEKMPGLSRVYYSNSGSEANEKAFKMVRQISAKHHGGKKSKILYRERDYHGTTIAALSATGQTQRRAQYGPFVPGFVEFPHCHEYQSQYELSEDKSYGVRAAQAMEEVILKEGPDTVGAVILEPITAGGGVILPPEGYWQEIQRTCKKYEILLIMDEVVCGIGRTGNWFGYQHFDIQPDIVTMAKGVASGYAAISCTVTTEAVFDLLQEEAGDELGYFRDISTYGGCQAGPAAALANLEIIEREGLIDNCRIQGERLLAGLEKLKAKYPIIGDVRGKGLFVGIELVTDPVNKAPVADAITVGIAARCKALGLLIGRTNRSFTAANNILNMSPALIATDADIDKILSILDKAFELETTNE

SEQ ID NO: 16159 - protein, 230 aa, Oryza sativa
  misc_feature (186)..(186): Xaa can be any naturally occurring amino acid
MGSTRLLVLLAAASLLLATAVPAARAQEETDHEEEFTYISGDEKGPEHWGKLKPEWAQCGAGEMQSPIDLSHERVKLVRDLGYLDDSYRAAEASIVNRGHDIMVRFDGDAGSVVINGTAYYLRQLHWHSPTEHSVDGRRYDMELHMVHESAEKKAAVIGLLYEVGRPDRFLQKMEPYLKMIADKGXGRLARRGWSGRLSRGFAPCRGISSTFSGKLCMMKWRTTRGPFRR

SEQ ID NO: 16160 - protein, 164 aa, Oryza sativa
  misc_feature (110)..(110): Xaa can be any naturally occurring amino acid
  misc_feature (130)..(130): Xaa can be any naturally occurring amino acid
ARRAYNCPFCGEDFDFVAFCCHVDDEHAVEAKSGVCPICATRVGVDLIGHLTMQHGSYFKMQRRRRVRKISSGSHSLLSLLRKDLRDGSLQSFLGGSSYMTRLQRGMSPXLCSFCRLTPLPLCHNTTVSXAEPSLSEKDQKERAQRSKFVRGLVLSTIFEDDNL

SEQ ID NO: 16161 - protein, 438 aa, Rubrobacter xylanophilus DSM 9941
MLRAARIRTEIPGPRSRALTERRRRAISAGLGTALPIWVAEAHGALVTDVDGNTFIDFGGGIGVLNAGHTHPRVVEAVREQVGRLTHACYYVSQYEPYLELAEKLNELVPGNFEKRSIFVNSGAEAVENAIKISRSYTRRPAILAFENAFHGRTMLGMSLTGKADPYRRGFGPFVPEVYRVPAPYAYRMPKEESWFDAFRRSLVSVDVSSVAAVIVEPVLGEGGFIPFPPEDLRRLREWCTENGAVMVVDEVQTGFGRTGKMFAIEHSGVEPDIVTTAKSLGGGMPIAGVTGRAEIMDSVHAGGLGTTYGGNPAACAAALAVIRAFEEENLLERSVRVGERVMEELRAIQRRHPDFVGDVRGLGAMAAMELVTDARSKTPDPARTKGVVEHALQEGLMLLTAGAYGNVIRTLMPLVITDSELEEGLSILSRAVDAAAA

SEQ ID NO: 16162 - protein, 122 aa, Vitis vinifera
MASKLVQLQTKACKASQLVAKHANSYYKELLEENKQYIQDPPTIQKCDLLAKQLFATRLASIPGRYEAFWKELGYIKNLWKNRQELKVEDAGIAALFGLECYAWFCGGEIVGRGFTFTGYYV

SEQ ID NO: 16163 - protein, 242 aa, Zea mays
MEYVNPLTGFRVDGRRPNEMRQLKGEVGVVARADGSALFEMGNTRVIAAVYGPREVQNKGQQVNSKEALVRCEYRMAEFSTGDRRRKPKGDRRSTEISLVIRQTMEASILTHLMPHSQIDIYVQVLQADGGTRSACINAATLALADAGIPMRDIATSCSAGYLCSTPLLDLNYLEDSAGGSDVTVGILAKMDKVTLLQMDAKLPIDTFENVMGLAIEGCKAIATYIREVLLENTKKLECQRG

SEQ ID NO: 16164 - protein, 256 aa, Streptococcus mutans UA159
MKKKFIYLTVLVVVAVFCISTFLTLKGDSQDREAHWSYSGSTSPEHWGDLSDDYKAAKDGKEQSPINITGAKDVDLPSLQLNSKNSKAEVENNGHTIEVKLKNKKNTLKFNGKTYTLEQFHFHAPSENQIDGKTYPLEGHFVYTTKDKKITVISILYQYGKENKTLKQVWKKMPQKAETKKNLSQPVAISQLFPKDLDYYNFEGSLTTPPCTEGVNWIVFKKQENISKAQVKKFSKTLGFNNNRPIQKLNGREIKE

SEQ ID NO: 16165 - protein, 449 aa, Vitis vinifera
MSKTAGSIVEAALKRDPHEVEFIQSVQEAVHALERVIAKNSHYVNIMERLLEPERMILFRVPWVDDRGETHVNRGFRVQFNQTLGPCRGGIRFHSSMNLSIAKFLGFEQTLKNALSPYKLGGAAGGSDFDPKGKSDNEIMRFCQSFMNELYRYLGPDQDLPSEEMGVGPREMGYLFGQYRRLAGHFQGSFTGPRIFWSGSSLRTEATGYGLVFFAQLMLADMNKELKGLRCVVSGSGKIALHVTEKLLAYGALPITVSDSKGYLVDEDGFDYMKISFLREIKSQQRSLRDYSKTYARSKYYDEAKPWSERCDVAFPCASQNEIDQSDAINLVNSGCRILIEGSSNMPCTPEAVDVLRKANVLIAPAMAAGAGGVAAGELELNHECNLMHWSPEDFESKLQEAMKQTYQRALKAAADFGYQKESPEALVHGAAISAFLTIAQGMTDQGCV

SEQ ID NO: 16166 - protein, 626 aa, Bacillus anthracis str. Ames
MTICSVNNVTKSFGGNIIFENISLEIKNGERVGLVGRNGSGKTTIFQLLTGMESLDAGAIHMKKGTRIGHVAQIPKFDESMTVYEVLSSAFKIEKELEREMRTLEKDMAEEQESSVLQKLMERYGIIQEKFAFLGGYEIEANIMKVANGLQVTELFPRSFLELSGGEQTKVSLAYMLLQKPDLLLLDEPTNHLDLFAVEWLEQFLKEYNGTVMVISHDRYFLDEVVTKIFDLEDGEIHVYHTNYSRFVEEKEERLLQEFQAYQEQQKKIKKMKEAIKRLREWANQANPPNEGLHKRARSMERALERMQKLKKPILERKQIGLQFEGQDRSGKDVVVIKEVSKGFADHPLFNEVNLHVRFQERAAIVGRNGTGKTTLLKLLLEEIEPDAGEIRIGSSVKIGYLSQHAYGNMKSDVLEAFREYVAVTEGEARHILAKFLFYGPAVFKKVTQLSGGEKMRLRLAQLMYQDINFLILDEPTNHLDIESREVLEEALEQYNGTILAVSHDRYFLNKLFEKTYWIDEHKLFEFAGNYAWARQKWEERLETQVIKQQRQGRKSIETAPVKKKEARNIEEIETELMHVEEDIYTLECTMEHVVDIKRLEQLYEEKTKKELLRAELYNELENIVE

SEQ ID NO: 16167 - protein, 288 aa, Zea mays
MEGKEEDVRLGANRYSERQPIGTAAQGTEEKDYKEPPPAPLFEAEELTSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQEGLYMGAGGGANAVNPGYTKGDGLGAEIVGTFVLVYTVFSATDAKRSARDSHVPILAPLPIGFAVFLVHLATIPITGTGINPARSLGAAIVYNRSHAWNDHWIFWVGPFIGAALAAIYHVVIIRALPFKSRD

SEQ ID NO: 16168 - protein, 194 aa, Brassica napus
  misc_feature (19)..(19): Xaa can be any naturally occurring amino acid
  misc_feature (71)..(71): Xaa can be any naturally occurring amino acid
  misc_feature (93)..(93): Xaa can be any naturally occurring amino acid
  misc_feature (111)..(111): Xaa can be any naturally occurring amino acid
  misc_feature (142)..(142): Xaa can be any naturally occurring amino acid
STHASEKLEGAPSMLSSAXVATSPAQAPWMLPFTGCEVHHVAIPQRTPRIATLMLLLSQAAGGRVSCMKAXHPLGKRKLETLSYLPDLTGAEXGIEADYLVRNKRMTCVEXQLEHGFVYREHGSTPAILRWPVIDTMRKLPXCGCTDYAQVLNEVQESMTEDPSPSIKIIGYDNNRQEQRISLIDYKPPSLTAA

SEQ ID NO: 16169 - protein, 341 aa, Salmonella typhimurium LT2
MKVKAVFINKPGEVETRWVDYPHKKENEVLIKVDAAGICGSDIGAFRGTNPLVTYPRIIGHEVTGIVLQEGAGMPDNIKEGDRVIVDPYIYCGHCYPCSVGRTNCCENLNVIGVHVDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 16170 - protein, 631 aa, Cytophaga hutchinsonii ATCC 33406
MENNFLFQTVIYLSAAVVCVPIAKRFAMGSVLGYLLAGMLIGPFVLGFIGQEGKDIMHFAEFGVVMMLFLIGLELEPAHLWKIRKQILGVGLSQVLITTAVVMIIAIAASLAWQSALAIGFAFAMSSTAIVLQSLKEKGLMKAPSGQFSFAVLLFQDIAVIPILAILPLLVFLPVSIPQDAHSGGINDLPRWLQTASVLGAVGGIVLIGKYAIVPLLRVIAKTHMRELFTASALLIVVAIALLMQQVGLSPALGTFLAGVILANSEFKHELESDLEPFKGLLLGLFFIAVGASIDFSLVYEELLTIAILTFSIIIVKASILFAIGKKAKLSLDQNLIFAIGLSQVGEFAFVLFSFIGTHNILSKAQTDMMMAVTALSMTISPLLLIVLDKWILPKLHAADKEQTTKRADHIEERNNVLLVGFGHFGTTLARFLRANGVAATVLDNNSDQVDLLRKMGFNVFYGDATRIDILEAAGAAEASILIIAIDSPETNLEIVKIVKQHFPNLEIMVRSKNRMDAYELLDEGVSNIYREHLDTSIRLGVDVMKKLGYRTYSAFRAGQNFIKYDEAALRTLSQNRKNMKVYISDVREQIALQEELLQIDRQVVPSANDHAWDSREMREKIREMDNQKSV

SEQ ID NO: 16171 - protein, 758 aa, Oryza sativa Japonica Group
MAAAAARPARSPPGPTEISAEITTPNRLMGRNQITPWVLRWGGERTGSRRTGLVSSATGRNGGFFFFFVGAPEEEDGVLPALVVVVTAAEEEERIEPERIEPERIEPEAEKKAPDTGEGLAKAAWALSLPADMAATGQRGSTPVWKDPDNIREIALREYTELVLDETEVSEAALVRDVLYACQGIDGRYVRFDKGSDAYDLPDGVRVPRSTRTLEELSDYYKLLAVLESYSLNPIPTPGSDSGVSVWLAEPAVRMRLMAVLVDGCRGLRGGAMAGAIHGHAQHGDPTFQDFMGRLLRRVCSPLFEMVRSWVLEGELEDVFAEFFIVGQPVKAESLWQEGYLLQSDMLPAFISPVLAQRFLEPGNAATEAAVCVGTTTSRGGLGYGQIDALEALVVEAAKRIDRHLMDVIHKRYRFKDHCLAIKRYLLLGQGDFVQYLMDVVGPELSEPANRISSFHLAGLLETAIRASNAQYDDRDILDRIKVKMMDHGDGDRGWDVFSLEYDARVPLDTVFTASVMKRYLKIFNFLWKLKRVDHSLTGIWKTMKPNCIVSSPFYKEGTNIRSQFVSVLRKCQVLFNEMNHFVTNFQYYIMFEVLEVSWARFSEEMDSAKDLDDLLLAHDKYLTSIVEKSLLGERSHGILRNLFALFDIILQFRSHADRWFERIYELQLRGKGKPKSKAKAKSKEVDSWVDGGRKAMIQLAGELFRKMGEDLDSIAKDYTSSLDAFIAQLPMQQHVDLKFLLFRLDFTEYYSRVSSNK

SEQ ID NO: 16172 - protein, 181 aa, Solanum tuberosum
MASSVISSAAVATRTNVTQAGSMIAPFTGLKSAATFPVSRKQNLDITSIASNGGRVRCMQVWPPINTKKYETLSYLPDLTDEQLLKEVEYLLKNGWVPCLEFETEHGIVYREKHKSPGYYDGRYWNMWKLPMFGCTDATQVLAEVQECKKSYPQAWIRIIGFDNVRQVQCISFIAYKPEGY

SEQ ID NO: 16173 - protein, 105 aa, Lactococcus lactis
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIA

SEQ ID NO: 16174 - protein, 287 aa, Candida glabrata CBS 138
MSVTVDVPKYYELQDGRKIPSLALGTYDIPNSVTAKVVTEALKCGYRHFDTAVLYGNEREVGQGIVNWINEDKAHNKREDVFYTTKLWNSQNGYNEAKRAIKECMQKVSGLGYIDMLLIHSPLSGQRRRLETWKAMQEAVDEGIVKSIGVSNYGKHHIEELLGWDELKYKPVVNQIEISPWVMRQELADYCKSVNLVVEAYAPMAHGYKMNDPGLREISKETGMNPGQLLIRWSLQHGYLPLPKTKTVARLASNLDVYNHKLTLDQVKRMDHPEAYDPTDWECTDAP

SEQ ID NO: 16175 - protein, 143 aa, Bacillus pumilus SAFR-032
MTNDKEKRLKELNRMQYEVTQNNGTEPPFQNEFWDHKEEGIYVDIISGKPLFSSLDKFDAHCGWPSFTKPLEDEEVAEKVDKSHGMVRTEVRSKTADSHLGHVFPDGPGPNGLRYCINSAALKFIPKDDLEKEGYGDLKHLFD

SEQ ID NO: 16176 - protein, 470 aa, Zymomonas mobilis subsp. mobilis ZM4
MLHPVVLCGGSGTRLFPLSRRSHPKQLLSLMGENSLFQDAVARVTDSSLFTAPLVICNEEYRFTIAEQLQEMGVKAQEIVLEPEGRNTAPAIALAASMIADKDPDACMLILPSDHVIRDVKAFHEAIKDAETIARKAKALVTFGVRPTSPETGYGYIEMGEALPIAGGYHIDRFREKPDIKTAEDYLASGRFLWNSGMFLFPVSRILEDFALYQSDILDAVKASLRKSQKDLDFTRLDAESFAKAPSISIDYAIMEPAHNRAVVPVNIGWSDVGSWSSLWAISDHDDNGNVLMGDVVAEDSSNCLIRSENGLVATLGVKDLTIINTSDVTLVVNQDQSQNVGTLVKKMIKEGRLEPLNPKQVARPWGWYESIAMGPRFQVKQIMVKPGHRLSLQKHFNRAEHWVVTQGTARVTVGDHVDLIRENESIYIPMGEVHRLDNPGKVDLLLIEIQTGCYLGEDDIVRLEDDYRR

SEQ ID NO: 16177 - protein, 157 aa, Lactococcus lactis
FVDPELEWDFRLKNVISINTSGHKYGLVYTGVGWVLWRDKKYLPEELIFKVSYLGGELPTMAINFSHSASQLIGQYYNFVRYGFDGYKAIHERTHKVAMYLAEEIEKTGMFEIMNDGSQLPIVCYKLKENSNLGWNLYDLADRLFNEGMASACLSTS

SEQ ID NO: 16178 - protein, 226 aa, Petroselinum crispum
MVKIAIGSIGDSFTHGSLKCYLAEFIATLLFVFAGVGSAIAFNNLTADAGLDPAGLVAIAVAHAFALFVGVSIAANISGGHLNPAVTFGLAVGGHITLITGFFYWIAQLLGATVASFLLIFVNGGKAVPIHGVGAGLGAAEGVVFEIIITFALVYTFYATAADPKKGSLGTIAPIAIGFIVGANILAAGPFSGGSMNPARHSGQLLLAETFLDTGSTGLVLSLEEA

SEQ ID NO: 16179 - protein, 482 aa, Vibrio parahaemolyticus RIMD 2210633
MKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQSSLVAWRKVAAKSLEAGIPMPCTTSALTFLDGYTTARLPANLLQAQRDYFGAHTYERIDRERGEFFHTNWTGTGGNTASTTYDV

SEQ ID NO: 16180 - protein, 501 aa, Vibrio parahaemolyticus RIMD 2210633
MMVIPENSSIVIFGASGDLTYRKLIPALYHLYANKQLPESFAILGVSRTEYSDESYREKLKKSLQEMEKTEPETLDAFINHLHYQAINTSDTQDYSKLATRLDQLADEYQFEQRNTLFYLATPPSLYSVIPASLAAHGLNNEEDGWKRLIIEKPFGYDLESARTLDKEIHEHFQEHQIYRIDHYLGKETVQNLLVFRFSNAMFEPLWNRNFIDYVEITGAEFLGVEERGGYYDNSGAVRDMFQNHLLQVLAMVGMEPPAQINADSMRDEVVKVLQCLKPLDETALRNDLVLGQYTASDVRGQHLPGYREENGVADDSRTETYIGLKAYINNWRWNGVPFYVRTGKRLPTRVTEVVIHFKQTPHPVFGQNAPENKLIIRIQPDEGIQMSFGLKEPGAGFNAKEVKMNFHYADLQETQMLTAYERLLLDALNGDATLFARSDAVEACWQYVQPILDFKQDPQSLFGYACGTWGPKESDDLLQRDNRAWRFPCKNLTDTDYCEL

SEQ ID NO: 16181 - protein, 494 aa, Rubrobacter xylanophilus DSM 9941
MNVEREGRVETRMIERLFVGGEWVGEASTGRTFEVENPASGRVIAVLPDGGGGEMRRAVEAAVAAQPGWEEATAYERASVLWRAAGLMRERAEHLARVMTLEQGKPLAESRGEISYAASFVEWFAEEGKRVYGESVPSSFRDKRILVLKRPVGVAAAITPWNFPAAMITRKLAPALAAGCAMVVKPSELTPLSALELAKIFEEAGLPRGLLSVVVGTDPGDITAPLMEDGRVRKLSFTGSTEVGKHLMRQAAKTMKRLSLELGGHAPFIVFEDADLEAAVEGALVSKMRNMGQTCVCANRIFVQKSVLEPFAERLVERMGRMKVGDGLQEGVSVGPLIEERALRKVERHVEDARQKGARVLLGGSRLSSGGGYFFAPTVLCGADESMLVFREETFGPVAALASFESEQEVVERANATPYGLAGYYYTRDVGRVMRLAEKLRYGILGANDGLPSTAQAPFGGLKESGFGREGGHWGIEEYLDVKYLSLGGLGSSS

SEQ ID NO: 16182 - protein, 210 aa, Triticum aestivum
DARARSFVARAAAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLRALQYVKKPDEVCPAGWKPGEKSMKPDPKGSKEYFAAI

SEQ ID NO: 16183 - protein, 393 aa, Vitis vinifera
MASVTFAKFNASSSQWIGQQSFSQRQGSSARFPARRVSVPIRAGSYSEELVQTAKTVASPGRGILAIDESNATCGKRLASIGLDNTEPNRQAYRQLLLTTPGLGEYISGAILFEETLYQSTTDGKKFVDCLREKKIVPGIKVDKGLVPLPGSNNESWCQGLDGLASRSAEYYKQGARFAKWRTVVSIPCGPSALAVKEAAWGLARYAAISQDNGLVPIVEPEILLDGDHPIDRTLEVAEKVWSEVFFYLAQNNVLFEGILLKPSMVTPGAEHKEKASPETIAKYTLTMLRRRVPPAVPGIMFLSGGQSEVEATLNLNAMNQSPNPWHVSFSYARALQNTVLKTWQGHPENVEAAQKSLLVRAKANSLAQLGKYSAEGESEEAKKGMFVQGYTY

SEQ ID NO: 16184 - protein, 385 aa, Geobacillus stearothermophilus
MSALFPTYNRWNIAVQSAEGTVVTDVNGKQYLDFVSGIAVCNLGHRHPHVQKSIEQQLNQYWHVSNLFTIPIQEEVASLLVAHSAGDYVFFCNSGAEANEAALKLARKHTGRHKVITFRQSFHGRTFATMAATGQEKVHSGFGPLLPEFIHLPLNDVDALKQAMSEEVAAVMLEVVQGEGGVRPVDPAFLQTASELCQQHGALLIIDEVQTGIGRTGKPFAYQHFDVEPDIITAAKGLGSGIPVGAMIGKAFLKESFGPGVHGSTFGGNPIAMAAAKATLEVVFDPAFLQDVQEKGRYFLARLHDALASLDIVKDVRGLGLLVGIECQTDVAPLLPLIHENGLLVLSAGPNVIRLLPLVVTKAEIDEAVDILTNVLNNANASAVL

SEQ ID NO: 16185 - protein, 223 aa, Oryza sativa
MAAAAVDPMALGLGTSGGGGGGESAVGGDGAEPVDLVEHPSGIVPTLQNIVSTVNLDCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGHAYSHGAFSSYEPELFPGLIYRMKQPKIVLLIFVSGKIVLTGAKYRKEIYAAFENMFPVLTEYRKTQQR

SEQ ID NO: 16186 - protein, 454 aa, Rubrobacter xylanophilus DSM 9941
MDVMRGLGEGGRRTPLPGVENLMLHFTPFSEDWGRLPVIVSGEGCYVTDAEGNRYIDGLAGLFTTQVGHGRSELAEAASRQMRELGFFPNWSFQHPRSLELAARLAELAPGDLSTSFFVSSGSEAVETVIKLARQYHKANGEPTRYKIISRKIAYHGTTLGALSVTGLPSFKAPFEPLLQGFMHVPNTQQDPEGAAEAIEEAIEFGPPETVAAVVLEPVQNAGGCLVPPEGYWRRVREICDRHGVLLVSDAVICAFGRLGEWFGIERFGVVPDMTSFAKGITSGYLPMGGVVVSEKVRDTLRENAPMFFHGSTFGGHPVSAAVALENINIIERERLLENVHDLEGHFQSELRRMAEGHPIVKDVRGMGFFWAVEVRPERADGTPLAGDEYERYFKGVVSRKLLEGGLICRFDDKDEPVIQYSPALVADREVISRIAEITDEALTELERELGYRS

SEQ ID NO: 16187 - protein, 522 aa, Oryza sativa Japonica Group
MGACFSSHTATAAADGGSGKRQQRKGDHKGKLPDGGGGEKEKEAARVEFGYERDFEGRYQVGRLLGHGQFGYTFAATDRASGDRVAVKRIDKAKMVRPVAVEDVKREVKILKELKGHENIVHFYNAFEDDSYVYIVMELCEGGELLDRILAKKNSRYSEKDAAVVVRQMLKVAAECHLHGLVHRDMKPENFLFKSTKEDSPLKATDFGLSDFIKPGKKFHDIVGSAYYVAPEVLKRRSGPESDVWSIGVITYILLCGRRPFWNKTEDGIFREVLRNKPDFRKKPWPGISSGAKDFVKKLLVKNPRARLTAAQALSHPWVREGGEASEIPVDISVLSNMRQFVKYSRFKQFALRALASTLKEEELADLKDQFDAIDVDKSGSISIEEMRHALAKDLPWRLKGPRVLEIIQAIDSNTDGLVDFEEFVAATLHIHQMAELDSERWGLRCQAAFSKFDLDGDGYITPDELRMVQHTGLKGSIEPLLEEADIDKDGRISLSEFRKLLRTASMSNLPSPRGPPNPQPL

SEQ ID NO: 16188 - protein, 74 aa, Zea mays
MAAKLAQLRAQAARAAEFASKHGGAYYKEVMEKNKQYVVQPPTVEKCQELSKQLFYTRLASLPGRYEAFWKEFD

SEQ ID NO: 16189 - protein, 406 aa, Coprinopsis cinerea okayama7#130
MRDRLKSAPSQPDPSKIPFRRTYSSNSIKVGRVEVGPSSFLKVKMLGKGDVGRVYLVREKKTNKLYAMKVLSKKEMIERKKIKRALTEQEILATANHPFIVTLYHSFQSEGYLYFCMEYCMGGEFFRALQTRPGKCLPEDGSRFYAAEVVAALEYLHLMGFIYRDLKPENILLHQSGHIMLSDFDLAKQSAEYGGLPSMVHSEQNGVPLVDTMSCTANFRTNSFVGTEAIPEYIAPEVIAAQGHTAAVDWWTLGILIYEMIYATTPFKGQERNETFNNIRHQPVTFRDSPKISSAGKDCMTRLLDKNERTRLGSRSGASEVKQHKWFSKINWGLLRNTRPPIVPSSSNGLDAAHFRHMRESTSLHLDLEDQSKAQPSADLLADDGQPADVLFKAFNSITLHHDGDT

SEQ ID NO: 16190 - protein, 545 aa, Volvariella volvacea
MAFSSSRMQSLLNTLTVMITLMGLGVSYAAAQQSFHTLELTNDEVNPDGFQRDAVLVNGGLFGAVITGQKGDGFVIEVDNQLTDSLLRKSTSIHWHGLFQRDSAWADGPAFVTQCPIAPGHTFTYRFTATEEAGTFWYHSHLDAQYCDGLRGPFIIYGPNDPHLGLYDVDNEDTIITLADWYHTPAELLSGGISPQSTLINGLGRSSSDFTAPLAVVNVQQGLKYRMRLISISCDPNWIFSIEGHELTVIEADGISVQPVTVTSLQIFVGQRYSFVLHANQPVGNYWIRANPNKGPTGFGNNINSAILRYQGAPIADPTGAGLQDALNRLAEPNLHPVVNPGAPGLAQINGADIDIVINIGFSGGLFNIAGTSYTSPDVPSLLQILSGTPPSKCIRSRVLNDAHRGIRLAHAQRILYRVPGNKVVQLSFPVIAGQGSAIGAPHPIHLHGHAFDVIRSAGSNVYNYVDPPRRDVVSIGRAGDNVTIRFVTDNAGPWYLHCHIEWHLRSGLGVIIAEDSQGVVNGPQPPPEWEELCDIYDALIPEDQ

SEQ ID NO: 16191 - protein, 319 aa, Oryza sativa
MDPATTELRFDTPLLRIYNDGRVERLFGTETTPAGFDGATGVTSKDVVIDDATGVSARLYIPDLPASGPGHHRKKLPIVVYFHGGGMVLDSAASPTYHRYLNSLVSKAGALAVSVNYRLAPEHPLPAAYDDAWAALSWTASAADPWLSEHGDVGRVFLAGDSGGANVVHNVAIMAGAGQSSLPPGATVEGVIILHPMFSGKEPIDGENAETRELTEKLWPLICADPEAGLDDPWINPMADGAPSLAVLGCRKLLVCSAESDIVLARAAAYYQAVMASGWPGMAEWLESKGEEHVFFLNKPDCEESVALMDRVVAFLAGN

SEQ ID NO: 16192 - protein, 359 aa, Oryza sativa
  misc_feature (267)..(267): Xaa can be any naturally occurring amino acid
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSXGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 16193 - protein, 533 aa, Volvariella volvacea
MLSPTLVALSVLFATTAFAIGPVTELQIVNDEIAPDGFSRGSVLANGAYPGPLITGSKGDRFLINVINELTDTTMLRATSIHWHGFFQNHTAWADGVASVTQCPIVPSESFLYNFTVPDQAGTLWYHSHLSTQYCDGLRGPLVVYDPDDPHRHLYDIDDGAIMMWLNQCHPDSYVAIESTIITLSDWYHVKAPVAGLQPTPMSTLINGRGRYAGGPNVPLEVINVVPGIRYRFRLVSMVCDPNYIFSIDGHELTIIEADGVNTKPLTVDSIQIFAGQRYSFILNANQPVDNYWIRANPNLGTTGFTNGINSAILRYEGAPLQDPTTPLVSSVNPLVESNLRNLIENAVPGQPFPGGADININLFTDFDWDMLHFTVNGSPYIPPNAPVLLQILSGTYNAQDLMPAGSIIELPSNKVIEISMPGGSPGSPHPFHLHGHTFDVIRSTDTQEYNFVDPVRRDVVNTGFETDNVTIRFTTDNPGPWILHCHIDWHLEVGLAVVFAEDIPRISTPAPPPSWDELCPEYDRFPVETFDQ

SEQ ID NO: 16194 - protein, 212 aa, Arabidopsis thaliana
MSEETKDNQRLQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDYKKNENKEVAVNDFLPSESAVEAIQYSMDLYAEYILHTLRR

SEQ ID NO: 16195 - protein, 533 aa, Volvariella volvacea
MAYSARLGSALSTLAIMLLVLALGVGHATAQASPPQSVHTLNLTNANVSPDGYNRSAILVNGNLLNEAIVGNKGDQFVITVENNLDNPLLRKSASIHWHGLFQRGTQWADGPAFVTQCPIAPEHSFTYQFTAGHEAGTFWYHSHLDAQYCDGLRGPFIIYDPADPHLSLYGVDDNSTIITLADWYHEPASQLSGIVIPKSTLINGLGRANTTTDAPLAVIHVEQGVKYRFRPVALSCDPNWVFSIEGHELTVIESDGVSVQPVTVTSLQIFAGQRYSFVLHANQAVDNYWIRANPNLGPTGFADGINSAILRYNGAPDEEPTGSGLQDPSNRLHEPDLHPVANPGAPGFDEIDGVDVNLVINIGFAAGRFSMAGASFEPPSLPALLQILSGTTDVADLLPAGSYIELPANKVVQISFPVISGGGAATGAPHPIHLHGHTFDVIRSAGSSTYNFVDPPRRDVVSIGTPGDNVTIRFVTDNAGPWFLHCHIEWHLRSGLGVILAEDIPGIVSGPQPPAAWEELCDIYNDLDEEDR

SEQ ID NO: 16196 - protein, 512 aa, Streptococcus thermophilus CNRZ1066
MSILEVKNLSHGFGDRAIFENVSFRLLKGEHIGLVGANGEGKSTFMSIVTGKLQPDEGKVEWSKYVTAGYLDQHAVLEKGMTVRDVLRTAFDELFKTEERINKIYMSMAEEGTDVDALMEEVGELQDRLETRDFYTLDAKIDEVARALGVMDFGMDTDVTDLSGGQRTKILLAKLLLEKPDILLLDEPTNYLDAEHIAWLKRYLQEYENAFVLISHDIPFLNDVINIVYHVENQDLVRYAGNYDNFQSVYAMKKAQLEAAYERQQKEIADLQDFVNRNKARVATRNMAMSRQKKLDKMEIIELQAEKPKPEFHFKESRTPGRFIFQTKDLVIGYDSPLTKSPLNLTFERNQKVAIVGANGIGKTTLLKSLLGIIQPLEGEVETGDFIDLGYFEQEAEGSRQTPLEAVWDAFPALNQAEVRAALAKCGLTSKHIESQIQVLSGGEQAKVRFCLLMNRENNVLVLDEPTNHLDVDAKDELKRALQAFKGSVLMVCHEPEFYEGWTDIWDFNELV

SEQ ID NO: 16197 - protein, 562 aa, Volvariella volvacea
MLFFSSRVKYLLGHLAVITAVVGGDVGNPGDHSGGYPGGHSEDHHGGPSGGHSGSHSDHSGSHRSFHTLKLTNGRVSPDGFQRNAVLVNGGLFQTAITGNKGDEFAIKIDNKLTNSLSHKSTSIHWHGLFQHGTPWADGPAFVSQCPIAPGHQYTYRFSSADQAGTFWYHSHLDAQYCDGLRGPFIIYDPGDPHRSLYDIDNKDTIITLADWYHRDSNLLSGIVIPNSTLINGLGRTAQSPNTPLAVVNVKQGLRYRMRLVAISCDPNWIFSIEGHKLTVIEADGVSVQPVTVTSLQIFVAQRYSFVLHANQPVGNYWIRANPNIGPTGFDSNINSAILRYKGAPIAEPRGLGLQNSDNRLREPDLHPLFNPGAPGLAHVDGADINMVINIGFIQSAGRFTIDGTSYVPPDVPTLLQILSGTPASSLLPSGSYIALPPNKVVQLSFPVFDGQGSALGGPHPIHLHGHTFDVIRSAGSSEYNFVNPPRRDVVAIGTPGDNVTIRFATDNAGPWYLHCHIEWHLRAGLGVVIAEDAPGLANGPEPPEEWKQLCPIYNALDPDDK

SEQ ID NO: 16198 - protein, 467 aa, Dekkera bruxellensis
MWRISSLWKAAVVNQRNKKSATIPILNVFDIYGRNFLFAWLGFLVCFLSWFGVPPLMTKMIKRDLKLTAVDIANNNICGLSATLLGRFVMGPVCDRYGPRWGMISILLIGAIPTAFMPLVNNVSGLHAIRFFISILGSSFVCCAQYVNAFFDNNIIGTANAVAAGWGNSGAGIAFFVMPAIASALLNNDGYSLHKAWSLSFVIGPFLILLFVAFLLLFFGQDCPMGKWSRRSDILGVNQNNTLIKTVSLSKHGKVLSITASAVGVTGVDDPAAANKILVNKDSNDEKKYLNDEAQDSEENDVDIEDLISKDEIIRDPTFWDVAKISFAPRTLLCALPYLTTFGTELAVESILSALYEQHEKLWPMKKAGDWASMMGLLNVVTRPLGGFISDILYHHFKSTKAKKFWMLFCGVVQGIFLIWIGFRPHLSIAGLITALSFMALFMEMANGANFAVVPFINKAHTGLISG

SEQ ID NO: 16199 - protein, 555 aa, Coprinopsis cinerea okayama7#130
MSGLADELLADLDGLSGGEEEHETTPQQQTAGASSSSSSLPQKRKATDEGPGSSLADELDMDDDEDEEDGGANAEEEEASKGREIGSLVMEGGVRPADELDAEDVQQMELGSIEDVTKVAKLEGSKKMSDILKDIEKYQENPSTPAQMSLPAHLNPEYTLIVQANNLSVEVENEILIVNKFIRDHYSPRFPELEQLVTDPTMYIKAVRALANADDLTKVELSGILPPAVIMSVVVTATTTPGTKLSAASWQAIEKACGLADRLEEARKKIFMYVSSRMNVLAPNLSAIVGTTTAAKLLGVAGGLAALAKMPACNVHLLGAQKKITAGFSTATQKRHTGFIFQSELVSQTPPEYQLKIQRTVGAKCVLAARMDLERQRRDGTYGESLRDKIEKHIDRLAAPPPSKVVKALPIPNDGPKKRRGGKRARRAKEAYAQTELRKLQNRVMFGEAEEEVGAFDQTKGLGMIGLASGKVRASVGEAKSKAKMSKQNKLRTAALARSAQQAQTSGTATSLSVTPAQGFELTNRAAMAQRVKEANERWFSGGTFSFVGQKGQTK

SEQ ID NO: 16200 - protein, 508 aa, Volvariella volvacea
MGLGVGFVAAGTASHTLTLTNGVVSPDGHSREVVLVNGALFGKLITGRKGDDFEIEVDNQLTNSLLRKSTSIHWHGLFQRGSAWADGPAFVTQCPIAPGNTFTYSFTPTDEVGTFWYHSHLDAQYCDGLRGPFVIYDRFDPHRHRYDVDNKDTIITLADWYHTPAAQLSGVITPNSALINGRGRTATTTTAPLSVIRVRRGRKYRMRLISMSCDPNYIFSIEGHEMTVIEADGISVEPVTVTSLQIFVGQRYSFVLHANQPVGNYWIRANPNKGPTGFVDGINSAILRYHGAPNAEPTGAGLQDALNRLAEPDLHPIVNPGAPGLATPDGVDIDIVVNIGFAAGLFNIDGTSYVSPDIPTLLQILNGVPVGSLMPSGSYIALPANKVVQISFPVVSGQGSAIGAPHPIHLHGHAFDVVRSAGSATYNYADPPRRDVVSIGTPGDNVTIRFVTDNAGPWYLHCHIEWHLRAGLGVILAEDAPGVLTGPAPPSEWDDLCDIYDGLDEEDQ

SEQ ID NO: 16201 - protein, 649 aa, Zymomonas mobilis subsp. mobilis ZM4
MFPNDKTPLLDKIKTPAELRQLDRNSLRQLADELRKETISAVGVTGGHLGSGLGVIELTVALHYVFNTPKDALVWDVGHQTYPHKILTGRRDRIRTLRQRDGLSGFTQRAESEYDAFGAAHSSTSISAALGFAMASKLSDSDDKAVAIIGDGSMTAGMAYEAMNNAKAAGKRLIVILNDNEMSISPPVGALSSYLSRLISSRPFMNLRDIMRGVVNRMPKGLATAARKADEYARGMATGGTFFEELGFYYVGPVDGHNLDQLIPVLENVRDAKDGPILVHVVTRKGQGYAPAEAAKDKYHAVQRLDVVSGKQAKAPPGPPSYTSVFSEQLIKEAKQDDKIVTITAAMPTGTGLDRFQQYFPERMFDVGIAEQHAVTFAAGLAAAGYKPFCCLYSTFLQRGYDQLVHDVAIQNLPVRFAVDRAGLVGADGATHAGSFDLAFMVNLPNMVVMAPSDERELANMVHSMAHYDQGPISVRYPRGNGVGVSLEGEKEILPIGKGRLIRRGKKVAILSLGTRLEESLKAADRLDAQGLSTSVADMRFAKPLDEALTRQLLKSHQVIITIEEGALGGFATQVLTMASDEGLMDDGLKIRTLRLPDRFQPQDKQERQYAEAGLDADGIVAAVISALHRNSKPVEVVEMANMGSIARA

SEQ ID NO: 16202 - protein, 180 aa, Coprinopsis cinerea okayama7#130
MFRSAISRPLFAAARPVISRTAIRPTLVRSYHEKVISHYEKPRNVGSLPKNDIDVGTGLVGAPACGDVMKLQIRVDENGIISDVKFKTFGCGSAIASSSYMTERVKGLSLEEAGKIKNTEIAKELCLPPVKLHCSMLAEDAIRSAIRDYKSKRKLAGSKPKIDLSHSTNASAAETSSPSA

SEQ ID NO: 16203 - protein, 409 aa, Aspergillus nidulans FGSC A4
MVQIKDFAVEQWMDKYETTAKYNVAETCSASISVRDLQALCEDPALNPLDGVLDRKLTYGEIRGSKQLRSTLANLYSVRTPTPLPSDNILVTAGAIQANFLLLYTLVGPGDHVICHYPTYQQLYSVPESLGAEVSLWKSKEAEGWKLDLEELKGLIRPNTKLIIINNPQNPTGAIIPQGTLDEIVEIARSSSIYVFCDEVYRPLFHSISPMDPDFPSSVLSLGYERAIVTGSLSKAYSLAGIRVGWIASRDRTVIEACASSRDYTTISVSQLDDAVASYALAPTTIHALLKRNIELGRTNLGILEKFIESHRWACDWVKPRAGTTAFVRFNKMGKPVNDTAFCEMLLERTGVMLVPGSLCFGGGEDFLGYVRIGYVCETQVLEEGLAKLKAFLEDDYEEVPAVKRKTQS

SEQ ID NO: 16204 - protein, 337 aa, Zymomonas mobilis subsp. mobilis ZM4
MKAAVITKDHTIEVKDTKLRPLKYGEALLEMEYCGVCHTDLHVKNGDFGDETGRITGHEGIGIVKQVGEGVTSLKVGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 16205 - protein, 332 aa, Pseudomonas aeruginosa PAO1
MRPEPTNAPAALSRRFSVAPMMDWTDRHCRFFLRQLSRHTLLYTEMVTTGALLHGDRQRFLRYDECEHPLALQLGGSVPAELAACARLAEEAGYDEVNLNVGCPSDRVQHNMIGACLMGHPALVADCVKAMLDAVEIAVTVKHRIGINGRDSYAELCDFVGQVREAGCRSFTVHARIAILEGLSPKENREVPPLRYEVAAQLKKDFPDLEIVLNGGIKTLEACREHLQTFDGVMLGREAYHNPYLLAAVDSQLFGSEAPPLSRSEALLRLRPYIERHQAEGGAMHHVTRHILGLAQGFPGSRRFRQLLSVDVHKAADPLRVFDQALELLAGR

SEQ ID NO: 16206 - protein, 316 aa, Vitis vinifera
  misc_feature (8)..(8): Xaa can be any naturally occurring amino acid
MACSVAVXNSPVFSPSSSLFCKTSRKRPARLDIPIASLSFPAPVPVGEGCREAVEDERDGYYSVYCKRGRREAMEDRYSAVVDLQGDHKQAFFGIFDGHGGAKAAEFAAQNLKNNILDEVVRRGDDEIEESVKHGYLNTDSDFLKEDLRGGSCCVTALIRNGKLAVSNAGDCRAVMSRGGIAKALTSDHRPSREDEKSRIEKLDGYVDCYHGVWRIQGSLAVSRGIGDRHLKQWVTAEPETKILAIQPDYEFLILASDGLWDKVTNQEAVDISRPFCIGVDKPDPLFACKKLVDLSVSRGSTDDISVMLIRLGQYI

SEQ ID NO: 16207 - protein, 228 aa, Zymomonas mobilis subsp. mobilis ZM4
MPTLVLSRHGQSEWNLENRFTGWWDVNLTEQGVQEATAGGKALAEKGFEFDIAFTSVLTRAIKTTNLILEAGKTLWVPTEKDWRLNERHYGGLTGLNKAETAAKHGEEQVHIWRRSYDVPPPPMEKGSKFDLSGDRRYDGVKIPETESLKDTVARVLPYWEERIAPELKAGKRVLIGAHGNSLRALVKHLSKLSDEEIVKFELPTGQPLVYELNDDLTPKDRYFLNER

SEQ ID NO: 16208 - protein, 496 aa, Oryza sativa Japonica Group
MAVQAGTPATPISPQVISGAFVQQYYHILHETPDQVYKFYQDASIVGRPDSNGVMKYVSTTADINKIILSMDFSNYLTEIETADAQLSHQDGVLIVVTGSLTSEGICRRFTQSFFLAPQESGGYVVLNDIFRFIVERPPVAISQVSQENENNQNTATLPETDPNPAGDGMISEPVAVENNVAEGEVTNSTVDGTSIENNATAAVEPPVQMTKEEPRKISVAAPPPPAQKDVTKKSYASITLTMIALQVKVMKEVSLTPVVKPKPAPKHVVKTVEASEKPSVKSSQTVEITPNDNNDAENNTSNDEQGYSVFVKSLPHNVTVQTVEEEFKKFGAIKPGGIQVRNNKIDRFCFGFIEFESQQSMQAAIEASPIHMGGKEVFVEEKRTTTRVVNGVVITRGDNGNAGGGGRYQSGRGGYRGDNFRGRGGGYANSGNYRGGDNFSRRNDLRNRNEFSGRGRGPPPGNGYQNNGFHPARPFQNGNGRFTRVNGPRQTPVAA

SEQ ID NO: 16209 - protein, 422 aa, Bacillus pumilus SAFR-032
MKPLLKENTLIQVKDILKAHQNLKDVVIHTPLQKNERLSERYECNVYLKREDLQVVRSFKLRGAFNKMSQLPKDKLKNGIVCASAGNHAQGVAYSCKYLGIHGKIFMPATTPRQKVSQVELFGKEYVEIILTGDTFDDSYHEAVKCGDEEKREFIHPFDDLDVMAGQGTTAVEILNDIEVEPHFLFASVGGGGLLSGVGTYIKNIAPETEIIAVEPLGAASLHASHEKGKVVTLDSIDKFVDGAAVQRIGEKTFTSLQSVVDKISLVPEGKVCTTILELYNQCAIVAEPAGALPIAALDAHREEIKGKNVVCIVSGGNNDIGRMQEIKERSMIYEGLQHYFIVNFPQRAGALREFLDEVLGPNDDISRFEYTKKNNRSKGPALVGIELKERDDYTALIERMNKKGFHYVEVNKDQDLFHLFI

SEQ ID NO: 16210 - protein, 316 aa, Cytophaga hutchinsonii ATCC 33406
MKNFISVKDVTDIPGLVKEALELKKNPYAFKKLGENKTIGLIFLNPSLRTRISTQKAAKNLGMDTIVMNMDKEGWALETQDGVIMNHNTVEHIREAAAVMGQYCDIIGVRSFPRLVDKNEDYSEDFFNKFIKYAGVPIVSLESATLHPLQSLADLITIEETKTKPRPKVVLTWAPHIKALPQAVANSFSEWMCKADVEFVITHPEGYDLANEFTNGARIEYNQDKALEDADYVYVKNWSSYEDYGKVHSMDSHWMMTNEKLKLTNNAKVMHCLPVRRGIELADEILDGPNSLVIQEASNRVWSAQAVLKRMLEAQG

SEQ ID NO: 16211 - protein, 314 aa, Zea mays
  misc_feature (106)..(107): Xaa can be any naturally occurring amino acid
  misc_feature (110)..(110): Xaa can be any naturally occurring amino acid
MPLGQRSGDKSDSRYCGVEVLDFPVGEGLPAVLNHSLASAFDFILAPLVDPNYRPAPGAVLPVSASDLVLGPSQWSNHVVGKISEWIDLDAEDERLRLDYARVVNXXCKXLTNMNLWLRLPLEKSEPMDDDLDKIKNNSHTSEIVDSWELWNSFRLLCDHSSQLCVALDILSTLPSINSLARWFGEPVRAAILQTEAFLTNAKGYPCLSKRHQSLLTGFFKHSVQVIISGRSNHNVFPVSEGVLSGDESYTEDSHVRHALTPYLEYIAYLYRKMDPLPEQERIEPLMDNLEAQTYETFEKDVVKYTQYRRAVAK

SEQ ID NO: 16212 - protein, 482 aa, Zea mays
  misc_feature (302)..(302): Xaa can be any naturally occurring amino acid
MASSASTLEIEARDVVKIVLQFCKENSLQQTFQTLQNECQVAQLKLPRKKLEDLYEQIVLEMAELRELDTARAILRQTQVMGVMKQEQPERYLRLEHLLVRTYFDPNEAYQESTKEKRRALIAQAVASEVSVVPPSRLMALIGQALKWQQHQGLLPPGTQFDLFRGTAAMKQDEEETYPTSLSHQIKFGKKTHPECARFSPDGQYLVSCSVDGIIEVWDYLSGKLKKDLQYQADESFMMHEEPVLCVDFSRDSEMLASGSQDGKIKVWRIRTGQCLRRLERAHSKGVTSVTFSRDGTQILRXHGLKSGKMLKEFRGHSSYVNYAIFTTDGSRVITASSDCTVKVWDTKTTDCLHTFKPPPPLRGGDASVNSVHLFPKNTDHIVVCNKTSSIFIMTLQGQVVKSFSSGKREGGDFVAASVSPKGEWIYCVGEDMNMYCFSYQSGKLEHLMKVHEKDVIGITHHPHRNLVATIAEDCMMKIWKP

SEQ ID NO: 16213 - protein, 264 aa, Cytophaga hutchinsonii ATCC 33406
MQKLYIIKVGGNIIDNPEALTSFLKDFASLKENKILVHGGGKVATEISKGLGIEAQMVDGRRITDAETLKIVTMVYGGLINKNIVAKLQSNECNAIGLTGADANIMLSSKRPLKNGIDYGFVGDVKKVHPQPLIHLLSQGITPVVAPLTHDGNGTMLNTNADTVASELAVALCGAFAVNLVYCFELKGVLRDFEDKDSVISTINPDTYEELKSTGVINKGMIPKLDNSFNAINAGVSSVIICQAESLVELINENKTVGTKLVAN

SEQ ID NO: 16214 - protein, 364 aa, Vitis vinifera
MSRAKREQLSRTLNSHLNNIHETFQVLDQTSSLPLDKVSWDDVIQMGEQVYKQATIVGMLWTGEAPEVSALEGNMEAYFNMLQGFLFLSHGSTVGAGPTLSSSIHASVKQVVDSSFRLLKESVSSYGSRNRDQKLSIPQLVGAVWEACSALKKTPATNITAIGRTMTQVAVSMKDVLREMKELKPASSDPTDETSDEASNKAESIPENDDNSSEGDLGNDLSPEEMKIAVSVISVVTEILAVIKELIRCITGLVKQEDANKSSNFVDSLEKLLKLCQGIGVQVDELGACLYPPQEIPAMKAAAEKISGSVDEIQAEIENLGGTTETFIQACNVLRSSLGQLNSLVGDSSTADLVPEMQNLAVTS

SEQ ID NO: 16215 - protein, 284 aa, Streptococcus agalactiae NEM316
MKGIILAGGSGTRLYPLTRAASKQLMPIYDKPMIYYPLSVLMLAGIKEILIISTPQDLPRFEDMLGDGSELGISLSYAEQPSPDGLAQAFIIGEEFIGDDHVALVLGDNIYHGPGLSAMLQRAASKESGATVFGYQVKDPERFGVVEFDTDMNAISIEEKPAQPKSNYAVTGLYFYDNDVVEIAKNIKPSPRGELEITDVNKAYLDRGDLSVELMGRGFAWLDTGTHESLLEAAQYIETVQRMQNVQVANLEEIAYRMGYITREQVLELAHHLRKMSMVNTYFV

SEQ ID NO: 16216 - protein, 1538 aa, Arabidopsis thaliana
MKKETQNLQCIPLVISVLSLFGVSSARKPPYLCNRVCGGISIPFPFGIGGKECYLNPWYEVVCNTTTSVPFLSRINRELVNIYLPDPTEYYSNGVVHIKGPVTSSGCSTGTSQPLTPQPLNVAGQGSPYFLTDKNLLMAVGCNVKAVMMDVKSQIIGCESSCDERNSSSQVVRNKICSGNKCCQTRIPEGQPQVIGVNIEIPENKNTTEGGCKVAFLTSNKYSSLNVTEPEEFHSDGYAVVELGWYFDTSDSRVLSPIGCMNVSDASQDGGYGSETICVCSYGYFSGFSYRSCYCNSMGYAGNPFLPGGCVDIDECKLEIGRKRCKDQSCVNKPGWFTCEPKKPGQIKPVFQGVLIGSALLLFAFGIFGLYKFIKKQRRSSRMRVFFRRNGGMLLKQQLARKEGNVEMSKIFSSNELEKATDNFNTNRVLGQGGQGTVYKGMLVDGRIVAVKRSKAMDEDKVEEFINEVVVLAQINHRNIVKLLGCCLETEVPVLVYEFVPNGDLCKRLRDECDDYIMTWEVRLHIAIEIAGALSYLHSAASFPIYHRDIKTTNILLDEKYQVKVSDFGTSRSVTIDQTHLTTQVAGTFGYVDPEYFQSSKFTDKSDVYSFGVVLVELITGKNPSSRVQSEENRGFAAHFVAAVKENRFLDIVDERIKDECNLDQVMAVAKLAKRCLNRKGKKRPNMREVSVELERIRSSSYKSEIHNDDDDDDDDDDEDDQAMELNIEETWDVGMTAPASMFNNGSPASDVEPLIRCLGQLLFCILNPERTCQHGDDGQMSIMWWSTFIWSSEKRCFVTCFTLLSKPLLTFTLTSDRAASVLTLQLMNGSSAATPPPPPNSKNSSTSCNRTCGGISIPFPFGIGGKDCYLNGWYEVVCNATTSGSSGTTVPFLSRINREVVNISLPEGNNEQYGVVHIKGPVTSLGCSSNTSQVPQKSLPDLNVTGKGSPYFITDENRLVAVGCGTKALMTDIESEILGCESSCKDSKSSQEVTNLLCDGYKCCQARIPVERPQAVGVNIESSGGDGCKVAFLSSKRYSPSNVTIPEQFHAGGYVVVELGWYFATTDSRFRNPLGCINLTYSGSYLSGDSCLCEYGYFSEMSYRNCYCSLGFTGNPYLRGGCIDNDDCKGPNICEEGTCVNVPGGYRCDPKPKIIKPAKPLVLQGVLLGLMGLLFLVVGTLGLIIFIKKRRRIISSRKFFKRNGGLLLKQQLTTTNDGNVDMSRLFSSEELKKATDNFSVKRVLGKGSQGTVYKGMMVDGKIIAVKRSKVVDEDKLEKFINEIILLSQINHRNIVKLIGCCLETEVPILVYEYIPNGDMFKRLHDESDDYAMTWEVRLRIAIEIAGALTYMHSAASFPIYHRDIKTTNILLDEKYGAKVSDFGTSRSVTIDQTHLTTMVAGTFGYMDPEYFLSSQYTDKSDVYSFGVVLVELITGEKPLSRIRSEEGRGLATHFLEAMKENRVIDIIDIRIKEESKLDQLMAVAKLARKCLSRKGIKRPNMREASLELERIRSSPEDLEAHIENDDEEDQVMEISRE

SEQ ID NO: 16217 - protein, 391 aa, Physcomitrella patens subsp. patens
MQVNSDAQRAEEQPYGIPEKRVPEHWGVVGLGQAMVDFSGIIGDDFLKELGLVKGTRKVVNHEERGKVLRALDGRNYKLSAGGSLSNTLVALARLGVASSHNSAQNVAMTGSVGSDALGDFYRTKLLRANVHFLSQPVVGGTTGTVIVLTTPDAQRTMLSYQQGMSSIVNFDSVLADAIAKSRVLVVEGYLWEINQTIEAIAQACETARQQGVLVALTASDVSCVTRHRQQFWDVMCQSSDILFANADEARALCALGNDCTPEQATKHLNQFCSLVSVTDGARGSYIGLRGEVFFIPPAPCVPVDTCGAGDAYAAGILYGLLRGMPDVRGMGDLAARVAAVVVGQQGARLKEEAALELAESVNSFSDALDNRITVLMGMKDEVKSQKTSNV

SEQ ID NO: 16218 - protein, 560 aa, Vitis vinifera
MASRRLLSSLLRSSVRRYSAKSPAISPRTPSPYPSSRPSPKGFLLNRAVDYATSAAAAASPPPPPPAKGAGPSGKITDEFTGAGAIGSVCQVIGAVVDVRFDEGLPPILTALEVLDNSIRLVLEVAQHLGENMVRTIAMDGTEGLVRGQRVLNTGSPITVPVGRATLGRIINVIGEPIDERGEIKTDHFLPIHREAPSFVDQATEQQILVTGIKVVDLLAPYQRGGKIGLFGGAGVGKTVLIMELINNVAKAHGGFSVFAGVGERTREGNDLYREMIESGVIKLGDKQASFSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEVFTGAPGKYVELKESITSFQGVLDGKYDDLSEQSFYMVGGIEEVIAKAEKIAKESAA

SEQ ID NO: 16219 - protein, 222 aa, Coprinopsis cinerea okayama7#130
MQVLTDGSVYAEHAGRAGKLEMEDIVLAVQARVGWEFGGRVPKEYILSLATEVNAAPLPPVPEVFGVRLPPTSECLASVDFDLIPNKPPPGVKIYDEEIEEIEEEESEEDEEMQPVEPESQQSAAINTMMATPSSASHQDPDQFADTPFPISAIATPSDVDMLGTPGIGARAEAEEGSDADDDGLFAGPDDEEEESDGMEEVQTSSAVNGVKRKLVEEDDYD

SEQ ID NO: 16220 - protein, 516 aa, Penicillium digitatum
MDLVPLVTGQIKCIAYYTTGLVLASIVLNVIKQLVFYNRKEPPVVFHWIPFIGSTVAYGMDPYQFFFASRAKYGNIFTFILLGKKTTVYLGVEGNEFILNGKLKDVNAEEIYGKLTTPVFGSDVVYDCPNSKLMEQKKFIKYGLSQEALESYVPLIADEISSYIKSSPSFKGQSGTIDLVPAMAEITTFTAARTLQGEEVRSKLTTEFAKLFHDLDLGFTPINFMLPWAPLPQNRKRDRAHRRMREIYVDIIQARREAGEEANDNGRDKTKGTDMISNLMRCVYRDGTPIPDKEIAHLMITLLMAGQHSSASISCWILLRLASQPEMTEKLFAEQVNNLGADLPLLQYKDLDKLPLHRNVIKETLRLHSSIHTLMRKVKNPMPVPGTDFVIPPSHTLLSSPGVTARDERHFRDPLRWDPHRWGSRVEAEDSSDTVDYRYGAVSKGTRSPYLPFGAGRHRCIGEKFAYLNLGVIIATLLREFRFFNPEGMEGVPDTDYSSLFSRPMQPATVRWEVRS

SEQ ID NO: 16221 - protein, 859 aa, Legionella pneumophila str. Paris
MSGILIMQQVVIKFGGTSVSSRATWNNIAAITQKHLNTGVQPVIVCSALTQISNKLEKAIEAALLDEHHSLFNDIQSSHLNLAEQLEVNHQLIANDLHQLQQWLTGISLLKQAPAKTHAQILSLGELMMTRLGHAFLEKQGIKVKWYDARELLTSTPTLGGETMNYLSARCESEYDPALVEKFLSTGAQAIITQGFFAANPHGETVLLGRGGSDTSAALLAGKLQAASCEIWTDVPGIYTANPHQLPHARLLKQLNYDEAQEIASMGAKVLHPNCIPPVRKANIPMVVKYTHLPEHSGTLITKDIDESAPLIKSIQVKHSILLISIDTLNMWQQVGFLADVFAAFKKHGFSVDLLSSSEFNVTLSLDVNAKIHDRPAINALLDDLNQFGRAKLIEPCSAVSLVGHHIRTVLPHLGPALEVFEAKQVYLMSLASNDLNLTFVVDESHADKLCQRLHHLLIESNPQIFYYSKSWHEEFGKPNVRPTPWWEIERDRLLTTSAIHSPCYVYHSPTQATRARQLSALESIDSLFYAIKANPFPSILKTLEKEGIGFECVSIQELELVLKLFPNIKKERILFTPNFAPKSEYEFALQTGCYVTIDSLYPLENWPKLFKDREVIVRIDPGTGAGHHKHVSTGGNESKFGITQNDISKILSHTKANHIKVIGLHAHSGSGILSTDLWQQTAVMLASLTDQFPEVRSINLGGGLGIVEKPGQHPIDFAALDAQLMAVKSQYPGLAIWLEPGRFFVAESGVILAKVTQCKEKGKVKFIGIETGMNSLIRPSLYGAYHEIINLTRLHEEKAGFAHIVGPICESGDTLGYDRLLPVTREGDVILIANTGAYGHCMSSHYNLRPPAQEIVLE

SEQ ID NO: 16222 - protein, 307 aa, Mycobacterium smegmatis str. MC2 155
MIRHFLRDDDLSPEEQAEVLTLAADLKKTPFSRRPLEGPRGVAVIFEKNSTRTRFSFEMGIAQLGGHAIVVDGRSTQLGREETLEDTGAVLSRYVDAIVWRTFAQERLTAMASGASVPIVNALSDEFHPCQVLADLQTLAERKGKLAGLRMTYFGDGANNMAHSLMLGGVTAGVHVTIAAPDGFEPDPRFVDAARRRAAETGATVALTKDAKAGADGADVLVTDTWTSMGQENDGLDRVRPFRPFQVNADLLELADPAAVVLHCLPAHRGHEITDEVIDGPQSAVFDEAENRLHAQKALLVWLLEKR

SEQ ID NO: 16223 - protein, 141 aa, Lactobacillus delbrueckii subsp. lactis
  misc_feature (138)..(138): Xaa can be any naturally occurring amino acid
LTGDVFGSKRCDCGHQLHQAMRRIEEKGSGLILYLNQEGRGIGLTNKLRAYALQDQGHDTYDANLLLGFAPDERKYDVAAKMIKDLGIKQVQLLTNNPDKIKQLEEAGVEITDRLPLEIAATAEDRRYLETKRDRFKXMLV

SEQ ID NO: 16224 - protein, 249 aa, Oryza sativa Japonica Group
MANLFLKQAKQYAATRPAYPPELFDFIASKTARHDLAWDVGTGSGQAIPALAKLYKDVVGTDTSAQQLFLRAAPPQRALRPHAADLPLDGIHAAVAPPGSVDLVTVAQAFHWLDLPRFYAQVRSVLRAPQPQQAAGVLAAWCYTEPCVDAAVDDAFWRLYNGSQPYWAPNRRLAHTGPFEFSTERRMDLDGYLAYITSWSAYQTAKEKGVELLDEATVRGFADAWGGDRVEVKTVRYPIFLRIGKVRTE

SEQ ID NO: 16225 - protein, 520 aa, Ostreococcus tauri
MVKTASSSSGRFESRASASMTSRAREMEQTLEVQAEGEGVEDEMREIAVDARAPRVRRDRAKTASRELKRRFQSRDARCVILAGGADETNPLTRRRARSAVHLAGTYRVIDFPMTNLINSGMRQLYVLTQFNSHSLVTHVNKAFPSELFGGEVNGFVEVLPTSQTREHGETWSLGSADCVARHLSSGSLTKYTYEMRMEDECLRQLGSLDECLMSELDGTTIILSAEALYSMNFAELLEQHFLKGADVTIATCNQISSDQANAFGILDVDEMTAQVNCFIEKPTKAQLEEFMQCTTEELESCKLDANMGVYVFNNSALLELLTASKSGVAPGGPTRVRLGYDVKAFRHSDYWKPLRSLRDLYEANISIAVGGDAASLLTHGRQVYTKPNFLPPTTFHGSVYTEKTIFSDGCLVQDGSRIVNSVIGACTSIDKNVDLEGVVVVGRDEIMKRSGGVNSVPDIGANTIIRKCIIDSDATIGANVRIVNAAGIEELDRTDEGYVITEGIVTILGGAIIPDGFVI

SEQ ID NO: 16226 - protein, 274 aa, Campylobacter coli RM2228
MLQTCIFPAAGYGTRFLPATKALPKEMLPILTKPLIHYGVDEALEAGMDNMGFVTGRGKRALEDYFDISYELEHQISGTNKEYLLKDIRSLIHRCTFTFTRQNEMRGLGDAVLKGRPLAGDEAFGVILADDLCINEEGVNVMAQMVKIYEKYRCTIIAVMEVPKEQVSSYGVIAGNFVEEDLIMVNSMIEKPSPQEAPSNLAIIGRYILTPDIFGILENTKAGKNGEIQLTDALLTQATNGMVLAYKFKGKRFDCGSVEGFVEATNYFYEKSKC

SEQ ID NO: 16227 - protein, 402 aa, Aspergillus nidulans FGSC A4
MAAEVASRKCLGTDCGKDAGSLQCPTCLKMGLDSFFCSQDCFKRSWSDHKALHKKSNFLTNLFPPKVVSEPDPATGLFNPFPSFGFTGSLRPVYPLSPMRTVPKSIPHPDYAKDGIPRSEQKFVGRHNITILNKAEQEGMRKVCRLAREVLDIAARELRPGVTTDYIDEVVHKACIERNSYPSPLNYVHFPKSVCTSINETICHGIPDQRPLEDGDIINIDVTLYHEGFHGDINETYYVGEKARSNPDAVRVVETARECLDKSIEIVKPGMLFRDPGNVIEKHAKSRNCSVVKSYCGHGINQLFHCAPNVPHYAKNKAVGTAKPGMCFTIEPMINIGTHRDRLWPDDWTSTTADGSLSAQFEHTLLVTEDGVEVLTARLPDSPGGPIPMPGTEAAGEVKTDA

SEQ ID NO: 16228 - protein, 452 aa, Ostreococcus tauri
MAGTNTPVTAALGAAAANDGMDNVLSIILGGGAGTRLYPLTKKRAKPAVPLGANYRLIDIPVSNCINSDINKVYCLTQFNSASLNRHLAQAYNTNIGTHTRQGFVEVLAAQQSPVNKAWFQGTADAVRQYLWLFEESKCEEYLILSGDHLYRMDYRPFIMKHRETEAAITVAALPCDEKRASSFGLMKIDNTGRVIEFAEKPKGAELQAMKVDTTVLGLDADKAQEMPFIASMGIYVFDAKKMRECLLENFKEADDFGGEIIPMAAQMGLKVQAFLYEGYWEDIGTVDAFFHANLSCNDPNPAFNFHEMNAPIYTQSRFLPPSKVQDCEIERSTIGDGCFITKAKLKNVMVGLRSTVNANCDLEDTLVMGADYYETYDEAKTSALPGGVPIGIGAGTKIRKAIIDKNARIGENCQILNEAGVMDKDCENEGYIIRDGIIVVIKDAVIKPGTV

SEQ ID NO: 16229 - protein, 401 aa, Salmonella enterica subsp. enterica serovar Paratyphi B str.
MNAFNPTQFRAQFPALADAGVYLDSAATALKPQAVIDATHQFYCLSAGNVHRSQFAQAQRLTAQYEAARAKAARLLNAPDEKSIVWTRGTTEAINMVAQCYARPRLRPGDEIIVSVAEHHANLVPWLMVAQQTGAQVIKLPLNDRRLPDVERLPELITSRSRILALGQMSNVTGGCPDLASAISTAHAAGMVVMVDGAQGAVHFPADVQQLDIDFYAFSAHKLYGPTGIGVLYGKPELLEAMSPWLGGGKMIRDVSFEGFSTQSAPWKLEAGTPNVAGVIGLCAALEWLSDIDIEQAENWSRGLATLAEDALAKRPGFRSFRCQDSSLLAFDFVGVHHGDMVTLLAEYGIALRAGQHCAQPLLAELGVTGTLRASFAPYNTQHDVDALVNAVDRALELLVD

SEQ ID NO: 16230 - protein, 636 aa, Saccharomyces cerevisiae YJM789
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYEYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDAGTHPFHLHGHAFQTIQRDRTYDDALGEVPHSFDPDNHPAFPEYPMRRDTLYVRPQSNFVIRFKSDNPGVWFFHCHIEWHLLQGLGLVLVEDPFGIQDAHSQQLSENHLEVCQSCSVATEGNAAANTLDLTDLTGENVQHAFIPTGFTKKGIIAMTFSCFAGILGIITIAIYGMMDMEDATEKVIRDLHVDPEVLLNEVDENEEREVNEDRHSTEKHQFLTKAKRFF

SEQ ID NO: 16231 - protein, 363 aa, Anthurium andraeanum
MATEVMTAVPAGSRVESLASSGIQAIPPEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKANFSIWPKQPANYVEETREFGRQLRVVASKMLAMLSLGLGVEEGKLEAEVGGMEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGHPAQFPPRTFSQHIQHKLFRKTQGDFATPN

SEQ ID NO: 16232 - protein, 641 aa, Bordetella bronchiseptica RB50
MIRASGLTLRRGTKVLLDGADFVVHPGERVGIVGKNGAGKSSLFALLTGALDPDAGNLDLPAGWRIASVQQEIAADAQAAREFVIDGDTHLRALQAQRAALTDDQGTQIAETEAALIEAGAWSAASRAEQLLAGLGFKPSEWMQPVRSFSGGWRMRLALARALMAPSELLLLDEPTNHLDLDAMLWLEKWLTAYPGTVLLISHDTEFLDAVARAILHFDQAKLQRYRGGYQDFLLQRAERLRQANIAYERQTREAARLQGFIDRFKAKASKAKQAQSRVKALARMEALAPIHAESGIDIRIPSPDHMPDPLLAMEHMDAGYGGAEPILRDVTLMVRAGSRIGVLGANGAGKSTLIKTLADELAPHAGTRRASRGLAIGYFHQHQLDMLDLDSTPLAHLARLAPEVREQELRNYLGGFGFSGDTVLSKVGPMSGGEKARLALSLIVWQKPNLLLLDEPSNHLDVETREALATALAEFSGSMLLVSHDRHLLRTTVDSFWIVADGGVREFDGDLEDYRDWLAARNAGERAAAREAAAGEPGVAVDRKAQRRLEAEQRQRLATLRKPLAAKLAKVEADMERARARLQELDAVIADADLYSDARRTERQQVMTEHGESGKRLNDLEEQWLEIQQALEEIEQDNAA

SEQ ID NO: 16233 - protein, 480 aa, Vitis vinifera
MVKICCIGAGYVGGPTMAVIALKCPSIEVAVVDISVSRITAWNSDQLPIYEPGLDGVVKQCRGKNLFFSTDVEKHVSEADIVFVSVNTPTKTRGLGAGKAADLTYWESAARMIADVSKSDKIVVEKSTVPVKTAEAIEKILTHNSKGIKFQILSNPEFLAEGTAIQDLLKPDRVLIGGRETPEGQKAIQALKDVYAHWVPEDRILTTNLWSAELSKLAANAFLAQRISSVNAMSALCEATGADVTQVSYAVGTDTRIGPKFLNASVGFGGSCFQKDILNLVYICECNGLPEVAEYWKQVIKVNDYQKNRFVNRVVSSMFNTVSNKKIAILGFAFKKDTGDTRETPAIDVCKGLLGDKARLSIYDPQVTEDQIQRDLTMNKFDWDHPIHLQPMSPTTVKQVSMVWDAYSATKDAHGICILTEWDEFKTLDYKKIYDNMQKPAFVFDGRNIVNAEKLREIGFIVYSIGKPLDPWLKDMPAVA

SEQ ID NO: 16234 - protein, 298 aa, Oryza sativa
MPPNAHAMPGRVGGRVGGRVGGEYMAKDYSDPPPAPLIDAEELTKWSLYRAVIAEFVATLLFLYITVATVIGYKHQSDPGANAADAACSGVGILGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 16235 - protein, 499 aa, Vitis vinifera
MELLSCLLCFLAAWTSIYIMFSARRGRKHAAHKLPPGPVPLPIIGSLLNLGNRPHESLANLAKTYGPIMTLKLGYVTTIVISSAPMAKEVLQKQDLSFCNRSIPDAIRAAKHNQLSMAWIPVSTTWRALRRTCNSHLFTSQKLDSNTHLRHQKVQELLANVEQSCQAGGPVDIGQEAFRTSLNLLSNTIFSVDLVDPISETAQEFKELVRGVMEEAGKPNLVYYFPVLRQIDPQGIRRRLTIYFGRMIEIFDRMIKQRLQLRKIQGSIASSDVLDVLLNISEDNSNEIERSHMEHLLLDLFAAGTDTTSSTLEWAMAELLHNPETLLKARMELLQTIGQDKQVKESDISRLPYLQAVVKETFRLHPAVPFLLPRRVEGDADIDGFAVPKNAQVLVNAWAIGRDPNTWENPNSFVPERFLGLDMDVKGQNFELIPFGAGRRICPGLPLAIRMVHLMLASLIHSYDWKLEDGVTPENMNMEERYGISLQKAQPLQALPVRV

SEQ ID NO: 16236 - protein, 312 aa, Magnaporthe grisea 70-15
MADKDFTLNTGAKIPAFGLGTWQGDKGVIKEAVLTAIKSGYRLIDGAYVYGNEEEVGQGIREAISSGIVKREDLFVVSKCWATYTTRCELGLDQSLKLLGLDYVDLYLVHWPILMNPEGNDEKFPKHADGSRDIIHTHNHVDTWKLMEKLPATGKTKAVGVSNYSKAWLEQLLPHATTVPAVNQVENHPQLPQQELVDFCKEKGIHIMAYSPLGSTGGPLLTAEPVVKIAEKHSISPAAVLLGYQIARGITVIPKSVNPDRIKANAQLKDLDAEDMKLLNDYSEQLAKDGKLNRYVFPPFGTDFGFPDKVGQ

SEQ ID NO: 16237 - protein, 654 aa, Solibacter usitatus Ellin6076
MIQLTGAGKRYGPRILFENTDWLVTPNERAGIVGANGTGKSSLLKVLAGIEGLDSGTISLQKGVTLGYLPQEGLSLSGRTVFAECMTVFAGLRELEDEQERLTQRMSELDPSSPEYAQVAERFHMSESEFRARDGYTVESQVGAVLSGLGFPQRDWKRRTEEFSGGWQMRIALAKLLLEKPNLLLLDEPTNHLDLEARNWLEEYLSSYPYAFVLVSHDRYFLDVTVKKIVELWNKNLHFYTGGYSRYEVQKDERRAQLQAAYANQRDRIEQLESFINRFRAQATKAKQVQSRIKELEKIERIEIPPDEKSIHFSFPQPKPSGRIVAEFKKVSKAYGDHVVFSGADVIIERGDRVALVGINGAGKSTMIKILAGAEPVTTGEYILGHNAQPDYFAQDQYKELDQTAKMIDDLGIVAPRATNTELRSILGSFLFSEDDVFKQIGVLSGGERNRYALARMLMVPSNFMLLDEPTNHLDMRAKDVLLRALQDYTGTVVFVSHDRYFIDKLATRIVEVENGNVQVYPGNYEDYLWRKAGGSGSVIGDTGTPSMPTPAAVPVLVETQATNQTTNQALASKSGVVRLNPIKLRQMKERRHAIEDEVTRLEVEIADYEAELANFVSVEETKRVNELLEARRSDLEALMFEWEEVAQLIEANS

SEQ ID NO: 16238 - protein, 355 aa, Nocardia farcinica IFM 10152
MRQKIIVDVDTGIDDSLALLYLLASPEAEIVGIAATAGNVSAAQVAANNLAWLDVCRAPAIEVALGAAAPLAIPLRTTEDTHGPQGVGYAELPTSARPLSDRSAAQLWVDLARAHPGQITGLCTGPLTNLALALRLEPALPLLLRRLVVMGGAFNHPGNTTPTNEWNVHVDPEAAKAVFDAFSAAPPERRPLICALDITETIEMHPHHLAELARRAGSTPVEQPAPTDPPGTRSTAANPVIRHVTDAVRFYFEFHDAYDQGYLAHMHDPFAAAVALDPALARVRPATVDVELTGTITRATTVADWAGMWGRPFNADIVLGTDPALFFERMIDRVGAYARSLYPPVANLPATQEVP

SEQ ID NO: 16239 - protein, 246 aa, Xanthobacter autotrophicus Py2
MSDNIAGKVVVITGASSGLGAATARHLAAAGAKLVLGARRLDRLQALATELDLGAAAAVETDVTDPAQVKHLVDAAVAAHGRIDVLLNNAGLMPQSLLERGRVDEWDRMIDVNIKGVLYGIAAALPHMKAQKGGHIINVSSVAGHKVRPGSSVYAATKAAVRLLSEGLRQEVKPFNIRTTIISPGAVESELPQSVTEPDTAKAIADFYAAYAIPADSFARVVAFAISQPEEVDINEILFRPTAQEL

SEQ ID NO: 16240 - protein, 266 aa, Salmonella enterica subsp. enterica serovar Paratyphi B str.
MVISDAWRQRFGGTARLYGEKALQRFAEAHICVVGIGGVGSWAAEALARTGIGAITLIDMDDVCVTNTNRQIHALRDNVGLAKAEVMAERIRQINPECRVTVIDDFITPDNVAGYMNAGFTYVIDAIDSVRPKAALIAYCRRYKVPLVTTGGAGGQIDPTQIQVADLAKTIQDPLAAKLRERLKHNFGVVKNSKGKLGVDCVFSTEALVYPQADGSVCAMKATAEGPKRMDCASGFGAATMVTATFGFVAVSHALKKIMAKAARQE

SEQ ID NO: 16241 - protein, 640 aa, Bacillus anthracis str. Ames
MILLQVNALSKLYGAETILANIKLEVQTKDRIALVGRNGAGKSTLLKIIAGELSHDGGEIIKPKDVSMGYLAQNTGLETSLTIWDEMLTVFTHLQQMETKLRRLEQEMGKEENFSNEATYERLLADYDQLQLDYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVIELSTEGAQEYLGDYDYYVEKKNEMIERAELEQEDETPVQKTVAQEKLNYLEEKERKKLERQRTRKIEELEQNIVQFEEEIATLEDQLCLPEIYADYEKASEITTKKQTLQEQLDACMAEWEELHV

SEQ ID NO: 16242 - protein, 535 aa, Legionella pneumophila str. Paris
MAKLTTQINTSSQEFKNNQANMQALVTDLREKIHQISLGGDEKARTKHQQQGKLLPRERLHQLLDPGSPFLELSQLAAYQVYEDTIPAAGIITGIGRVAGNECVIVVNDATVKGGTYYPLTVKKHLRAQEIALINHLPCIYLVDSGGAFLPLQDQVFADKEHFGRVFYNQAQMSALNIPQIAVVMGSCTAGGAYVPAMADESIMVKNQATIFLGGPPLVKAATGEVISAEELGGAEVHCRHSGVSDHYAENDAHALYLARVAISNLNRKKPDSIHRVDTVPPLYDSEDLTGIIPTDPRKPFDIREIIARVVDGSEFDEFKALFGTTLVCGFARLYGYPIGIIANNGILFSESAQKGSHFIELCCQRKIPLVFLQNITGFMVGSKYEASGIAKHGAKMVTAVANANVPKFTIIVGGSFGAGNYAMCGRAYAPRFLWAWPNARISVMGGEQAANVLAQITREKYAKQGKEWSLEEEEQFKTQMRSQYETQGNPYYASARLWDDGVIAPQDTRKILGLGLSAALNAPIEDTRFGVFRM

SEQ ID NO: 16243 - protein, 397 aa, Hyphomonas neptunium ATCC 15444
MNIHEYQAKALLKSFGAPVAEGVPVLSLADVQKAIDTLPGPLWVVKSQIHAGGRGKGKFIEKEAGEKGGVRLAFNKEDVKKHAEAMLGNHLVTAQTSAAGKQVNRLYIEDGADIEKELYLSILVDRATSNVAFVVSTEGGMDIEAVAHDTPEKILTVQIDPMAGVTPADAAKINSALNLSGSAAEDGLKLYPILYKAFVEKDMAMLEVNPLIVMKDGHLRVLDAKVSFDGNALFRHPDVAALKDETEQDAKELEAAEWDLAYIALDGTIGCMVNGAGLAMATMDIIKLYGEEPANFCDVGGGAGKEKVAAAFKIIMKDPNVKGILVNIFGGIMKCDVIAEGVIAAVKETNLAVPLVVRLEGTNVDLGKKIIRESGLNVIPADDLDDAAQKIVKAVRG

SEQ ID NO: 16244 - protein, 751 aa, Arabidopsis thaliana
MKRRRLFFSVLLSILTLFINGPLITTAQSPPSSSTSCNRICGGIEIPFPFGIGRRDCFLNDWYEVVCNSTTSGKSLAPFLYKINRELVSITLRSSIDSSYGVVHIKSPVTSSGCSQRPVKPLPLNLTGKGSPFFITDSNRLVSVGCDNRALITDIESQITGCESSCDGDKSRLDKICGGYTCCQAKIPADRPQVIGVDLESSGGNTTQGGNCKVAFLTNETYSPANVTEPEQFYTNGFTVIELGWYFDTSDSRLTNPVGCVNLTETGIYTSAPSCVCEYGNFSGFGYSNCYCNQIGYRGNPYLPGGCIDIDECEEGKGLSSCGELTCVNVPGSWRCELNGVGKIKPLFPGLVLGFPLLFLVLGIWGLIKFVKKRRKIIRKRMFFKRNGGLLLKQQLTTRGGNVQSSKIFSSKELEKATDNFNMNRVLGQGGQGTVYKGMLVDGRIVAVKRSKVLDEDKVEEFINEVGVLSQINHRNIVKLMGCCLETEVPILVYEHIPNGDLFKRLHHDSDDYTMTWDVRLRISVEIAGALAYLHSAASTPVYHRDVKTTNILLDEKYRAKVSDFGTSRSINVDQTHLTTLVAGTFGYLDPEYFQTSQFTDKSDVYSFGVVLVELITGEKPFSVMRPEENRGLVSHFNEAMKQNRVLDIVDSRIKEGCTLEQVLAVAKLARRCLSLKGKKRPNMREVSVELERIRSSPEDLELHIEEEDEEECAMEINMDDSWSVDMTAPASLFDLSPKLDVEPLVPQRTW

SEQ ID NO: 16245 - protein, 545 aa, Desulfovibrio desulfuricans G20
MKREELLDRLKADKEFDLLVVGGGATGCGVALDAATRGLDVALVERADFAEGTSSKSTKLVHGGVRYLEKAVLKLDKEQFDLVREGLKERGLLLKNAPHLAHPLRLITPVHTAREAGYMYAGLVMYDLLAGRLGLGRSRLVTRKKAQQLFPTLNLDGYKAAVIYYDGQFNDARMAVTLARTANLHGATCANHVEVTALVREHGKIRGAVVRDNLTGDEWTIRARGVVNATGPMADRLRHMDDTRLPDILKVSSGIHIMLDAGFTPPDLSLMIPRTEDGRVLFMIPWMGHVVFGTTDEPATPEYSPVPVEKDVEYLLEYARRYLNRPVDRSDVLSVWSGLRPLVFASGKSSTQELARTHVIEVSPGGLLTITGGKWTSYRRMAEDTVDRADSLFGFNLRRPCVTEKLKVLGSRGYVPGAHAELAREYAVSEELAAALYTTYGDEACAVLQVARETGFTEPLHPDHPYIGAEVVYQVRHEMASHVSDVLVRRLPLGLVNIAHAVEVAPVVAEIMGSELSWDPARCKEESDAAIAMLHSWHMPQGSEG

SEQ ID NO: 16246 - protein, 683 aa, Vitis vinifera
MESSREDLVSAVVPLLKLLSLTVIGLVLAHPKTQMIPRSTFKLLSKLVFALFLPCLIFTNLGQFITLENFTFWWFVPVNVLVSTLIGCFLGYLVVIICRPPAQFNRFTIIMTGLGNTGNLPLAIVGSVCHTANNPFGPDCYGKGVAYVSFAQWVAVILVYTFVYHMMEPPMNFYEIVDEGIEIGEPQLVNNISRPLLVEAEWPGIEDKETEHSKTPFIAGVFNSISNLTMSDLDLVGETGNTRSESIRCFAEPKVVRRMRVVAEQTPIKHILQPPTIASLLAIIVGMVPQFKSFVFGHDAPLSFITDSLEILAGAMVPSVMLVLGGMLAEGPNDSKLGLRTTIGISVARLLVLPLLGIGIVFLADKLNFLVHGDQMSIFVLLLQYTTPSAILLGAIASLRGYAVKEASALLFWQHVFALFSLSLYIKSAMETGIILSPSSPSPSLPHVILTQDELKKIAAYKAVEYVESGMVLGLGTGSTAKHAVDRIGELLRQGKLKNIVGIPTSKKTHEQAVSLGIPLSDLDSHPILDLAIDGADEVDPYLNLVKGRGGSLLREKMVEGACKKFIVIVDESKLVNHLGGSGLAMPVEIVPFCWKFTAQRLQMFFEESGCVAKLRTYENGEPFVTDNRNYVVDLYFKREIGDLKVASDAILRLAGVVEHGMFLGMATTLIVAGECGVVVKDK

SEQ ID NO: 16247 - protein, 748 aa, Salmonella enterica subsp. arizonae serovar 62:z4,z23:--
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIAPGWQDATMPLMEQVYEASTLDTSLERERLTGALEEAANEFRRYSKRFAAGAQKETAAIFDLYSHLLSDARLRRELFAEVDNGAVAEWAVKKIIEKFAEQFAALTDNYLKERAGDLRALGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSVLLPMVTSIDEVDEARRLIERAGREVEEMIGYAIPKPRIGIMLEVPSMVFMLPHLANRIDFISVGTNDLTQYILAVDRNNTRVASIYDSLHPAMLRALYMIAQEAEKNGIDLRLCGEMAGDPMCVAILIGLGYRHLSMNGRSVARMKYLLRHIDFADAQTLARRSLEAQMATEVRHQVAAFMERRGMGGLIRGGL

SEQ ID NO: 16248 - protein, 373 aa, Colwellia psychrerythraea 34H
MTIQSFFPPQRTLMGPGPSDVSPRVLSALARPTIGHLDPCFVAMMDEVKELLQYAFQTTNKFTMAVSAPGSAGMEACFVNLITPDDTVVVCVNGVFGMRMIENVNRIGAKLVVVEGEWGRAVDPQALEASLKENPQANFVAFVHAETSTGALSDAKTLCAIAKNHDCLTIVDAVTSLGGVELRVDEWQIDAVYSGSQKCLSCVPGLSPVSFSDRAAEVIQNRGIAVQSWFLDQSLVMGYWSGEGKRSYHHTAPVNSLYALHESLVMLQNEGLENSWARHKTMHDKLSTGLAELGLDFIVPADERLPQLNAVYIPEGIDDAKVRNFLLNEYNLEIGAGLGAFAGKAWRIGLMGYAARNENVTLCLAALKEALKQ

SEQ ID NO: 16249 - protein, 409 aa, Vitis vinifera
MLAEKKWLFTLFSAAFVSLLLFLSSISGFNASYALSFHKPFSSTVHHGLHYPPAFAYYISGGRGHKDRILRLLLAVYHPRNRYLLHLGADASDEERRLLASAVKSVPAIRAFGNVDVVGKPDRLTYMGSSNIAATLRAASILLRVDSGWNWFITLSSMDYPLITQDDLSHVFSSVRRDLNFIDHTSDLGWKESQRVHPIVVDPGIYLARRSQIFHATEKRPTPDGFKFFTGKVLLYVLCSPWVILNRSFLEFCILGWDNLPRTLLMYFTNVILSDEGYFHSVICNSPEFRNTTVNNDLRYVIWDSPPKMEPHFLNVSDYDQTVQSGAAFARQFQKDDPVLNMIDEKILKRGRNRVVPGAWCTGRKSWWMDPCSNWGDANVLRPGLQAKKLEESVTNLLEGSNSQSNQCK

SEQ ID NO: 16250 - protein, 564 aa, Lentisphaera araneosa HTCC2155
MPLKTSSFFFCFTFLFYGLIHADSSSYATRPVVKAKNGMLATSHPLATKIGLQIIKDGGNAIDAAIAANAALGLMEPTGGGIGGDLFAIVWSAKDKKLYGLNASGRSPQLLTWDYFREHNLNRVPYSGPLPVTVPGCVDGWFELHGKFGKLPMKEILAPAIKYCREGFELTPIIARHWSYGDDLIKQPNFASTFFPNGRSPKEGESFKNPDLGNTLEIIAQEGRDAFYKGSLAKRMDAFSKKHGHFLRYEDLASHKSLWVEPLKSNYRGYDIWELPPNTQGIAALQMLNILEKYELRSWGHNSAKTLHHMVEAKKLSYEDRTKYYADPQLSPAPLKGLISKEYADARRQLINSEKVSEHFEPGNPILQNGDTVYLSVGDKEGNMISFIQSNYAGFGSGVVPDGMGFSFQDRGALFNIRDKNHPNAYAPGKLPFHTIIPAFITKDGAPWLSFGLMGGAMQPQGHVQIVCNLIDFDMNLQEACDAPRFRHYGSSTSTGYKMSDSGTLRLEKGVSSESIEKLRSMGHDVRPNSRSGFGGFQGVIWDKENKTYIGASESRKDGHAEGY

SEQ ID NO: 16251 - protein, 422 aa, Oryza sativa Japonica Group
MSITSASRRAGAAALPILRRIGGAFRRPFSSEPDPASSPGYHVAGGPSFMRGAVFWEPGRPLTLEDFRMPRPKAGELLIKTKACGVCHSDLHVLKGELPFSSPCVVGHEITGEVVDHGTHTPAEIINRFPVGSHVVGAFIMPCGNCFYCVKGQEDLCESFFAYNRAKGTLYDGQTRLFLRSNGKPVYMYSMGGLAEYCVVPANALAVLPNSLPYTESAILGCAVFTAYGALRHAAEMRAGDSVAVIGVGGVGSSCLQIAKAFGASEVIAVDVLDEKLQNARTLGATHTVNAAKEDAVEKIKEITDGRGVDVAVEALGKALTFSQCAKSVRDGGKAVMIGLAATNVMGEVDITRLVRRQVKIIGSYGARARQDLPQIVKLAESGAFNLKNTISRKCKFEEANSAYEDLDRGKIVGRAVVEIMS

SEQ ID NO: 16252 - protein, 141 aa, Solibacter usitatus Ellin6076
MSRVRDVVHQCQLFSVEEHQSVAQVARVMAGFKVGAILVLKGDDLAGIFSERDLMTRIVLERRDPDLTPVRDVMTTDVCTIDESATPEEAMEAMQANNCRHLPVTRDGRVVAFLSMRDLMNFEVARQTEEIYHMRAYISNA

SEQ ID NO: 16253 - protein, 512 aa, Bacillus anthracis str. Ames
MKKQHDTIIVLDFGSQYNQLIARRIREFGVYSELHPHTITAEEIKAMNPKGIIFSGGPNSVYGEGALHCDEKIFDLGLPIFGICYGMQLMTQQFGGTVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 16254 - protein, 221 aa, Castanea sativa
DEARYFFQQLISGVCYCHSMQICHRNLKLENTLLDGSPAPRLKICDFGYSKSSLLHSRPKPTVGTPAYIAPEVLSRREYDGKMADVWSCGVTLYVMLVGAYPFEDPADPKNFRKTINRIMAVQYKIPDYVHISQECRHLLSRIFVASSLKEGITIKEIKSHPWFLKTLPRELTEPAQQCTTRKENPSFSLQEFRIYKNGEEAKFLPTSKRGGFGWGGKKKG

SEQ ID NO: 16255 - protein, 360 aa, Aspergillus nidulans FGSC A4
MAAARTLRIGLIPGDGIGREVIPAGRRILEALPASLNLKFNFVDLDAGYDCFKRTGTALPDKTVEVLKKECDGALFGAVSSPSTKVAGYSSPIVALRKKLDLFANVRPVKTTAGTSAGKPIDLVIVRENTEDLYVKEESTEETPNGKVARAIKQISERASSRIATIAGEIALRRQNIRDGAAASGLRTKPMVTITHKSNVLSQTDGLFRETARAALAAQKFSSVEVEEQIVDSMVYKLFRQPEYYDVIVAPNLYGDILSDGAAALVGSLGLVPSANVGDNFAIGEPCHGSAPDIEGKNIANPIATLRSVALMLEFLGEEQAAAKIYAAVDGNLDEGKYLSPDMGGKATTTEVLEDVLKRL

SEQ ID NO: 16256 - protein, 537 aa, Oryza sativa
  misc_feature (207)..(207): Xaa can be any naturally occurring amino acid
MALELSLVSASPPGGLAASPPPPAAIPGKEQQVAGVGILLQISMLVLSFVLGHVLRRHRFYYLPEASASLLIGLVVGGLANISNTETNTRMWFNFHDEFFFLFLLPPIIFQSGFSLSPKPFFANFGAIVTFAILGTFIASVVTGVLVYLGGLTFLMYKLPFVECLMFGALISATDPVTVLSIFQELGTDVNLYALVFGESVLNDACXMAISLYRTMSLVRSQAAAGENFFMMVFQFLETFVGSLSSGVGVGFISALLFKYAGLDIDNLQNLECCLFVLFPYFSYMLAEGLGLSGIVSILFTGMVMKHYTFSNLSNNSQRFVSAFFHLLSSLAETFVFIYMGFDIAMEEHSWSHVGFIFFSIIFIIIARAVNVFSCAYLVNMSRPEHRRIPLKHQKALWFSGLRGAMAFALALQSANELPGGHGKTIFTTTTAIVVLTVLLIGGSTGTMLEALDVIGDENRSIENYDDNNGYIPPTYEEGSSSGGGLRMKLKEFHKSTTSFTALDRNYLTPFFTSQTDEDDDVFGEQPQNQRRGFYDQ

SEQ ID NO: 16257 - protein, 308 aa, Geobacillus stearothermophilus
MARTVNSITELIGDTPAVKLNRIVDEDSADVYLKLEFMNPGSSVKDRIALAMIEAAEKEGKLKPGDTIIEPTSGNTGIGLAMVAAAKGYKAILVMPDTMSLERRNLLRAYGAELVLTPGSQGMRGAIEKAEELVREHGYFMPQQFKNEANPEIHRLTTGKEIVEQMGDQLDAFIAGVGTGGTITGAGQVLREKYPNIKIYAVEPADSPVLSGGKPGPHKIQGIGAGFVPDVLDTNIYDEVITVTTEEAFAAARRAAREEGILGGISSGAAIHAALKVAKQLGKGKKVLAIIPSNGERYLSTPLYQFED

SEQ ID NO: 16258 - protein, 176 aa, Cytophaga hutchinsonii ATCC 33406
MNPWHDVSFGDESPSIVQCIIEIPSGSKAKYELDKESGLLRLDRVLFSSVHYPANYGFIPRTYCDDKDPLDVLVISQVEVVPFCIVNAKVIGVMRMLDGGEKDDKIIAVAADDISVKHYNDISDLPPHTILEVQRFFEDYKKLENKKVVVEDFLGREEALRIVNESIELYNVTFKK

SEQ ID NO: 16259 - protein, 526 aa, Zymomonas mobilis subsp. mobilis ZM4
MSVSSIADKIVSESILIVDFGSQVTQLIARRVREAGVYSEIVPFNRAEEAFQRLQPKGIILSGSPASVVAEGSPRAPESFFQAGIPIFGICYGQQVMCHQLGGKVTANDVDGEFGRAFIDVIAPSPLFENLWKVGEKHQVWMSHADRVEALPEGFKPIAVSDGAPFALIADEKRRFYGMQFHPEVVHTPDGGKLIAHFVHDICGLAGDWTMAEFRQTKIAEIRKQVGDGRVICGLSGGVDSSVTAVLVHEAIGDQLTCVFVDHGLMRQGEAEQVVSLFREHYGIKLVHVNAEDRFLAGLKGVTDPETKRKFIGKTFIEIFEEEAKKIGGADFLAQGTLYPDVIESVSFLGGPSVTIKSHHNVGGLPERMNMKLVEPLRELFKDEVRDLGRELGMPDVFVDRHPFPGPGLAIRIPGEVTKERCDILRKADAVYLEEIRNAGLYNAIWQAFAVLLPVRTVGVMGDGRTYDSVCALRAVTSTDGMTAEIYPFQPEFLANVATRIVNEVRGINRVTYDFTSKPPGTIEWE

SEQ ID NO: 16260 - protein, 992 aa, Ostreococcus tauri
MSSARARSSSVGARSGACVRGRTTRDASGIRHRRAATRTGAVNQERRGEVTIDLEPRDGPAKEQFYSESFTVTQRMRVDNELSIRVETNGVRYKVTIMTEMESSNLLLHWGIAESKDRWDEWKCPPERLRPKSTQETVGVCQTRFSTLPADRFAKDKLVTVIEGEVKDEIYAINFVLYDKKLDQWLHDSQGGFWHVTLPQPPEPEIIKRTITLLEDFEEPYEVEEEYEVEDDEEETLEVSGGASVATAQGEVSAPIEETAVSRSTTSNDDAWRRLMTPPVEPKPFNANKDALDAIANDLLGKIKKHTKSSAPVEERPEVQEPKVDEPPPKRKLKKMKTLKRKVTKSVTKRKEVTREVEEKVPVQLVEGSWIFTIDRKENVQNERECQFTIGALVEKDRKGGGVRMRVEAEVPWEAVLHWGIVPRGARNDMWSLPPEEWRPQGTVVYKDKACETPMCKFDAPLMTTKPISFVELELGNAPTQVRFVLKEQGGGNRWVDLNGADFIIPMPEAFYDPPTPTLDRSPTMEEIVVAEAAAARAAEMNLDTLTEIEIEPVAFETPVQTPVQTPEEKISIEEDFVAAPARPQKSAVGNGREILLQGFNWESCKNGAWYQNVERLAPTIAQLGFSVIWLPPPTDSVSQEGYMPRDYYCLESRYGTKDELKACINALHENGVLVLGDAVLNHRCAHFQDDKGIWNRFGGKLAWDARAIVSDDPNFHGQGHRSDGDFFHAAPNVDHSQAFVKADLEDWMSWLMREVGYDGWRLDYVRGFWGGHVKDYMEATNPQFAVGEYWDALSYKYDNPEYNQDAHRQRIVNWLNATGGNASAFDVTTKGILHAVFERQEYWRLSDPQGKPPGVMGWWPSRSVTFIENHDTGSTQGHWRFPRGKELQGYCYILTHPGTPTVFWDHMFDNDWGHLHKPIEDMIRIRRQSGIHCRSEVKIVKCEQTMYAAVIDNNLLMKIGPGHFSADGNWELQLSGQDFAIWRKKGAASTR

SEQ ID NO: 16261 - protein, 207 aa, Burkholderia thailandensis E264
MASQAPRDFEAQALGLVPIVVETSGRGERSYDIYSRLLKERIVFMVGEVNDQTANLVVAQLLFLESENPDKDISLYINSPGGSVSAGMAIYDTMQFVKPDVSTLCMGLAASMGAFLLASGAKGKRYALPNARVMIHQPLGGARGQASDIEIQAREILYLKDRLNHLLAHHTGQDVERIARDTDRDNFMSSEDAKAYGLIDHVSTKRP

SEQ ID NO: 16262 - protein, 250 aa, Clostridium acetobutylicum
MIIIKNDTEIEYMRQAGKIVGETLNMLEKAAKPGVTTADLDRLAEDFIKKYNAIPSFKGYGGFPASICTSINEEVIHGIPSKHRVLHEGDIISVDCGAILNGYQGDAARTFAIGEISEEAAKLIKVTKESFFKGVEKAVIGNRLTDISHSIQEYVESFGYGVVRDYVGHGIGKEMHEDPEVPNYGRPGRGPKLVHGMVLAIEPMVDVGTYMVKTQSNDWTVVTQDGSLAAHYENTVAILDNGPEILTLCE

SEQ ID NO: 16263 - protein, 748 aa, Salmonella enterica subsp. enterica serovar Paratyphi B str.
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKNGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 16264 - protein, 470 aa, Burkholderia sp. 383
MGKQAIGVIGLAVMGRNLALNIESRGYAVSVYNRSREKTDELIAEFPGRNLVPTYTLEEFVASLETPRRILMMVKAGEATDATIASLKPLLEKGDVLIDGGNTHFTDTIRRNQELAQSGLHFIGTGVSGGEEGALRGPSIMPGGQRDAYDLVEPILKQIAAKAPSDGEPCVAYMGPDGAGHYVKMVHNGIEYGDMQLIAESYAVLKDVAGLTNDELGAVYTEWNQGELDSYLMEITSKIFGKKDEETGKHLVDVILDRAAQKGTGKWTSQNALDLGVPLPLITESVFARVLSSLKTERVAASKVLSGPAAAPFDGDRAAFVEAVRRALYLSKVISYAQGFAQLRTASEEYGWNLDLGTIAKIFRAGCIIRARFLQKITDAYAKDPALANLLLDPYFKDIAANYQASLRDVVVAAVKAGVPVPAFASAVAYFDSYRSERLPANLVQAQRDFFGAHTFERTDKPGSFHANWS

SEQ ID NO: 16265 - protein, 336 aa, Zea mays
  misc_feature (136)..(136): Xaa can be any naturally occurring amino acid
VGIWATAAASSLFRNGEASYSNSTHEGIKTIPVQRACEFTTNSVLCVCIVTWNMNSKMSAEDVAKLVSSDRKFDLLVVGLQEAPKPDVSRVLQEALAGTHVLLGQKSMQSLRMLLFGSRSSEKYIREMKVDKHAVXGGCGGIIGRKKGAVAMYINFSGIRMVFVSCHLAAHEHKVEKRNAEFQHISQSLFARYGAPTPYAQSADITVWLGDLNYRLQGISSTPARKMIEENRQSKLRGRDQLLQEAEKGQVFSGYCEGTLSFKPTYKYDVGGSVYDTSYKVRVPSWTGRILFKVGQSSGLDAVLSSYESLDCVRSSDHKPVKAHLCLKVRSDGDAD

SEQ ID NO: 16266 - protein, 475 aa, Ostreococcus tauri
MSERRIARGRDARARVVTRMDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTI

SEQ ID NO: 16267 - protein, 440 aa, Triticum aestivum
  misc_feature (202)..(202): Xaa can be any naturally occurring amino acid
  misc_feature (292)..(292): Xaa can be any naturally occurring amino acid
MGMEYEPVPLAAPAPKKPAAGGRAALKLLLALLLVGLAMRLLADRCASRLLPPTAPTEEAAALAVTAPPAQEEAGGGDGVPVTPSGAGRCDLFHGEWVHDSSGPAYTNATCRFIETPQNCMSNGRPDDGYLYWKWKPYGCEVPPFEGKTFLEDMRGKHWALVGDSILRNHVQSLLCLLSKVEDPTEVYHDKTYQSRRWHFPXYNFTLSLVWAPFLVKAEIFEDENGFSSAEPRLTFDVLDANWISQWTTFDYVIISTGQWFFKKAVYLEKGAVIGCHFCQDKSLREVSIDYXFRRALREAFRFITASAHRPVVFYRTWSPSHFEGGEWFSGGRCDRKAPFKPREAGDRALDNLMWRVERAEFAKAAADDGGSGEGRRLRLLDTFEMSLQRPDAHAGPYRAYQPFAKGADAGKVQNDCLHWCLPGPIEAWNDIIMQMLGED

SEQ ID NO: 16268 - protein, 465 aa, Desulfovibrio desulfuricans G20
MAPQFCTTPVPVPPVHTGYRHIATPLPVPESLALLEEMRACEPRSVDCQPPLVWHGAQGVQVYDPYGNIWLDFTSGVLVTNIGHCQPEMVQAARAELDAHRFFSYCFATEPRIRLARRLVDMLQPHIGTACKAFIMSTGSEATENALKLARAHGRSLHPEKNVIVSFDRAFHGRTLGAQQMGGYPAAKSWIGNLDPAFVQVPFPDGLHCTDTSFNLFSRRLAQLGIAPQRVAGVIMESYQGGGASFAPEEYVRELRSFCSRHEALLIMDEVQSGFGRTGRLFAFEHYGIAPDLVCLGKAVSGGLPVSAVAGRADVLDMHDPGSMTSTHGGNPVACASAAANLEVLLRDGLTEAAAATGHILRQGLEGLRQRHAGHIMAIHGRGMVQGIHVGRTEPDGTPCPDGALAFDVTERAFRKGLLLFAPVGTGGATIKICPPLIMQPDAVLEGIDVLTQCFDEALSAETDR

SEQ ID NO: 16269 - protein, 461 aa, Zea mays
MAPANVRAAQAQAQAPSADRRLSTLVGHLLPSSPRRAAADTSATSTLESFPTMASQGSSVFAALEQAPEDPILGVTVAYNKDPSPMKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLMEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCRSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 16270 - protein, 268 aa, Salmonella enterica subsp. arizonae serovar 62:z4,z23:--
MSVVISDAWRQRFGGTARLYGEKALQWFAEAHICVVGIGGVGSWAAEALARTGIGAITLIDMDDVCVTNTNRQIHALRDNVGLAKAEVMAERIRQINPECRVTVIDDFITPDNVAGYMSAGFTYVIDAIDSVRPKAALIAYCRRYKVPLVTTGGAGGQSDPTQIHVVDLAKTIQDPLAAKLRERLKHDFGVVKNSKGKLGVDCVFSTEALVYPQSDGSVCAMKATAEGPKRMDCASGFGAATMVTATFGFVAVSHALKKIMSKAARQG

SEQ ID NO: 16271 - protein, 425 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASFPRMGLI

SEQ ID NO: 16272 - protein, 447 aa, Solibacter usitatus Ellin6076
MKVSIIGLGKLGAPMAAVMAHKGNFVVGVDINPEFVKAIREGRPPVNEPQLAEMITANHERLTATESYEDAILATDLTFIIVPTPSGPDGRFSLDYVLKAVEKIGAAVRKKAAWHLVVLSSTVMPGSVDLHVLPALEKYSGLKCGVDFGLCYNPEFIALGSVVRDMLNPDMILIGEAEPRSGAMLEELYTGVCESNPRIQRMNYVNAELTKLSVNTFVTTKISYANMLAQICETLNGADADVVTSALGCDTRIGPKYLKGALGYGGPCFPRDNIAFSALARENGVPALLAEATDELNRRQVPRMAELLLSHLPAGGTVGMLGLSYKPHTEVIEESQGVAIAKELAARGARVVVYDPAAMDSTRRVLGDRIEYAATAAECAGQADVLAITTPWPEFKNLTPTDLKQGAKPAIVDCWRVLPRAAFEGASEYMTLGFGMSALALATAEGD

SEQ ID NO: 16273 - protein, 368 aa, Pseudomonas putida
MEMEIKAAIVRQKNGPFLLEHVALNEPAEDQVLVRLVATGLCHTDLVCRDQHYPVPLPMVFGHEGAGVVERVGSAVKKVQPGDHVVLTFYTCGSCDACLSGDPTSCANSFGPNFMGRSVTGECTIHDHQGAEVGASFFGQSSFATYALSYERNTVKVTKDVPLELLGPLGCGIQTGAGSVLNALNPPAGSAIAIFGAGAVGLSAVMAAVVAGCTTIIAVDVKENRLELASELGATHIINPAANDPIEAIKEIFADGVPYVLETSGLPAVLTQAILSSAIGGEIGIVGAPPMGATVPVDINFLLFNRKLRGIVEGQSISDIFIPRLVELYRQGKFPFDKLIKFYPFDEINRAAEDSEKGVTLKPVLRIG

SEQ ID NO: 16274 - protein, 430 aa, Nocardia farcinica IFM 10152
MRTSTPGSPTSTRPSNASPVDASFASVPALFPALADPAHTYLDSAATTQKPVPVIDTVTRYHRERTANAGRGSYPWSTALAGRITEIRARTAAFLGAGHTDEIVFTPGATAALNAVALCWGLAVLDDGDEILYSPADHASNVLPWHHLRGLLGRAGRRIDLVPYATTRRGTADIDDILARASPRTRLVTVAHLHHVYGGRTDVAALRAGLDRRVALCVDASQSAGHLPLDVTALGADFTVLAAHKMFGAPGLGVLYCGRRVHDSLLPFLPGGNSGVRVGDSGLESTGMPHLLEGGTPDIPAVLALGSALDVLESLGRDRIAAHNHLLTRRLIDGLRTVPGLDFLPGPAHGPETDGDGIVSFTLDGIAAADLGFVLAEHGFLVRTGSHCVPAAHHAAPHRDSVRVSTHVYTTVEQIDRFVRCVATIAEEVT

SEQ ID NO: 16275 - protein, 521 aa, Bdellovibrio bacteriovorus HD100
MTRIIKLQHTEIAGCIFVDKIAGLNTHTPEYGQRGCVEIYEEELDRKLYTVHRLDKATSGALVFATSSEIAAQLTQAFEQHKVEKKYLFLTDKKIARTEFTYESFIQKEKNVFVSRDTQEPNSKTSFKWVKALGPYQLWEAVPHTGKPHQIRLHAEANGIAVLGDSDHNGTNHFRLCLHSQVLGFELNGQKVRYETPLPGWAEDDFTADPEEQILTEAFQRRERMYKFSTLTDECLRLAHRELDTYRIDQYGEYLWVYWYKESDPTVQDLLRFEKIAKKYHKKILVRKMLNRGEDPNAEVLWHIGNTASRWQAKENGVIYDLRSDTGLSPGLFLDQRENRLWVKNHAEGRSVLNLFSYTSGFSVVSALAGAREVCTVDVSQNFIEWSKHNFTINGLDPEAENHEFWVQDCILFLKGTIRRKRKFGMIVCDPPSFGRSKNGVFSISKNFDELLINCMYCLQKDGLLLFCTNYEKWTTGDLHLRLNKLKKDFSFKILPAPAQGLDFELPDQEPLMKSIILRKN

SEQ ID NO: 16276 - protein, 144 aa, Nocardia farcinica IFM 10152
MRIAEILRRKGCEVATVTPGTTVRALLAVLAEHNIGAVVVSPGGGRISGIVSERDVVRGLHEYGAGLLDTPVSDIMTTPVRTCAPEDRVDGLRRIMTEHRVRHLPVVRDDRLVGIVSIGDVVKSAISELATERQLLVDYVQGRY

SEQ ID NO: 16277 - protein, 457 aa, Mesorhizobium sp. BNC1
MLYHRAKNSWEQRDQENVFHGFTDLETLNQNGPVVLTHGEGIHVFDVHGKSYMDANSGLWNNVAGFNHKGLIEAICDQARRFPGYHAFFGRIADTTVALSEKLIEISPFPSGRVYYTNSGSEANDTVVKMLWLLHRRNGQPQRRKIITRVNAYHGVTVATASMTGKTYNAEFGLPLPGFLHADCPHHWRYGEPGESEAAFSQRLARKLEELIIKEGPDTIAGMFAEPVQGAGGVIPPSRGYFEAIRPILRKYGIPLIADEVITGFGRTGEMWGGDKYNVEPDAIVASKCITAGYFPMGAIILGPELADALTRACEAAEEFPHGFTSGGNPLGSAIALKALEVIETEGLLDNVRRVSPRFLAGLDRLARHDHAGEARGVGLMGAVELVADKNSKAPLDGALRIPERIANKALEKGLICRPLGQAIVLGPPFIITEGQIGEIFDILEDTMAEVFADVGL

SEQ ID NO: 16278 - protein, 526 aa, Aspergillus nidulans FGSC A4
MAASSSLDHLSNRMKLEWHSKLNTEMVPAKNFRRTSIICTIGPKTNSVEKINALRRAGLNVVRMNFSHGSYEYHQSVIDHAREAEKQQAGRPVAIALDTKGPEIRTGNTVGDKDIPIKAGHEMNISTDEQYATASDDQNMYVDYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTSGNTARMISKYRPVCPIIMVSRNPAATRYSHLYRGVWPFYFPEKKPDFNVKIWQEDVDRRLKWGINHGLKLGIINKGDNIVCVQGWRGGMGHTNTVRVVPAEENLGLSE

SEQ ID NO: 16279 - protein, 594 aa, Emericella nidulans
MGFLRRRSMMQALLLTIIFSAYAYGAKVKQQGKWFFPINLTWSDISLWDSRKMILANGQFPAPALRLKQGDDVEFLVNNEMPFSTTVHFHGTPWSDGVPGLSQRPIPPGESFLYKWRATNYGSYFYHAHSRGQQEDGLYGAIHILADDSIERPFALISEDEQEIQSMRRAESESIPIMLSDVRSLTSAEIWDAEKAMGRDALCANALLVNGKGSVTCLGQQTIDEYTSVAQRGVLGNQSLTDIGCLPPDNLLAQGPWSHNLSAIPPTVFSDCIPSHGLTERFYPDATNRYASFDLVSAALVSTITFSIDEHPMYVYAIDGSYINPIEADGITITNGARYSVLVKLDKPRGDYTIRVVNTGLNQILHGNALMTYHNGIGPIQQHPSTPSIDLVGTPTSNHTLLNESMIIPFAAQDVSRVDVAQTLTLTLERYNASYTWTMGDSSFPLQLEEESPLLFYPQTASKNFTATSKNGTWVDVVFDVANAIQPPHPIHKHSNKFYVLGGGNGKWNYTSVAEAAKHMPESFNFETPQIRDTFATLPAATGPTWLALRYHVVNPGPFLLHCHIQIHQSGGMALALLDGIDEWPEIPEEYQLA

SEQ ID NO: 16280 - protein, 312 aa, Streptococcus thermophilus CNRZ1066
MDSLVSFSKWLSKWFTAAVILWAVFNYAFPATSSWVIPNTAYLLGLILFGMGLTLTTEDFKRIAKRPIPVILGTVAHYVIMPGLAWLLCIIFHLKGATAAGVILVGSCPSGTSSSVMAFLSGGDVALDVSIETLSTLLAPLMIPMLLSFLADQYVSVPAQNLFLSTLRIVVVPIILGVVIHSIFGKKIDAIIKIMPLISQVAILLIVGAVVSANHANIFTAATALVIPVVMLHNLCGYVLGFGFSKLLGLEEPQQKAITFEVGMQDSSLGATLAMKYFVPQAAIPSTIFSIWHNISGSILSSWWKNHSKKSH

SEQ ID NO: 16281 - protein, 116 aa, Oryza sativa
  misc_feature (28)..(28): Xaa can be any naturally occurring amino acid
  misc_feature (74)..(74): Xaa can be any naturally occurring amino acid
CAVCGRRTSTTYSTNIVSTVNLGCTLEXKKIALYARNAEYNPERFAAVIMRIRSPRTTALIFSSGKMVCTGAKXEDDSRLPGRKYPRFIQKLGFPASSWDFKNQNLLGHIKPWALC

SEQ ID NO: 16282 - protein, 78 aa, Zymomonas mobilis subsp. mobilis ZM4
MSDTAERIKKIVVEHLGVEPDKVVENASFLDDLGADSLDIIELVMAFEEEFGVEIPDDSVEKIGTVKDAVSYIDEHKA

SEQ ID NO: 16283 - protein, 443 aa, Brachypodium sylvaticum
MLIYRSFRPAAASNSSTSAFSVMHRHGPCSPLQTPDDAPSDADLLEHDQARVDSIHRMIANETAVVGQDVSLPAERGISVGTGNYVVSVGLGTPARDLTVVFDTGSDLSWVQCGPCSSGGCYHQQDPLFAPSSSSTFSAVRCGEPECPRARQSCSSSPGDDRCPYEVVYGDKSRTVGHLGNDTLTLGTTPSTNASENNSNKLPGFVFGCGENNTGLFGKADGLFGLGRGKVSLSSQAAGKYGEGFSYCLPSSSSNAHGYLSLGTPAPAPAHARFTPMLNRSNTPSFYYVKLVGIRVAGRAIKVSSRPALWPAGLIVDSGTVITRLAPRAYSALRTAFLSAMGKYGYKRAPRLSILDTCYDFTAHANATVSIPAVALVFAGGATISVDFSGVLYVAKVAQACLAFAPNGNGRSAGILGNTQQRTVAVVYDVGRQKIGFAAKGCS

SEQ ID NO: 16284 - protein, 586 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 16285 - protein, 330 aa, Bacillus licheniformis ATCC 14580
MKAIIHEGIKGLSGLKYTDVSDKTPGPGEVKIRLKAAGLNHRDLFLFQSRKAGDAPFIPGSDGAGMIEETGEGVRDLAVHTEVIINPSIGWEYTDSVPQVPDILGGPSDGTFAEHVIVPAKHVLKKPAHLSWEEAGVLPLSALTAYRALFTKGHLEKGEHILIPGAGGGVATNALLMAKAAGARVIVTSRSEEKRKEALRYGADFAIDSRGLWKESLDGERVDLILDSIGPATFANYFDVIKPNGRIVIFGASSGESIQLPLRSLFFPQISIIGTSMGSLEEFRQMIDFIERHSLKPVIDQVFPLSEAVPAFKRMKDGEQFGNIALQIDG

SEQ ID NO: 16286 - protein, 634 aa, Brachypodium sylvaticum
MARFAAATLLFQAAVMAVTPHSSSTPPSMPGCPSSCGDVTIPYPFGVGAGCHLAGFGLTCDVATLLGPPKLRLVVTGCNVQAVLLDEISRRVVAACTAICSARTTVAHDDDSCAGAGCCQASIDTGLASYGIRLSSFGDATPNSSLDESASVFITDSAWFRENAGKLLDDGDKPPAVLDWGIGNSGASHGGYSCRCQHGYAGNPYVADGCQDIDECALPEEYPCYGECMNRPGSFLCLCPGGTQGDARTEGGCGIAFPSLYVIALTMAYLIKARRVKKLKELFFKQNRGLLLHQLVDKVIAERMVFTLEELETATNQFDQRRKLGSGGHGTVYKGFLPNRHVVAIKKSNITVQKEIDDFINEVVILSQINHRGVVRLFGCCLETRVPLLVYEFISNGTLSDHLHVEGPESLPWTDRLRIALEAASALAYLHSSASVSIIHRDVKSANILLDDRLTVKVSDFGASRGIPIDKKGVTTAIEGTFGYLDPEYYQTSRLTDKSDVYSFCVVLVEMLTRKKPTVFTSTENASLIALFNLRMMQGKLYQILDPQLISEGMETAEEFAALASACLSLKGGERPTMRQVEMRLERLLGPNLVIEVEQGCSTEVQCTLTQMSNGNSRQYSMEQEFLSSATFPR

SEQ ID NO: 16287 - protein, 401 aa, Salmonella enterica subsp. arizonae serovar 62:z4,z23:--
MNAFNPTQFRAQFPALTDAGVYLDSAATALKPQAVIDATHQFYRLSAGNVHRSQFAQAQRLTAQYEAARAEAARLLNTPDEKSIVWTRGTTEAINMVAQCYARPRLRPGDEIIVSVAEHHANLVPWLMVAQQTGAHIIKLPLNDRRLPDVECLPDLITPRSRILALGQMSNVTGGCPDIARAISAAHAAGMVVMVDGAQGAVHFPADVQQLEIDFYAFSGHKLYGPTGIGVLYGKPELLEAMSPWLGGGKMIRDVSFEGFTTQSAPWKLEAGTPNVAGVIGLSAALEWLSDVDIEQAENWSRELATLAEDALAKRPGFRSFRCQDSSLLAFDFVGVHHGDMVTLLAEYGIALRAGQHCAQPLLAELGVTGTLRASFAPYNTRHDVDALVNAVDRALELLVD

SEQ ID NO: 16288 - protein, 638 aa, Prosthecochloris aestuarii DSM 271
MPAACDASAACCVFEHSDPYTMSYQVIARKYRPSKFADITAQEHITHTIQNALRLDRVGHGYIFSGLRGVGKTTAARVFAKAVNCQKMIDDPVYRQEVTEPCGECESCLDFDAGTSLNISEFDAASNNSVDDIRQLRENVRYGPQKGRYRVYIIDEVHMLSTAAFNAFLKTLEEPPSHAIFIFATTELHKIPATISSRCQRFNFKRIPIGEIQSQLQMICRAETLQISDDALLLIARKAQGSMRDAQSILDQVIAFSVGNDAEKVIAYQGVAELLNYIDDDQFFDVSDAVAENDPVKMLQVARFVIDNGYDEQDFLEKLIEHFRNFLVLYNLRSTRLIERTESVKERYQQSAGGLSAPLVMQLIDLLMKESGELKFQFEYQFRFELTLLRLIELVHNDGGVAASVAGGPPVKKKAPEPDLKQPDRHPGPAGRSAPGARPAELPSPASTPEQQPPSARSASLPPSPQQSAPRNVASGKPGVDFSAWQGKLMNFTRNGSRKQPVQASSSDARQSGVFEGVVEVEKFRMEWNQFLEMLLKKRQKVLVTHLRSCELTSCSHGVLVMTCGKKFSYEELMQDAALLSKEIESFYGIAVKLQICYDAARDAQTREQTIFTLFRDLAETNDVMKYIIKEFGGELVY

SEQ ID NO: 16289 - protein, 555 aa, Bacillus licheniformis ATCC 14580
MESLFSSRKRDDILQNMTKQKYDVFIIGGGITGAGTALDAASRGMKTALCEMQDFAAGTSSRSTKLVHGGLRYLKQFEVKMVAEVGKERAIVYENGPHVTTPEWMLLPMHKGGTFGKFSTSIGLRVYDFLAGVKKAERRSMLTAEETLQKEPLVKKNGLKGGGYYVEYRTDDARLTIEVMKEAVKFGAEAVNYAKVSDFIYENGKVTGVVIEDVFTKKTYRVYAKKIVNAAGPWVDRLREKDHSKEGKHLQHTKGVHLVFDQSVFPLKQAVYFDTPDGRMVFAIPRDGKAYVGTTDTVYNENLEHPRMTTADRDYVINAINYMFPELGIKAEDVESSWAGLRPLIHEEGKDPSEISRKDEIWTSESGLITIAGGKLTGYRKMAEHIVDLVRDRLKEEGDRDFGPCRTKTMPISGGHIGGSKNLEAFIQAKAAEGIEAGLSEETAKQIAARYGSNADRLFDRIPSLKDEAAKRRIPVHVLAEMDYGIEEEMAAVPADFFVRRTGALFFDINWVRTYKESLTDYMSEKLNWDGETKARHVKALEGLLHDAVVPLESK

SEQ ID NO: 16290 - protein, 168 aa, Triticum aestivum
MSAKAGKPLVQTDAGAYIAWSGADQPELATEGLGCGLLVLRPLGFALPHYADSNKFGYVLGGSGVAGVLPVDAKERVVRLKAGDVIAVRTGDVSWWYNDNDGHADDLSILFIGDTARAVSPGDISYFFLAGGNSVLSGFDAGLLTMAWPGVTEEQAATAFRSQPAVLL

SEQ ID NO: 16291 - protein, 293 aa, Neptuniibacter caesariensis
MEIRQQLKHYQSRVDNHLENCLPSESIDPLLQESMRYSLFNGGKRVRPALVYLVNQILGGTDEAADNAAAAIECIHSYSLVHDDLPAMDDDDLRRGKPTCHIAYDEATAILAGDALQCLAFELLANDQQQSADSKIKLIQLLSQASGHGGMVVGQSFDLRHVGKPLTLEQLEAMHQHKTGALLLCAVHMGAACGPRVSKEQLDALTRYALAIGLAFQVQDDILDIEGDSETIGKPQGSDLELNKPTYPALLGLEGAKLKLTKLHHEAIEALTIFNENAEPLRALADFIVRRDH

SEQ ID NO: 16292 - protein, 590 aa, Neptuniibacter caesariensis
MFHSIPTQRPATPLLDQVNDPASLRTLKHNQLEELASQLRAYLLYSVGQSGGHFGAGLGVIELTIALHYLLNTPKDNLVWDVGHQCYPHKILTERREAMPKIRQGDGPSPFPKREESPFDSFGVGHSSTSISAALGMAIADKLQGIESKTVAVIGDGAMTAGMAFEALNHAAHTDTNLLVILNDNDMSISHNEGGLATYLAKNLKNRSAGETTAALFEALDFEYTGPVDGHDFNQLLPTLEKVLNTPGPQFLHLITTKGKGFQPAEDDPVGYHAITKIEPISQPKEKKIRYSNVFGRWVCDMAETDNRLTAITPAMREGSDLIEFSSRFPQRYFDVAIAEQHAVTLGAGMACQKLKPVVAIYSTFLQRGYDQVVHDVAIQKLDMLLAIDRAGLVGEDGATHAGCFDIAMLRCLPNTIIMTPSSAEEQRNMLYTGYKYPGLAAVRYPRGSVSELANGEMSKLPLGQSKTILEGSRVAVLNFGPLLHEAEHVAKREGYTLIDMRFVKPLDTQAIALIAASHQLIVTLEDHSIIGGAGSAVSEYLHTEKIKTPLLSLGIPDRWISHASRQEQLKECGLDSEGIAQAIAESLNR

SEQ ID NO: 16293 - protein, 263 aa, Mycobacterium smegmatis str. MC2 155
MPDARALGAAQLWIGTSWKMNKGLAESRGYARELAEYVAAKPPAGVQPFIIPSFTALTTVRDALGDDSPVLLGVQNAHWEDHGAWTGEVSVAQAKDAGAQIVEIGHSERREHFGETVETTRLKVAAALHHGLVPLLCIGESAENKQAGESSRFILEQAAGALEGLTDEHLARVLIAYEPIWAIGENGRPATVEELRQPFDDLAREYGCRTMGLLYGGSVNTDNAEDLLGIDHVTGLFIGRAAWQLPGYVRILEMAAAHPKAKA

SEQ ID NO: 16294 - protein, 544 aa, Mycobacterium smegmatis str. MC2 155
MVPGVRYAPVIRPGRLPVIELPDTEVAEPDRAAEAGRFRAAATAVTERLRARADRATGAAAEVLGATATLAQDRAWLGAADKRIAAGAPAVRAVSEAVDQFIDMFTKMGGLMAERVTDLRDIRDRVVAELSGYPEPGVPLPELPSILCATDLAPADTAGLDPELVVGLATTLGGPTSHTAIIARQLGIPCVVAVSGLDDIEAGRMVLLDGTAGTVTADPDPSEAATAVDAARRSAATARNWHGPGATGDGHAVAIMANVADGAAARAARETPAEGIGLFRTELCFLNRDTEPTVAEQAAIYGEVLDAFSGAKVVIRTLDAGSDKPLKFAGHPPEEANPALGVRGIRIAEANPGLLEHQLDAIADAAENTRSAPWVMAPMIATPDEAKRFAAQVRSRGLTPGVMVEVPAAALLAEQILDHVDFLSIGTNDLAQYTMAADRMSAELAALTDPWQPAVLALVGTAARAGAAADKPVGVCGEAAADPLLACVLVGLGVTSLSAAAAAIPSVGAKLATVTVQQCREAARAVLATAGPAEARAAALGILT

SEQ ID NO: 16295 - protein, 211 aa, Mesorhizobium sp. BNC1
MGGIETLEVDAVLVAIGRRPHTAGLGLEALGVRQDAKGFVEIDAQFRASVPGIHAIGDAVPGPMLAHKAEEHAIACIDALAGRPNGAPDYGLVPGVIYTAPEIAGVGLSEDDASATGRAVLVGKSSFLANGRARAIGATNDFAKVIACAETGKLLGAHILGHGAGELLQELVLALRLGVSLGDVAGTSHAHPGMGEAVKEACLAALSSTTT

SEQ ID NO: 16296 - protein, 1170 aa, Chlamydomonas reinhardtii
MALQRLLIATACCVIPIALWLFLRCRSGFSLYVYPPARGTPVTCSFGSDSPLSSLDADEVRLYGACFLHTLLNSSGLPLVSRPQDACVLVPSLDANCAFNTCDETKLTQLGAALAALPHWDGGRNHLVFNYNNDWEHARFSVGQAIVARASWVKNTYRRGFDIQLPLTRPKITPPDVWVLAWGEELLQADRRAGAGGSSSGSSILSPWQKLELPQPPAAGTDASSASAAGNASQGVGAQPRRWLQGMVEAPDAAAGAWGEDTEALGGRLWSWDSKLLPAAQQPQHGAQVLQPQLQLEPRRRLQAASAAVRQRNEARVSSPHARHLSWWFWPWDRKSTGGRSGGDTVRGGASFNDTHLTGPLRHDLLLYFNGCLLPRCCTAAWPDVGFQEGMRRAQFALSPRGCGSQSYRLLEGAGLGTVPVHVGDSTVLPFDGEAGLGRLWAACVVDVKLEEVKKGQLLPRLRRLEEEGGGEGWEVRVVALQAVCTLALRVEAQFAAGAGAAPPAFWNVGNVHTGAECKGRFRGNCWGWGDGRFHENYTRLTLTSYGASCKVLTAYHRVTNKKVAVKTIPKSRKQLEKQRAKVKLEIGTFRLVEDHPNAVRVLEVFEGAECYYICMECCEGGELFDHISKKQASFTERQAAHLLRGLMLFLAHMHGKGIAHLDIKPENIMFDSEGANGVLKVLDFGSSAFVQPNETVRNAFGTVRYASPEMANDVCGQKADIWSVGVVMYILLSGRAPFLKSNDVDTLNLIKSGPRVKFAGERWAGISQAAKDCIKALLEPNPRLRPSAVTVLNMPWLKQQSRIRRLLLGLMADQLVGSGANQLLGQFYTLDKDFSGTLEVSELVKAAKEAIPDLSEHEINRMFEALDVDRTGTVDIKEFFAGLIQTIDEEKQTLVAQKSFTMLDKRGAGFVTKEAFMEVLLERAQAGTLKTLAPKAEQTGRPGPQSMDGSVASSHAPVTHGRTSGADGGEARVLLDPGLVSELEQEFANLDANGDGVLSFEEFKAILGIQSTPEGLQLTHGIAGMDRAAIDLEQPLDMETRDLLQLLAPAKRTPSSAAYGTTRGASGGLGGGGGEPGSARTPSVRDIHSQTVAALLQRAASINASHGASMTAASVAALNKQPSVLAGLGGSGAVGYGASPSQSPRTSQHRLRLHHPTPPPPCRQRIGLA

SEQ ID NO: 16297 - protein, 232 aa, Legionella pneumophila str. Paris
MIEFQPKKLYYSYKIFNENIMTKQAIIIGISGPSASGKSLLANTIVNELGSEQVVVISEDAYYKDNGHLPFAEREKINYDHPDSFDHALLYEHLRQLRVGNTVQIPIYSHSKHLRLPETRAVGQHAIIVLEGILLFSDKALREIMDIRIFMSTPLDVCLTRRLKRDVVERHRSFESVIHQYETTVRPMYMQFIEPSSRYADIIVPRGGENRIAIEMIQAKMRELLASHTRGS

SEQ ID NO: 16298 - protein, 189 aa, Zea mays
MTGVSTGLLTGLRRVREQQRISTAFCRQSRVSSSTVSFSDLDEKGDMEYDDNSPNSKRELRPQGVDPNKGWEFRGVHRAIICGKVGQVPVQKILRNGHTVTVFTVGTGGMFDQRVIGPKDLPKPAQWHRIAVHNDYLSAYAVQKLVKNGNDQVKNIPEICVRRDGKIQLVKSGDSAANISLDELREGLF

SEQ ID NO: 16299 - protein, 462 aa, Mesorhizobium sp. BNC1
MSDFDLIVIGAGPGGYVAALRAAQAGMRVACIDERATAGGTCLNVGCIPSKALLSSTEHWAGLKSLADHGIETEAARVDLSRMMARKDKVVSDLTKSIAFLFNKAGVEFIHGRASIAAPGRVTVGVREISSQHILIATGSAPAVLPNVPFDEKLVLSSTGALSLAKVPDRLVVVGAGVIGLEIGQIWSRLGAKVTVVEYLDRILPGMDGETAKNAQRIFARQGIGFMLNAAVEAVVDNGETAEIKIKSRASGKVEKLQADAVLVAIGRKPHTGGLGLEALRVRRDARGFIEVDEQFRTSVPGILAIGDVVPGPMLAHKAEEDAVACIDALAGKPHCAPDYGLVPGVVYTTPEIAGVGLTEDDASAAGRAVLIGKASFLANGRARAIGTTDGFAKVIACAETGKLLGAHILGHGAGELLQELVLALRFGASLNDVAGTSHAHPGMGEAVKEACLSVLDARSLD

SEQ ID NO: 16300 - protein, 340 aa, Streptococcus thermophilus CNRZ1066
MRNIPKSVTLKAWRCKYLVKGVLKMSNPNNHVIYLAGGCFWGVEEYFSRVPGVLDAVSGYANGSSETTRYELISQTGHAETVQVTYDAGKVTLREILLHFFRIINPLSKNKQGNDVGTQYRTGVYYTDVNDLPIIEKVFQEMSEQYGQPLAVELLPLQHFIPAEEYHQDYLKKNPNGYCHINVNQAVNPVIDSSSYHKPSQEELKVSLSPEAYAVTQENRTERAFTSPLWNHFEPGIYVDVVTGEPLFSSRDKFYSACGWPSFSRPISPEVANYKEDHSHNMDRIEVRSRVGDSHLGHVFPDGPSDKGGLRYCINGVATRFVPKADMEKEGYAYLLDQVD

SEQ ID NO: 16301 - protein, 362 aa, Geobacter metallireducens GS-15
MSQVFKVAVLPGDGIGPEVMAEALRVLDAIEKKYDVKFERTHANVGGAGIDLEGKALPETTITICKTSDAILFGSVGGPKWETLPPDEQPERGALLPLRKIFGLYANLRPAIIFPSLTGASSLKEEVIAGGFNVLVIRELTGGIYFAQPKGIEGEGRDRVGFDTMRYSVPEIERITHVAFQAARKRGKKVCSIDKANVLSSSVLWREVVTGIAKEYPDVELSHMYVDNAAMQLVRWPKQFDVILCENMFGDILSDEAAMLTGSLGMLPSASLAEGTFGMYEPSGGSAPDIAGQGIANPIAQILSMGMMLRFSFGMVDAADAIDNAVAKVLDQGCRTRDIFQEKPGEKLVNTKEMGDAIIVAL

SEQ ID NO: 16302 - protein, 447 aa, Bacteroides thetaiotaomicron VPI-5482
MNFDIAIIGGGPAGYTAAERAGANGLRAVLFEKKAIGGVCLNEGCIPTKTLLYSAKILDSIKSASKYGISAESPSFDLTKIMSRKEKTVKMLTGGVKMTVNSYGVTIVEKEAFIEGEENGLIRIICDGERYEVKYLLVCTGSDTVIPPIPGLSEVSYWTSKEALEIKELPETLVVIGGGVIGMEFASFFNSMGVKVHVVEMMPEILGVMDKETSSMLRMEYAKRGVTFYLNTKVIEVKPDGVVIEKDGKASTIKTEKILLSVGRKANITNVGLDKLNIELHRNGVKVDEYLQTSHPGVYACGDITGYSLLAHTAIREAEVAINHILGVEDRMNYNSVPGVVYTNPEVAGVGKTEEELTKQGIPYRVTKLPMAYSGRFVAENEQVNGICKLILDEADHIIGCHMLGNPASELIVIAGIAIQKGYTVEEFQKNVFPHPTVGEIYHEVLS

SEQ ID NO: 16303 - protein, 300 aa, Glycine max
MRNLAAPHSLGVFIFRPNKPPFLTLPSLSRRSLPSIQCGAVQFRPCIDIHKGKVKQIVGSTLQDLKGSDPVTNFESDKSAAEYATLYKQDGLTGGHVIMLGADPLSKAAALQALHAYPGGLQVGGGINSDNCLSYIEEGASHVIVTSYVFNNGQMDIGRLKDLVQIVGKERLVLDLSCRKKDGKYAIVTDRWQKFSDVFVDPDVMEFLANFADEFLVHGVDVEGKKLGIDEELVALLGKYSTIPVTYAGGVTEMADLERIRTAGMERVNVTVGSALDIFGGNLAYEDVVAWHAQQNASVV

SEQ ID NO: 16304 - protein, 228 aa, Erythrobacter sp. NAP1
MPKLILVRHGQSQWNLENRFTGWWDVDLTEKGVAEAKAAGTLMKEKGVLPTTCFTSFQTRAIKTLNLALEEMGRLWLPVTKDWRLNERHYGGLTGLNKQETRDKHGDEQVHIWRRSFDTPPPPMEPGSEYDPGADPRYEGIDVPYTESLKLTIERVLPYWESDILPVLSSGETVIISAHGNSLRALVKHLSNISDEDITGLEIPTGQPIVYEFDDTMTPGERYYLKDS

SEQ ID NO: 16305 - protein, 323 aa, Vitis vinifera
MEEKCAIAKDVTELIGNTPMVYLNNVVDGCVARIAAKLEVMEPYSSVKDRIGYSMISDAEEKGLITPGKTVLIEVTSGNTGIGLAFIAAAKGYKLIFVMPSVATLEKKMVLLAFGAELHLIDMAKGVQALFDKADEILQNTPNGYFLNQFENPANPKIHYETTGPEIWKGTGGKVDILVAGIGTGGTITGAGQFLKEKNPEIKVYGVEPAESAVLNGGKPGSHQIQGIGAGIIPKILDTELLDEVIQISSDEAIETARLLALKEGLLVGISSGGGAAAAIKLAKRPEYAGNLITVIFPSFGERYLSSVLFDSIRVEAENMNFD

SEQ ID NO: 16306 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 16307 - protein, 515 aa, Ostreococcus tauri
MEAALASRERARAKIVRKNQNDESSMKRAQGDAVSTLAKSRLPLDERNTVAAPKLKKITEMAPQTPFASPLSRPLPSTPCGNGRELILQGFNWESCQHAEKMGASWYAHLTEMTPQIAEAGFTSVWLPPPTKSVSKQGYLPTDLYNLNSFYGSEDELRSCVARLREYNITPVADIVINHRCAEAKDDAGRWNKYTGKLDWDERAITCENPAFGGRGAHKTGEDYLPAPNIDHTQEFVRRDLTQWLEWLRSDVGFRGWRFDFVKGYSGAFTGEYVEATRPFLAFGEFWDECGYRDGVLDYNQDAHRQRTCNWVDSTTGNTAAFDFTTKGILQEAVSRTEYWRLIDNKGRPPGFLGIWPSRAVTFIENHDTGSTLQHWPFPWDKVLQGYCYILTHPGTPTVFFDHWVDPVFKPSIDAMLEVRKRNRLSSKDAAIHIERATAGVYAAHVGHAKEAYTEGLCTDVDVTQPSICMKIGHEAWSPNAQKVGNLSWQCTASGDGWAVWEDKAHLVDAEKMTR

SEQ ID NO: 16308 - protein, 1128 aa, Brachypodium sylvaticum
MPPRPRAVALAPPRRLALLVSSAFAALLLIVSPCHCVNEQGQALLEWKRSLRPAGGALDSWKATDAAPCRWFGVSCDARGDVVSLSVTGVDLRGPLPASLPATLATLVLSGTNLTGPIPPELGAYSELTTVDLSKNQLTGAIPPELCRLSKLETLALNTNSLRGAIPDDLGDLASLTHLTLYDNELSGTIPGSIGKLKQLQVIRAGGNVALKGPLPSEIGGCTNLTMLGLAETGMSGSLPETIGRLEKLQTLAIYTTLLSGRIPESIGNCTELANIYLYQNSLSGPIPPQLGRLRKLQTLLLWQNQLVGAIPPEIGQCEELTLMDLSLNSLSGSIPASFGRLKNLQQLQLSTNRLTGAIPPELSNCTSLTDIEVDNNALSGDIRLDFPKLPSLTLFYAWKNGLTGGVPASLAECASLQSVDLSYNNLTGPIPRELFALQNLTKLLLLENELSGFVPPDIGNCTSLYRLRLNGNRLSGTIPAEIGNLKSLNFLDMSSNRLVGPVPAAISGCASLEFLDLHSNALSGALPDVMPRTLQLVDVSDNQLAGPLRPSSIVSMQELTKLYLGKNRLTGGIPPELGSCEKLQLLDLGENAFSGGIPAELGELPSLEISLNLSCNRLSGEIPPQFAGLDKLGSLDLSHNQLSGSLDPLAALQNLVALNVSFNGFSGELPNTPFFQKLPLSDLAGNRHLVVGDGSGDSSRRGAITTLKAAMSVLAVVSAALLVAAAYILARARRRGGTGGSTAVHGHGTWEVTLYQKLDISMDDVLRGLTTANVIGTGSSGVVYRVETPNGYTLAVKKMWSPSPDETAAAAAAFRSEIAALGSIRHRNIVRLLGWAAANNGSTATRLLFYSYLPNGNLSGVLHGSGGASVAKQSAQPGSDWAARYDVALGVAHAVAYLHHDCVPAILHGDIKSMNVLLGPAYEPYLADFGLARVLSAAQSKLDDDSSKPRPIAGSYGYMAPEYASMQRISEKSDVYSFGVVLLEILTGRHPLDPTLPGGAHLVQWVTQARRRACDGDDALLDARLRERSAGEADAQHEMRQVLAVAALCVSQRADDRPAMKDIVALLEEIRRPGTAAADDVKPAPAPAASLPAAVAAAPVLSPARGGAHSRGVSSSCSFAGVSDYSA

SEQ ID NO: 16309 - protein, 190 aa, Triticum aestivum
RGNPTVEVEIITAKGAFRADVPSGASTGIHEALELRDKIKADYCGKGVLQAIENVNQTIGPALVDSGLVVTDQKAIDTFLIDLDGTTNKSKLGANAILGVSLAVAKAGAAEKEVPLYVHFADLASSKKPFVLPVPSFNVINGGSHAGNKLAMQEFMIMPTGAASFSEAMKIGTEVYHTLKGVIKDKYGQD

SEQ ID NO: 16310 - protein, 441 aa, Bradyrhizobium sp. ORS278
MMKALAEQISDIDAVNTYGRVVGVKGLMVEIAGPIHAMSVGARIVIETGSTVIPAEVIGFSGKNAVVMPFAGLEGVRRGCRAVIANSANQVRPSPAWLGRVVNAMGEPIDGKGPLPSGAAPVPYRNNPPPAHSRKRVGAPLDLGVRALNTFLTCCRGQRLGIFAGSGVGKSVLLSMLARNVDAAVSVIGLIGERGREVQEFLQDDLGEEGLARSVVVVATSDEPALMRRQAAYLTLAISEYFRDEGKDVLCLMDSVTRFAMAQREIGLSAGEPPTAKGYTPTVFTELPKLLERAGPGSGEGTITGIFTVLVDGDDHNEPVADAVRGILDGHVVMQRSIAERGRYPAINILKSVSRTMPKSADPVFLPTIMRARQVMATYADMEELIRLGAYRAGSSPEVDEAIRLHEPLETFLRQRKDEVCTLSQGYRELEQILGRLETES

SEQ ID NO: 16311 - protein, 157 aa, Neptuniibacter caesariensis
MSVKTIEGDFVNVDGNYAIVVGRFNAFVVESLLEGTIDTLKRHGVSEEKIRVIRVPGAFEIPLAVKRIAAQKKDDAIIALGAVIRGGTPHFEYVSGESSKGVAQVSLDYDLPVANGILTVNSIEQAVERSGTKMGNKGAEAALSALEMVSLLKQLEV

SEQ ID NO: 16312 - protein, 448 aa, Prosthecochloris aestuarii DSM 271
MSTTAYCLEPFMEWIQTKNPAEPEFHQAVFEVARSIIPFVNEHQKYQQACILERMCEPDRIISFRVVWEDDKGNIRMNRGHRVQFNNSIGPYKGGLRFHPSVNTGILKFLGFEQTFKNSLTTLPMGSAKGGSDFDPKGKSDREIMRFCQSFMTELSHYIGHFTDIPAGDIGVGAKEISYLFGEYKRLSHQFTGVLTGKSLEYGGSLIRKEATGYGCVYFMEEMLHEKGESIRGKTCTVSGSGNVALYCAQKINHLGGKVVTLSDSDGFIHIPQGISDEELDAIIELKTFKRGRLAEYAEKTACSYFAAEKPWGIECDLAFPCATENEITKSDAALLAGGGCIALAEGANMPTTQDALEVLRNSGILTAPGKAANAGGVAVSGLEMAQNSMRMAWTTQDLDSRLQAIMKSIHQQCTTYGRTNGYIDYVKGANIAGFIKVADAMLAYGIL

SEQ ID NO: 16313 - protein, 372 aa, Neptuniibacter caesariensis
MKLNTPEELLEDIRQGKMVILMDDEDRENEGDLVIAAEMVRADDINFMATHARGLICLTLTRDRCEQLNLPLMVQSNGAQFSTNFTMSIEAAEGVTTGISAADRAHTVRVAVKENAKPEDIVQPGHIFPLMAQPGGVLSRAGHTEAGCDLARMAGFTPASVIVEIMNEDGTMARRPDLEEFAEKHGLKIGTIADLIHYRTANEHTVERSEEGVMATEYGDFNYVTYRDEIQNCTHLAMTLGEVKADEPVYVRVHNRAEVLRDVVGAVNPNEEPKWTMRKALARVAAEGQGVVLLLDTNERIDMSESVDLMLNGRQQSKVNVSASGAYLTVGTGSQILRDLGVGKMRLLSSPMKFNAISGFDLEIEEYIPCEE

SEQ ID NO: 16314 - protein, 536 aa, Oryza sativa Japonica Group
MRKNPSEQEEEEKETEKKANEIEVQFPFRPTDPTHLPQPQVDAQVHHPCSIRTNTTTQTTYRCDTRSRAKRYHPPIHGGLHLRHLLLHSHQARLLLLLLLKSQLRLLRQVSIGVALGGWIFAGSLAAIGDVMTASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 16315 - protein, 195 aa, Mycobacterium tuberculosis
  misc_feature (1)..(1): Xaa can be any naturally occurring amino acid
  misc_feature (110)..(110): Xaa can be any naturally occurring amino acid
XPLLTIGDQFPAYQLTALIGGDLSKVDAKQPGDYFTTITSDEHPGKWRVVFFWPKDFTFVCPTEIAAFSKLNDEFEDRDAQILGVSIDSEFAHFQWRAQHNDLKTLPFPXLSDIKRELSQAAGVLNADGVADRVTFIVDPNNEIQFVSATAGSVGRNVDEVLRVLDALQSDELCASNWRKGDPTLDAGELLKASA

SEQ ID NO: 16316 - protein, 452 aa, Nocardia farcinica IFM 10152
MTLVKPRRVSGGEHEHGHLEEFRTDPIALMRRVRQECGDVGAFELAGKQVILLSGAEANEFFFRSGDEDLDQGAAYPFMKPIFGEGVVFDASPERRKEMLHNSALRAEQMRGHATTIAAEVDRMIAGWDDEGEIDLLDFFAELTIYTSSACLIGVKFRNELDDRFARLYHELERGTDALAYVDPYAPIESFRRRDEARAALVALVQAIMDERAANPPADKSDRDLLDVLVSVPNEDGGPRFSASEITGIFISMMFAGHHTTSGTAAWTVIELLRHPELRDRVVAELDELFADGKDVSFHALRQIPLLEATLKETLRMHPPLIILMRVAQGDFEVCGHHIAAGDHVAATPAISNRLPEDFPDPDTFDPGRYIDPNQEDLVNRWTWIPFGAGRHRCVGAAFALMQLKAIFSILLRDWEFEMAQPSESYRNDHSKMVVQLQQPCRVRYRRRVRTS

SEQ ID NO: 16317 - protein, 456 aa, Bacteroides thetaiotaomicron VPI-5482
MSRFEIKMPKLGESITEGTIVSWSVKVGDVIQEDDVLFEVNTAKVSAEIPSPVAGKVVEILFKEGDTVAVGTVVAVVDMGGEEASDEETASGKETPESKENASSDAEKVSSQVAKAEERWYSPVVIQLARGANIPKEELDSIQGTGYEGRLSKKDIKDYIEKKKRGISEVSKAAIPTGDALTASMPSSTGGAGSMTTSPVAASVQTPVAAPSAPSKQAPAAANIPGVEVKEMDRVRRIIADHMVMSKKVSPHVTNVVEVDVTKLVRWREKNKDAFFRREGVKLTYMPVITEAVAKALAAYPQVNVSVDGYNILFKKHINIGIAVSLNDGNLIVPVVHDADHLNLNGLAVAIDSLALKARDNKLMPDDIDGGTFTITNFGTFKSLFGTPVINQPQVAILGVGYIEKKPAVIETPEGDTIAIRHKMYLSLSYDHRVVDGMLGGNFLHFIADYLENWKG

SEQ ID NO: 16318 - protein, 148 aa, Zea mays
  misc_feature (49)..(49): Xaa can be any naturally occurring amino acid
  misc_feature (59)..(59): Xaa can be any naturally occurring amino acid
  misc_feature (87)..(87): Xaa can be any naturally occurring amino acid
  misc_feature (107)..(107): Xaa can be any naturally occurring amino acid
  misc_feature (113)..(113): Xaa can be any naturally occurring amino acid
ARADTPWDYIEKCVFLDVNEPNGSGGRHSRYNTSDSPYFIVHNRGIHRXCFTNNFTYHXTKDFYVHDGHSSYFEQSAKHEHFSPLLXQIATLNDALYKIHIQQNWFXAQIDRXAISNHNIIMMAVHKALYHSASLILACVIQVYLLCR

SEQ ID NO: 16319 - protein, 256 aa, Streptococcus thermophilus CNRZ1066
MAGAVNYPLPLTIENNFLPQYSSIPKEILEKSKLLFLNYPNNPTGAGANDEFFKETVAFAKENNLVVSHDFAYSDISFSGKSPSFLQAPGAKEVGIEIYTLSKTFNMAGFRIAFAVGNKEVISLLKGYIRASVGGTFGSVQDAVTYALLYSEKERGQLRKLYKERRDLVLSLLEEHNIDVIKSEGTFFIWIKLPKTIDDITFVEEFLAKEQVALIPCSTFGEFGKGYIRLSLVSDLKTIQLGIEKLIAFLEKKRVI

SEQ ID NO: 16320 - protein, 225 aa, Arabidopsis thaliana
MKLIEKTMSMNQFRTMEEEKQDGGELFHTIEVAKVDRNNVSQPPPAATAALLEVPGDELNLIPPLNFSMVDNGIFRSGFPDSANFSFIKTLGLRSIISLCPEPYPENNMQFLKSNGISLFQFGIEGSKSKEPFVDILDQKIREALKVLLDEKNHPLLIHCKRGKHRTGCLVGCMRKLQKWCITSILDEYKRFAAAKARVSDQRFLESFDVSGLKHTPMSFSCSNR

SEQ ID NO: 16321 - protein, 344 aa, Brachypodium sylvaticum
MAAAKRSAAARDTDVTVVLHAPWMTSGKRTRLWSSSDCEETGALGEGAFGAVVEARHRATGEAVAIKKACSPTRNGGTGTGMMREAAFLAACQGHGNVVELRAVSLEPLGSSPERLSLVMGLVGPSLHDVLHHRRGGRPFPEAEVRCIMRQLLAGAQHMHGLRVVHRDIKPQNILVVAGDGDQIESVKICDLGLAVSMSEPTPYERCGTRRYMAPEVLLGKPDYDAAVDAWSLGCVMAELLAGAPLFDGEDDGAQLLSIFSVLGVPLFTLWPEYKSLPLAGKVVQPPNKRHRNKLRQHFPEERLSEEGFEVLQGLLSCNIDKRLSATTTLRRPWFTKKAVDAQA

SEQ ID NO: 16322 - protein, 294 aa, Burkholderia sp. 383
MTFEQWMRSVLDRVEDALGHYLPAETAVPEKLHEAMRYAVLGGGKRVRPLLCHAAGELTGATEAARNAAAAALEMIHVYSLVHDDMPCMDDDALRRGKPTVHVQYDEPTALLVGDALQSQAFVALTDAAALSPVQQAALVRELALASGSIGMAGGQAIDLASVGLKLTREQLETMHRMKTGALLRAAVRMGALAGETPSAETMAALDVYAGAVGLAFQVVDDILDVTTDSATLGKTAGKDAANDKPTYVSILGLEASRELAAQLRTEAHDALKPFGARAQRLAELADLVVNRVS

SEQ ID NO: 16323 - protein, 1564 aa, Arabidopsis thaliana
MKKAFGQTVRDLKRGVNKKVLKVPGIEQKVLDATSNESWGPHGSLLADIAHASRNYHEYQITMGVLWKRLSDSGKNWRHVYKALTVLEYMVGHGSERVIEEVKEHAYQITTLSGFQYIDSSGKDQGSNVRKKAQSLVALVNDKERITEVREKAAANRDKYHNSMHRPSGGYGDKYDYEGRYGDRDEGRSSYGKEREYGYRDDDRNSRDGDRYSRDSEDRYGRDGNTDDEYRGRSRSVDNYNGSRGRSSDRERPIEDDGQSSSRDSGAPADDHSQDGRGGLERKFSEQNIGAAPPSYEEAVSESRSPVYSERDGGETPQVAPPGAAASPLAENISVDNKAADFVNESSPQQVEAFDEFDPRGSVSAACAPTAGASVPAPIPPTVVSTPAPPASINAEMDLLGSLSDVFSPNPLAIVTSDSTSVETNGQANTGLAPSFSTSQSSTQPFDDPFGDSPFKAITSADTETSQHQSFGVPFQPTPPTSNPNNEHNFGFGEAFSAVTDSEPGVQNMQAPPNLSVFPQEQFDTSQSEIDILAGILPPSGPPVSLSPQPDSTMPTSQFHPNGNSYESYHHQAAPTDLNMQGQTPFGQASQQFNMVSHSQNHHEGMQFNNGGFTQQPGYAGPATSQPPQYTPGVSSHPPSESFPHQPGSATSASSQTPYATTPNVSAGQFDGGSFMTQQPYGVTQQVHVVPSHIPQRTQSGPVAAFGNNNNIVGDMHQPGSTPSSSSQTPYPTTPNAPSGQFDGGNFMTQQPYGVIPQVHGVPSHIPQRTQSGPVAAHGNSNNVVGDMFSPAGLSSLETSASQPSLTPLTGAIEIVPQNQKKFEPKSTIWADTLSRGLVNFNISGRKRDLFIYSLSSHKALTKFLTFVSYCAAKTNPLADIGVDFEAINRKEKRLEKPTITQQQVTSTINMGKAMGSGTGLGRAGAGAMRPPTNSMVGSSMPTGMNVGGYGGMNQHQPIGMNQNHPMGMNQNLSMGMNQNYPMGMNQNYPMGMGMNMNMGGYGQGYPMQPQQGMGMAPPGAPQGMTGAYNPMMGQGGYNPQQQQPYGGGYRCDSKHKNTKQKRDQRRQRRRRRIRRTRGFPTIRFFDIPRRLRYQLLRSALSVCVNHVNNLGMYLSGPSHCHQSYTDEFSSSIPYKRTSNARNRVFDGCGSANLSVLSSRCKIPFFGSAFHVSSGGHDLGLTKVSVAADYSDSVPDSSFYGYHPLEDLKPSKRVQETKLSASEVARTTVEANSSAVLVFPGAIHCEPHDHNSWSEFKYVIDDYGDIFFEIPDDENILEDPGASNPVKAFFGMDVPRYENTRHHEEYNISDIGNLDQIIFDDHYFEIMDSEARDIPIDWGMPDTSNGVHPIYFAKHLSKAISMDYDRKMDYPSNGVSILGCLRPAFLDEESYIRRLFLSEDRDDYSWEVQGDDNPITSSRRDENDMSSSLYRLEIVGIELLSLYGAESSISLQDFQDAEPDILVHSTSAIIERFNNRGINSSIALKALCKKKGLHAEEANLISVDSLGMDVRVFAGAQVQTHRFPFKTRATTEMAAEKKIHQLLFPRSRRRKLKCHDESLKDAFR

SEQ ID NO: 16324 - protein, 258 aa, Erythrobacter sp. NAP1
MIDQAAFQDIVREAGRIAFDRWPGAGNECETWEKSPGNPVSEADLAVDAFLRRELGKLLPAAAWLSEETADDKIRTRSDLIWLVDPIDGTRDYVRGRAGWSVSVALISSGKPLIGMLSAPAREEEWFSFAGRGSTLNGEPLKASTRKEFSGARVPTDQLPSADSDLVAVEKPNSIALRIAMVADNRADLLATLRWGFEWDIAAATLIAREAGAQVSDAFGNPLAYNKHDPRDFGVLVSAPGIHAAAVARLAERAKALK

SEQ ID NO: 16325 - protein, 399 aa, Erythrobacter sp. NAP1
MNVHEYQAKELLKEHGIAVPDGHAALSVEEAVAAAKKLPGPLYVVKAQIHAGGRGKGKFKELPEDAKGGVRLAKSIEEVEANAKEMLGNTLVTVQTGAEGKQVNRLYVTDGVDIAKEYYFSLLVDRASGQVAMVVSTEGGMDIEAVAHDTPEKITTITIDPAQGFMPHHGRAVAFGLKLSGDLNKQAQKLAKKLYDAFMATDSEMLEINPLVETEDGQLLVLDAKMSFDGNALFRHPDIEAMRDETEEDPAEVEASEYDLAYIKLDGNIGCMVNGAGLAMATMDIIKLNGAFPANFLDVGGGATTEKVTAAFKIILKDPAVEGILVNIFGGIMRCDTIAEGIVIAAKEVDLSVPLVVRLEGTNVEKGKEILANSGLPIVPADDLGDAAKKIVAEVKQAA

SEQ ID NO: 16326 - protein, 284 aa, Zymomonas mobilis subsp. mobilis ZM4
MSDTASDSAPLLPKDQAPFWAFGAGNMAGSMISCWLNNGLNPKDMLVIRPSGKPVAEGVKVVTSLPEDGSTPATLLLGVKPQMLPQIAPALAPYITEKTTLISILAGVELETLRHFFPKAKSIVRAMPNLPVALGKGVVALCADKLTDEQRKCIEKLASTLGIFEWVNENQFDTATALAGCGPAFVYRFIDALAQAGQKLGLTADQALPMAIATVEGAASMAKQADITPAELADKVASPGGSTRKGMDVLDKDEALYQLMDATLEASFKQNRYMAEKAKETIAQ

SEQ ID NO: 16327 - protein, 446 aa, Salmonella typhimurium
SAEHVLTMLNEHEVKFVDLRFTDTKGKEQHVTIPAHQVNAEFFEEGKMFDGSSIGGWDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPPVMLAYSARNRSASIRIPVVASPKARRIEVRFPDPAANPYLCFAALLMAGLDGIKNKIHPGEPMDIPQVAGSLEEALNALDLDREFLKAGGVFTDEAIDAYIALRREEDDRVRMTPHPVEFELYYSVE

SEQ ID NO: 16328 - protein, 245 aa, Shigella dysenteriae
LLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGDLSEYSFIQTKEPLDREGKVSRIVEFIEKPDQPQTLESDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 16329 - protein, 532 aa, Saccharomyces cerevisiae YJM789
MSNDGSKILNYTPVSKIDEIVEISKNFFFEKQLKLSHENNPRKKDLEFRQLQLKKLYYAVKDHEEELIDAMYKDFHRNKIESVLNETTKLMNDILHLIEILPKLIKPRRVSDSSPPFMFGKTIVEKISRGSVLIIAPFNFPLLLAFAPLAAALAAGNTIVLKPSELTPHTAVVMENLLTTAGFPDGLIQVVQGAIDETTRLLDCGKFDLIFYTGSPRVGSIVAEKAAKSLTPCVLELGGKSPTFITENFKASNIKIALKRIFFGAFGNSGQICVSPDYLLVHKSIYPKVIKECESVLNEFYPSFDEQTDFTRMIHEPAYKKAVASINSTNGSKIVPSKISINSDTEDLCLVPPTIVYNIGWDDPLMKQENFAPVLPIIEYEDLDETINKIIEEHDTPLVQYIFSDSQTEINRILTRLRSGDCVVGDTVIHVGITDAPFGGIGTSGYGNYGGYYGFNTFSHERTIFKQPYWNDFTLFMRYPPNSAQKEKLVRFAMERKPWFDRNGNNKWGLRQYFSLSAAVILISTIYAHCSS

SEQ ID NO: 16330 - protein, 395 aa, Yarrowia lipolytica CLIB122
MSPEITDQLVRLLTRDDDADAAPVVCDSGNEYDGRMGARISSIFVILICGTFGALFPVLCSKYSQIKVPPVFFFCAKYFGSGVIIATSLLHLLQPANEALSQECLGHWNDYPYAFGICLFMVFFMFAVELVCFNMFGHQGHSHGPVGLASSKDVEISGVHEHTHEGHSHDDHSSDDIVKENEKPREHSSVPVSMPNPIANHDPLTPKDHYGHCEEHTDPNDVDLENDMGLETYSAQLVSIFVLEFGIIFHSVFIGLTLAVSGDEFKDLYIVLVFHQMFEGFGLGTRLATAPWPKKKVWTPWILGLAFGLTTPIAIAIGLGVRKTYPPGGKTASITNGIFDSVSSGILLYTGLVELMAHEFLFSSEFKHANNWRIFWAFAWMCAGAGLMALLAKWA

SEQ ID NO: 16331 - protein, 425 aa, Burkholderia thailandensis E264
MAIVEVKVPQLSESVSEATMLQWKKKPGEAVAQDEILIELETDKVVLEVPAPAAGVLAQVLQNDGDTVVADQVIATIDTEAKAGAAAAAAGAAEVQPAAAPAAAPAPAAQPAAAAASSTASASPAASKLMAEKGLGAADVAGSGRDGRITKGDVLSAGSAPKAAPAAAPAKAAAKPSLPDVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 16332 - protein, 231 aa, Physcomitrella patens subsp. patens
ISRSQERYMVAFQYGSIVFFNFGDDEEEEALAAVRKFCTDEFRETRKDDYGVLVRPTLRQWSEGGQDRIMLRMLDTDNIRVISSILGQSIALDHYAKKVDEMVNTFSELNRGMEKTGTFTMTRKSLFQLVAAANTTLADVILRLGLLERSDAAWKDANYAQIWEYLRDDFELDERFESLDFKLNIIQHNVRFFLEILQNRKSDTLEWIIILLITGEICVGVYQILLETNVI

SEQ ID NO: 16333 - protein, 342 aa, Shigella dysenteriae
MKYKKIEDALSSKSETWLITGVAGFIGSNLLEALLKLNQKVVGLDNFATGHQANLDEVKESVSAEQWSAFTFVEGDICEPETCVEVVKGVDHVLHQAALGSVPRSIKDPITTNNTNISGFINMLVAAKDANVRSFTYAASSSTYGDHPALPKIEENIGNPLSPYAVTKYVNELYAQVFARTYGFKSIGLRYFNVFGKRQDPNGAYAAVIPKWTAAMINDEPLYINGDGETSRDFCFIENVVQMNILAAQSDASARDQVYNVAVGDRTTLKQLFTVLKNALNENGVSYNKEPEYKDFRAGDVRHSQADITKAKTRLGYEPQFSISEGILKAMPWYVNSLGNKK

SEQ ID NO: 16334 - protein, 650 aa, Prosthecochloris aestuarii DSM 271
MSIFQHINFSSAYCLSRPMVLLTVEAISKQYGLKTLFNDVSFGIDEKDKIGLIGANGSGKSTLLKIIAGAETPDSGKVMATKQKRIAWLPQDSPYNPDDTVLEAVLTSGDPVLSLVYQYEVACKELERTGGMDDKVIDRVSNLSHELDVNRAWELEATVKSVLGKLGLNDETAKMGTLSGGQRKRVALAHALVMPSDALILDEPTNHLDADSVEWLEKYLSRYQGAVILVTHDRYFLDRVANRMIELDGQTANTYTGGYTSYLQQKAEKEEQDARADRKKQALVRQELEWMRSGCKARTTKQKARIQRAEGLINERGRGEQQELKTDFGADRLGNKIIELHNVSKSWDGTPLINSFEYFVQKGDRIGIIGPNGSGKTTLLDLITGRIEPDSGHIDIGKTVKIGYYDQMSRGLDDSKRVIDYIKEEAEQVKLKDGTELSASKMLERFLFEPSVQYNLIGNLSGGERRRLYLLKQLIVSPNVLLLDEPTNDLDIPTLQVLEDFLDSWPGCVIAVSHDRYFLDRVVDHVFVFEDNGHIREYPGNYSVYLELKAQGGASAEKPQKKERSAAKPSEARKKSPSAQPKLGYKEARELSALEKKIAQTEKRQEAVAAALNAAGSDFGKVQELSEELQNLQAELNADMTRWAELADRA

SEQ ID NO: 16335 - protein, 298 aa, Aquifex aeolicus
MNELIEKAKVLQEALPYIREFHGKVFVIKYGGSAMHDEELRESFARDVVLLKYVGINPVIVHGGGPQISKTLEKFGIKPKFVGGMRKTDEETMHVVEMVLSGDINKDIVALINRYSGEKIYAVGLSGRDGRLLKAKKLDKERYFSELGLPVPEEDIGFVGEIVDVNEELIFTLLSHNFIPVIAPVGVGEEGEAYNVNADLAASEIAGEIKAEKLIYLTDTKGVLDEKGELISSLSKDKAEELIKKGVIREGMIPKVRSALRALEKGVKKVHIIDGRVKHSILLEVFTKEGVGTEITLE

SEQ ID NO: 16336 - protein, 685 aa, Arabidopsis thaliana; identical to SEQ ID NO: 882

SEQ ID NO: 16337 - protein, 473 aa, Neptuniibacter caesariensis
MADRLNNDFQFLDVGRDGPKKIDAKVRKQDFGEIYEPFAKESASEQSHRCLECGNPYCSWKCPVHNHIPNWLKLVSEGNILEAVELSHQTNSLPEVCGRVCPQDRLCEGACTLNDGFGAVTIGSVEKYITDTAFAMGWKPDLSEVPKTDKKVAVIGAGPAGLAAADILVRNGVKPVVFDRNPEIGGLLTFGIPEFKLEKDVMSRRREVFTEMGVEFQLNTEVGKDIQMQELIDQYDAVFLGMGTYTYMKGGFPGEELDGVYDALPFLISNVNNCLDFEQDENGFIDMKGKKVVVLGGGDTAMDCNRTSIRQGAESVVCAYRRDEANMPGSKKEVENAREEGVEFQFNRQPVEVVGENGKVTGLKVISTQMGEPDENGRRRAEVVPGSEEVLPADAILVAFGFRPSPAPWFADFGIDLHEDGRVKAPEQNAFPFQTTNEKVFAGGDMVRGSDLVVTAIAEGRKAAEGILDYLEV

SEQ ID NO: 16338 - protein, 378 aa, Shewanella oneidensis MR-1
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGGQRQAARGSDLRYNLELSLEEAVKGLTKELRIPTLASCDVCDGSGAKKGTSATTCTTCHGQGQVQMRQGFFTVQQPCPTCHGRGKIIKDPCAKCHGDGRVEKTKTLSVKIPAGVDTGDRIRLAGEGEAGEFGAPAGDLYVQVSVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 16339 - protein, 616 aa, Legionella pneumophila str. Paris
MLTLRQITLSRGDKTLLDKVNVSLYEKQKIGLIGHNGCGKSTLFDFLLGQLSPDTGEYLINPQLSISHLSQHIPDSNEKALDFVLAGDQQYIKLLKRLSEAEKTGDDAEVLQCHEELSHTGGYSKPAQAAVIMSGLGFSGNQQQEPVNSFSGGWRMRLNLARCLMKPADLLLLDEPTNHLDMEAIFWLERYLKQSPSTIILISHDREFLDAFVTHILHIENHNLTLYSGNYSSFEKIHAQQLALQQAMHEKQQTKIKHMMTFVTRFKAKATKAKQAQSRMKAIEKMEIIAAAQADSPFSFDFFPCPRAGNPLIQCNQVDAGYINHPPILKKIKLSLNPGDRIALLGPNGEGKSTLIKTLTADLPVLSGDIHRSPHLQIGYYAQHQLEQLDCKLSPVETLQTLSPEVREQTIRDFLGGFNFRGDMAVQSIQHFSGGEKARLALARLVWLKPNLLLLDEPTNHLDLGMRSAIELALQTYEGALILISHDRHLLKSSVDNFYLIYQGKVQPFEGDLDDYYLWLQTRNSEKESKLATSPNEYKERKSYQNKLKKLEQLIEHYQNQLRLLDKQLADVSLYEDTKQKSKLDNLLMERDIAHSALIKTEEEWLEICHALESLE

SEQ ID NO: 16340 - protein, 364 aa, Nocardia farcinica IFM 10152
MMRTTTAALSRDPRGPFQLEQVRLDAPRPDEILVRVLASGICHTDLVSRAAGAADRPVLLGHEGAGVVEEVGGAVTSVRPGDHVVLTFRHCGACRNCATGRPAYCRKATALNTFGRRADGTPRVTVDGAPVLDGFFGQSSLAGYALATADNTVVIDPSVDPVVAAPLGCGFQTGAGAVLNLLRPEADSWLVVYGAGAVGLAALLAARTLDGVRTVVVETSAQRRALALELGATAALDPADGDTTARVRELTGGGADHALEATGIPTVLADAVRALGVGGTVAAVGLGTGAPPLDMRDIVVHGKSIRGCLEGDSVPTEFVPRLLELYRSGRLPLDRLVSVYPSAEIETALADQRAGTIVKPVLRW

SEQ ID NO: 16341 - protein, 498 aa, Myoporum mauritianum
  misc_feature (1)..(5): Xaa can be any naturally occurring amino acid
XXXXXTTSGSGVSTLEKKNQGRIVQIIGPVLDVAFPPGKMPNIYNALVVKGRDTGGQPINVTCEVQQLLGNNRVRAVAMSATDGLTRGMEVIDTGAPLSVPVGGATLGRIFNVLGEPIDNLGPVDISTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEDDRLTVARARKIERFLSQPFFVAEVFTGSPGKYVGLAETIRGFQLILSGELDGLPEQAFYLVGNIDEATTKAMNLEMESNLKK

SEQ ID NO: 16342 - protein, 378 aa, Mycobacterium smegmatis str. MC2 155
MPAPDTIRPHSTSIRAAVFDGTISVEPVDLADPRPGEVRVKIAAAGVCHSDLHVTTGAWDVPAPVVLGHEGSGVVTAVGEGVDDLEPGDHVVLSWVPGCGECRYCKAGRPAQCSLVASVVAVKGTLYDGTTRLSNERGTVHHYLGVSSYAEQVVVPRNGAIKVRKDAPLEDIAIVGCAIATGVGAVRNTAGVEPGSTVAVIGCGGVGLACVQGARLAGASRIVAVDVVAEKLELARKLGATDAVDASATDDVVAAMREVLPDGYDYVFDAIGKIATTEQAIAALGLGGAAVIVGLPPQGERASFDPLTLAEADQRILGSNYGSAVPERDIPALVDEVMAGNLDLASMISGRRPLEEAAAALDDLAAGHALRQLLIPSA

SEQ ID NO: 16343 - protein, 197 aa, Ostreococcus tauri
MARSGARRETRASARARASCARAWTVNDARRARWSTRARARTEREREVEEVTKKWGLEAGLWRVWKSDAKAEGGGDGENPVGESLSRMDMAKNLLKRYGSAYLATSISLSLISITVFYFLVAGGIDVAALLEKIGITVNATSEQFGTFALAYAAHKASSPIRFGPTVALTPLVARWMGKDVDDAEERTTDETDGGAP

SEQ ID NO: 16344 - protein, 124 aa, Pseudomonas aeruginosa
LLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHV

SEQ ID NO: 16345 - protein, 446 aa, Syntrichia ruralis
MGQGQSGGLPKQGPGGERNKGDGQKKEKKYEPAAPPTRVGRKQRKQKGSEAAARLPVVTPATKCNLRLLKLDRAKDYLLMKEEFVRTQKRLNPQEDKTEKDRSKVDDLRGSPMSVGNLEEIIDENHAIVSSSVGPEYYVNILSFVDKDQPGPGCAILMHNKVLSVVGLLQDDVDPMVSVMKVEKAPLESYADIGGLDPQIQEIKEAVELPLTHPELYEDIGIKPLKGVILYGEPGTGKTLLAKAVANSTSATFLRVVGSELIQKYLGDGPKLVRELFRVADELSPTIVFIDEIDAIGTKRYDAHSGGEREIQRTMLELLNQLDGFDSRGDVKVILATNRIESLDPALLRPGRIDRKIEFPLPDTKTRRRIFQIHTSRMTMADDVNLEEFVMTKDEFSGADIKAICTEAGLLALRERRMKVTHADFKKAKEKVMYKKKEGVPEGLYM

SEQ ID NO: 16346 - protein, 982 aa, Bdellovibrio bacteriovorus HD100
MNDIQSQIVSRGEEILKRMESQSKASIFSKDFWYGSIMEWSMKNEKFKTNMFRFVDVLPSINSGDEVARHLKEYFSEDGGTLPPVFNVGLGLGSLAPGLMAGAIKKNVMGMAKMFITGESPDEALPVLKKARKNKMTFTVDILGEATLSEKEAQDYSNKYMELVTWLAKDAEKWDEVPQIDRDHEGALPKVNVSVKMTALYSQIKDAAWDESKKILKDRLRPVFRLGMEKGVFVNLDMEQYSVKHLTLEVFTELINEPEFKNYKFFGIVIQAYLRDSFEDVKSLTEFAQKRGTPFWVRLVKGAYWDYETIEAEQRGWPVPVYTNKAESDANYELCAKYLLENIKFIRPAFASHNVRTLAACMLYAEKLNIPKEALEFQMLYGMAEPIKKTIVDMGYRMREYAPVGELIPGMAYLVRRLLENTSNESWLRGKFADNKSMAELLKDPAQGLTPTSPVIPKKPGKFYNEPLLDFAVKADREKMLKALAEAKASLPVNVNIVINNKELQSGKIFDRVNPSQSDQIVGKIQMATTEQAEQAMQAAQTAYKTWKNVPCEQRAALVDKLADIMTRDRFKLIATQVLEVGKPWAEADGDIGEAIDFCRYYARHMRELQKPLRVGGLPGELSHYIYKSRGVTAVIAPWNFPLAILAGMVTAAAVAGNTVVMKPAEQSTVVAWGLMKMIQEAGFPQGVINFLPGYGEEVGEYIVNHKYTTTIAFTGSKAVGLHIMNRAAVVQPGQQHVKRCIIEMGGKNAVIIDNDADLDEAVDGVIYSAFGFSGQKCSAASRVIVLDEVYDRFVDRLVETAKSIEIHPAENPKAYMGPVVDKEAYDRILGTIAEAEKNHKLLFKGSVPGGGFFAPPTIFGDVPGDAKLAQAEIFGPVVAVIRAKNLDQALDIANSTEYALTGGVFSRSPANINRVKEELEVGNLYVNRGITGAMVDRHPFGGFKMSGIGSKTGGPDYLKQYMEPACVTENTLRRGFAPAEE

SEQ ID NO: 16347 - protein, 497 aa, Triticum aestivum
FSTNGFVVGWSPSRRAGNSARGAYTPLVHTRFVLSHGGKRVFLSGSFTRWSEHLPMSPVEGCPTVFQAICNLPPGIYQYKFNVDGQWRHDEGQPTITGEYGVVNTLYLTREFDHINTVLSPTTPGSRMDVDSDSFQRMGSLSDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHATPYESLRGIAMKILETGISTVPIIYSSSSDGSFPQLLHLASLSGILKCICRYFKNSTGSLPILNQPVCSIPLGTWVPKIGEPNGHPLAMLRPNTSLSSALNLLVQAGVSSIPIVDDNDSLIDTYSRSDITALAKDKVYTHIRLDEMTIHQALQLGQDANSPFGLFNGQRCQMCLQSDPLLKVMERLANPGVRRVFIVEAGSKRVEGVISLSDIFKLLLS

SEQ ID NO: 16348 - protein, 461 aa, Streptococcus thermophilus CNRZ1066
MSIFRKKDVGLSQTEMKRHLTLRDVVLLGIGAMVGTGIFTITGTAASTLAGPALIISVLISAVCVGMSAIFFAEFASRYPSAGGVYGYLYASWGEYPAWMGGWLTMIVFMNAVSSVASGWGAYLKGLLASFGLQLPKAISGPFNPSQGTYIDLLPVLVLVLVTALLLMDSKQVLRLNSLLVVLKFSALAVFILVGLFHLNPDNWANFAPFGFGQIYGGKTGIMAGASLMFFGFLGFESISMTVDEIKEPQKNVPRGIVLALIIVASLYAVVSLVLTGVVHYTKLNVDDAVAYALRYIGVSWAANYVSVVAIMTLITVCISMAYALSRMVYSLARDGFLPQTFQKVSKTHKVPHYATLLTGILSAISSGIFSLANMASLVNISTLAYLVLLAIALIILRKDKGLPQKDEFKVPFVPVLPILSIIVCLSFMSQYSWQTWSAFGIAVLIGSAIYAFYGYKHSKY

SEQ ID NO: 16349 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILPGGAGTHLFPLTNRAATPAVPLGGCYRLIDIPMSNCINSGVNKIFVLTQFNSASLNRHISRTVFGNGVSFGDGFVEVLAATQTQGETGMKWFQGTADAVRQFSWVFEDAKNKDIDNIVILSGDQLYRMDYMDLVQNHIERNSDITLSCATVGDSRASDFGLVKIDRRGRVVQFCEKPKGTEHKAMQVDTTLLGLPRQDARLNPYIACMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKHVVITNKDGVQESDRPDEGFYIRSGITIIMEKATIRDGTVV

SEQ ID NO: 16350 - protein, 485 aa, Oryza sativa Japonica Group
MKKKVCVVGGGLVGLAAARELQREGHDVSVLEQRGGVGGQWLYDHTAAIDGADPLGVAGVQSSVYASLRLITPREVTGFSDFPFSPTTVAGGGDARRFPSHAEFLRYLRDFCDAFGLMDVVRLNTRVLRVAADRDGWAVRSRRGEVETEEVFDAVVVAVGSYTQPRLPSIDGMEAWPGRQLHSHSYRVPDSFRGEVVVVVGCGFSGKDIALELRRVAREVHLSVRSTEEAMASPAMSKMLARYGNLHLRPQIARLCEEEDGAVVAFADGSRVAADTVVYCTGYSYSYPFLDTGGKVTVDDDNRVGPLFEHVFPPELAPSLSFLGIPNMVTTRFFEAQARWVAQVLSGRRALPPAGDMLRAAEEHARAMDAAGVARRRAHDVPDLGEEFCERSCGFPRLEEWEKELIWTSITAMRDDLESFRDDFRVTDLVADGLRRHGWILAPAPEPEPLRQEDVVAGDGEGEGVQPVQANQAAVASPLGFINSA

SEQ ID NO: 16351 - protein, 173 aa, Shigella dysenteriae
MIKIVNEDLHAFTKNGSFASKVKCTIIGHTFHLVLMIRLGQFLSKIPVIGAFFRLVIEYSIRIIFSSDISLRARIGGGLVIMHGHDIVIGRDVVIGRNCKILNGVTLGNKDTESTENQQPVVGDNVIIGTGAKILGKVVIGNNVKIGANSVVISDIAPDSVAVGIPARVTKGI

SEQ ID NO: 16352 - protein, 245 aa, Marinobacter sp. ELB17
MLIIPAIDLKDGKCVRLRQGRMDDSTVFGGDPVDMATRWVEAGVRRLHLVDLNGAFAGEPVNGEIVKAIARKYPDLPIQIGGGIRSAEIIETYLQAGVQWVIIGTKAVKEPEFVTEMCKRFPGHIIVGLDAKDGRVATDGWAEVSEVMATDLAQRFANDGVDSIVYTDIARDGMMQGVNVEATAALAKACGIPVIASGGVTNMDDLKRLGAVADQGILGAITGRAIYEGTLDVAEAQAYCDSLNA

SEQ ID NO: 16353 - protein, 365 aa, Helicobacter hepaticus ATCC 51449
MPQIPQDTILQTLRNEIDSIDSEIFDALQKRMALVAQVGAHKTKQGGAIYRPEREREIIERLSQRESKYLNERAIEAIYQEIFAISRNLELPEKVAFLGPVGSYTHQAAEERFGAMSKYIPLNTISAVFESLAYKRVKYGVIPLENNTNGMVGESIDFLAYYDFKIIAEIILPIHHSFLSSCEHLSEVKKIFSKDIAFGQCQKFLHAHNLHHIEQIPTDSTARAVQLAASNPQSAAIGSKIAGKLYNLPLMFEHIEDSQNNKTRFVIVSDFANAPSGKDKTSLFVNLKNDDQVGTLFRLLGDFEKEGINLTKIDSRPIRSNESFKTGFFIDCEGHYLDKPLQRLFAKRSDEIKWLGSYIFTDIKK

SEQ ID NO: 16354 - protein, 520 aa, Cryptococcus neoformans var. grubii
MAPRSSKKALTLCLFQSLAGVIFGWSNSEGSGLFSMSKYQERFGECVDGVCTLSTTRQSAITGLLSVGAVIGAVGSGSIADRFGLRLTCMVFIFIYLCGAAIETSAFNTYGQLCVARLLTGLGVGATSGLVPVFQAEASPPRYRGLVTGSFQLCVTLGIWGVAMTNWGMSSYAGDVSWRIPVSLQMVWAALLLVGFLFSPESPRFLAKKGRWEHCRKNLANLRGLPVDHPDIDTEMEEVREATIKDQERGQASYVECFSTKDRILWRTMIGICVQIGQQITGVNFFFSYGVQFAQTAGLDDTYVFQIILASVNVLFSFPGILAVDRAGRRPILLIGGILMFIGQIVVGAVSKAYPDDKIAGDVLIAFTCLFIASFASSWGPIAWVVCGETFPIRLSSLCVTLGTGANWLFNLIIAFAAPQIQARIGTGITFVWAGCLAISVSFAFFCIPETRSMSIEQVDALYLSHTPAWRSHKFVDEQLARAQNAQEKHYSRSIHAENEQVKSSQQTSARTSAEDDRIV

SEQ ID NO: 16355 - protein, 326 aa, Yarrowia lipolytica CLIB122
MEKSITNSPVLSILSYCAASILMTVTNKYVLSGTSFNLNLALLAVQSIVCLTAISIGKSFGLCKFRSFNADEAKKWFPIALLLVVMIYTSSKALQFLSIPVYTIFKNLTIILIAYGEVLWFGGSVTSMALASFVLMVLSSVIAAWSDISGAIAVSGSATTTVTALNIGYFWMMSNCFASAAFVLYMRKRIKLTNFGDFDTTFYNNLLSIPVLLIASLLFEDWSPANLAVNFPPESRNLIFFSMVVSGLMSIGISYCSAWCVRVTSSTTYSMVGALNKLPLALSGIVFFGTPATFSSVSAIFVGFVAGIVYAVAQIQKKKAEAALPK

SEQ ID NO: 16356 - protein, 469 aa, Prosthecochloris aestuarii DSM 271
MEEHDMHTQSDFDLAVIGSGPGGFEAAVRAARKGLTVCVIERGALGGVCVNWGCIPTKALLRSAEIFRLAGESSAFGLDIEASSIDLARAVKRSRKVVLLASKGVESALKKNKVTVFQGEATFVDERTLRVSRDGQEDERLTAKHIIIASGARPREIPVLPVDGRHIMTSREALALKSAPERMIVVGGGAIGLEMAWYYHSAGTKVTVLEMLPRLLPLEDKEVSEGLERLLKKAGISIHCEAAVVSASAGDDGIVDAVVRMKDGSEQKMQGECLLVAAGVVPNSGGLQLDAAGVILERGFIATDAQCRTNVDHIYAIGDVRGGMQLAHKASAEAVIAVESITGGNPMPIDDAMVPRCVYVEPAVAAIGASQEDAAAEGREVMVGRAMFAASGKASAYGFRDGFVKLIFDAGSGVMIGGHVLGHGAVELIGELSLAMRLGATADQIASTIHAHPTLSETVREAAENAVVA

SEQ ID NO: 16357 - protein, 515 aa, Marinobacter sp. ELB17
MTATRTPTALIILDGWGHRDPAEDNAISNANTPFWDSLWQNNPKTLIDTSGMFVGLPSGQMGNSEVGHMNLGAGRVVYQNLTRIDKDLKDGGFQKNPALCKAIDAAVSQGKAVHLIGLLSPGGVHSHERHILAAAELAATRGAKAVYLHAILDGRDMPPRSAKASLENAAASLATLGVARIASVTGRYFAMDRDNRWGRVESAYNVMTLGEAEYTCEDAVTALEQAYERDENDEFVKPTRIQAEGDTTAIINDGDAVLFMNFRADRARELTRTFVDADFDGFKRKKVPQLADFVMLTEYAADIKASCAYPSAQLVNGLGEYLANAGKTQLRISETEKYAHVTFFFNGGREEPFTGEDRILVPSPDVATYDMKPEMSAPEVTDKLVEAIKSDKYDLIICNYANGDMVGHTGKLDAAIKAAECLDACVKRVVEALAEVGGEGLITADHGNCEQMQDPVSGQVHTAHTIGPVPLVYTGPKQIILNDGGALSDVAPTLLALMGAAQPTEMTGHSLAEIG

SEQ ID NO: 16358 - protein, 490 aa, Zea mays
MGHSLSSHSKSTLSSPPRRSRSLSPMSPPPLRLTAPMQIAAEDSGSDSSSSFAPPARDYTQDLPDEILALVFASLSPTDRNACSLACSRWMEVDATTRHRLSRLKLRGLRQLSDAGLASLAAAAPAIRKLSVASCTFGPKAFVAVLQSCPLLEDLSVKRLRVIIDTAGATTSIGEDIKFPPTSSLRSVCLKDLYSALCFVPLVASSPELRSLKILRCSGAWDLPLEVITARAPGLVELHLEKLQVGDRGLAALSACANLEVLFLVKTPECTDSGIISVAEKCHRLRKLHVDGWRTNRIGDFGLMAVARGCPNLQELVLIGVNPTVLSLRMLGEHCRTLERLALCGCETVGDAEIICLAERWAALKKLCIKGCPVSDRGMEALNGGCPSLVKVKLKRCRGVSYECIENLKVTRGGSFSISLDIVLEHDARSASENGAQENGQAQITALTDQMAGMDLPVNAAGAQSSTHTITRMRSVVSALRRRFGNPPPP

SEQ ID NO: 16359 - protein, 368 aa, Triticum aestivum
MVQRSSNAEVMCMDLSPKKPAKAYGSDGGAYYDWSPADLPMLGAASIGAAKLHLSAGGLALPSYSDSAKVAYVLQGAGACGLVLPEAAKEKVIPVKEGDALALPFGAVTWWHNAEGSSAELVVLFLGDTSKGHTPGRFTNFQLTGASGIFTGFSTEFVARAWDLDQDAAAKIVSTQPGSGVVKIAAGHKMPEPSAEDREGVVLNCLEAPLDVDIPGGGCVVVLNTANLPLVKEVGLGADLVRIGGRSMCSPGFSCDSAYQVTYIVRGGGRVQVVGIDGTRVLETRAEAGCLFIVPRFFVVSKIADDTGMEWFSIITTPNPIFSHLAGKTSVWKAISPAVLETAFNTTPEMEKLFRSKRLDSEIFFAPN

SEQ ID NO: 16360 - protein, 238 aa, Physcomitrella patens subsp. patens
MGDARLIYSFVARGTTVLAEHAIYAGNFSQIAVQCLLKLPAGTSKQTYVMDRHTFNFFVENGFTFLVVAEEALGRLIPFAFLERVKDDFKHHYQGGRADLAVSHSLDAEFGPKLKEHMDFCMENPEEIKKISRIKSQVAEVKGIMMENIDKVLDRSDKIDLLVDRTTHLQSSAAEYQRAGVRIRRRLWWQHFRLKLLVLLLIVVVAFIIYLSICRGFICHNPAVPGTPPAPGTPPGPL

SEQ ID NO: 16361 - protein, 343 aa, Solibacter usitatus Ellin6076
MNALLLTQYMHLEMVEMPVPAIGADDVLVRVRACGICGSDVHGLDGKTGRRIPPLVMGHEAAGEVVETGANVTDLRPGDRVTFDSTVYCGRCFHCTRGEVNLCDNREVLGVSPGPYRRHGAFAEYVSVPRRIMYRLPDSLSYEQAALIEAVSVAVHAVNLTPVRLGDSAVVVGSGMIGLLAMQAAKHAGCTRVIAVDPDEGRLRLAIGAGATDAINPKSTDAAAAIRELTEGRGADLAIECVGATDPIRTAIAGVRKGGAVTLVGNVAPEIEFPLQSVVTRQIRLQGSCASNGEYPACIDMMARGAIRVDELITAVAPLEEGPSWFDRLYRHEPHLMKVILRP

SEQ ID NO: 16362 - protein, 180 aa, Streptococcus pyogenes MGAS10394
MIKKENIPNLLTLVRIAMIPFFLFITSSSNKVGWHIFAAVIFAIASFTDYLDGYLARKWHVVSNFGKFADPLADKMLVMSAFIMLVGLGLVPAWVSAVIICRELAVTGLRLLLVETGGKVLAAAMLGKIKTATQMLSIILLLCHWIFLGNVLLYIALFFTIYSGYDYFKGASFLFKDTFK

SEQ ID NO: 16363 - protein, 516 aa, Nocardia farcinica IFM 10152
MSGTREKLDQLLGILELAEEPAGEAGIAKRKAKEIPSARERVRMLLDKGTFVEIGKLVRQPGSGDAMYGDGVVTGRGYIDGRPVVVIAHDQTVHGGSVGEMFGRKVAAAMEFAYQNACPVIAINDSGGARIQDAVTSLAWYALMCRRQEDLSGYVPQIAVMLGKCAAGSVYGPVNMDVLVATEKSYMFVTGPEVIKAVTGETVSAEELGGAAVQAGNGTVHHVAPTEQAAFDWVRDYLSYLPSSCLEQPPVVNPGLEPEITDHDRELDSIIPDSDKVGYDMHEILLRIFDDGQLHEIGAATAGNLITAFARVDGRPIGVIANQPQVLGGALDAQCSDKATHFIRLCDAFGLPLVFVVDTPGVLPGIEEERNGVIKRGGRFFRAVIEATVPIVTVVTRKAYGGGYAVMGCKQLGADVSFAWPTARIAVMGAESMVGIIGRKKLAETPADQREVVRQQMIDFYNATMATPWIAAERGYIDAVIEPSQTRLEIRKALRMLRDKNPRPRHNPRKHSLFPV

SEQ ID NO: 16364 - protein, 462 aa, Rhodococcus sp. RHA1
MNVDETSHVKEAPPSGLKKVVGASMAGTVVEWYEFFLYGTAATLVFSKVFFAAGGNELDAIIAAFVTYAVGFVARPLGGIVFGHFGDKFGRKQLLQFSLLLVGAATFLMGCLPTYNQIGYWAPALLVTLRFIQGFAVGGEWGGAVLLVAEHSPNRSRGFWSSWPQAGVPAGNLVATVVLLILTTTLSDAAFLSWGWRVAFWLSAVIVLVGYYIRTKVTDAPIFIQAQKEAEHIKETSFSVFEVLKRYPRGVLTAMGLRFGENVMYYLVVTFSITYLKVVVHTDTAQILWWMLIAHAVHFAVIPLVGRLSDTIGRRPVYMIGAVTAGTWGFFAFPMMNSGHNAVILGAIIIGLVFHAFMYAGQPAIMAEMFPTRMRYSGVSLGYQVTSIVAGSLAPIIAASLLSKYDSSVPIAIYLAIACLVTVVAVIVARETKGISLESIDEADAQILADEKAAGAKDGVPA

SEQ ID NO: 16365 - protein, 388 aa, Rhodococcus sp. RHA1
MRPESQRSNIQTFHVMDVWKAATERQRTHGDVLTLAAGQPSTPAPQPVLRATREVLDGHLLGYTETFGILPLREAIAGYHSAKSGIDVDAEDVVVTTGSSGAFTLLFLAAFDVGDTVVVARPGYPAYRNTLAALGCTVIEIDCGADTRFQPTVAMLEALPEPPAGLIVASPANPTGTVIDPDELAALARWCDDHGTLLISDEIYHGIGYGEQAMTSSWETSRESVVVGSVSKYFSMTGWRLGWMLVPEGLRRPLQRLASNMTVCPPAISQYAAIAAFTEESRVELDGHVQRYAVNRELLLTGLPELGITDLAPADGAFYVYADIGHLLGGSHGATSTEWCSRLLQDTGLALAPGIDFDTVHGDRTVRLSFAGSTAEVRESLVRLGRWL

SEQ ID NO: 16366 - protein, 454 aa, Bacillus anthracis str. Ames
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRCPEGLTEEQYDDFMIEEFKNFFISEVAPETIAAVVMEPVQGEGGFIVPSKKFAQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTARV

SEQ ID NO: 16367 - protein, 394 aa, Streptococcus pneumoniae
MKIAIAGSGYVGLSLAVLLAQHHEVKVIDVIKDKVESINNRKSPIKDEAIEKYLVEKELNLEASLDPAHVYKDVEYAIIATPTNYDVDLNQFDTSSVEAAIKTCMEYNDTCTIVIKSTIPEGYTKEVREKFNTDRIIFSPEFLRESKALYDNLYPSRIVVGTDLDDSELTKRAWQFADLLKGGAIKEEVPILVVAFNEAEVAKLFSNTYLATRVAYFNEIDTYSEVKGLNPKTIIDIVCYDPRIGSDYNNPSFGYGGYCLPKDTKQLKASFRDVPENLITAVVQSNKTRKDYIAGAILAKQPSVVGIYRLIMKSDSDNFRSSAVKGVMERLDNYGKEIVIYEPTIECDTFMGYRVIKSLDEFKNISDIVVANRMNDDLRDIQEKLYTRDLFGRE

SEQ ID NO: 16368 - protein, 422 aa, Solibacter usitatus Ellin6076
MTNFSELPLSAQLKSNLAKNNFTEPTPIQSLAIEPALAGKDIVATAQTGTGKTLAFLLPTIQLLSTEPRQPGVRALILTPTRELALQINEALLQIARGTGIRAAVAVGGLNERSQLRDIRGGANIVVATPGRLYDFMSRGLINLTTVRMLILDESDRMLDMGFLPTIKRIIAAMPAERQTLLFSATLESSVKQLVETHVRNAVRIELGSISKPSEQVDLHLYEVDQDRKFGLLEMMLREEQGSFLVFARTKHGADKLAKKLAQSGFKSAAIHGDRSQNQRIQALKGFQEGYYRVLVATDVAARGIHVEGISHVVNFDLPQVPEDFIHRVGRTGRAGAKGTASTFATRSERSEIGRIERTLSVKLKRREVSASIVAAPRKESSAVIVLPHAKRAEHSRPEQGRNKSFRSFSPKSGRRPVRRAV

SEQ ID NO: 16369 - protein, 186 aa, Triticum aestivum
AYLGDSIEQVCTKKQAGTGPEFPGYRRPTRPPSRKVLSKIACLRLQKELGEWQASPPGGFTYKVSDNLQRWVIEVSGAEGTLYAGETYRLQVDFPEQYPMEAPQVIFMHPAPMHPHIYSNGHICLDILYDSWSPAMTVSSVCISILSMLSSSPAKERPSDNDRYVRNCRNGRSPKETRWWFHDDKV

SEQ ID NO: 16370 - protein, 386 aa, Shewanella oneidensis MR-1
MEVALTKSALLVLEDGTVFTGTAIGADGLSVGEVVFNTSMTGYQEILTDPSYSRQIVTLTYPHIGNTGTNNEDVESNGVHACGLIIRDLPLIASSFRNQQNLSDYLKANNVVGIADIDTRKLTRILREKGAQAGCIMAGADLDEVKALAAAKAFPGLKGMDLAKEVTTDKAYPWRKGSWRLVGGLPADTPAEALKYKVVAYDYGVKQNILRMLVDRGCDVTVVPAKTPASEVLAMNPDGVFLSNGPGDPEPCDYAIEAIQQILKTDTPIFGICLGHQLLALASGAKTLKMKFGHHGANHPVSNIEKGNVMITSQNHGFAADEATLPANIKVTHKSLFDGSLQGIHLTDKPAFSFQGHPEASPGPNDAAPLFDHFIELIEHYRQNAK

SEQ ID NO: 16371 - protein, 483 aa, Bacillus anthracis str. Ames
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFEKAVGQLKVGDGFGDGTTVGPLIDENAVSKVQEHIEDAIQKGGTVLYGGQKVAELDGHFMQPTVIGLANDTMLCMNEETFGPVAPVAKFKTVEEVIERANHTPYGLAAYIFTKDISQAFQISEALEYGIIGLNDGLPSVAQAPFGGFKESGIGREGGHFGIEEYLEIKYISLGL

SEQ ID NO: 16372 - protein, 306 aa, Streptococcus pneumoniae
MKKVKKAVIPAAGLGTRFLPATKALAKEMLPIVDRPTIHFVIEEALRSGIEDILVVTGKSKRSIEDYFDSTFELEYSLRKQGKMELLKSVNESTDIKVHFVRQSSPRGLGDAVLQAKSFVGDDPFVVMLGDDLMDITDSTAVPLTRQLMDDYNATQASTIAVMPVRYEDVSSYGVISPRLESSNGLYSVDAFVEKPKPEEAPSHLAIIGRYLLTPEIFSILETQKPGAGNEIQLTDAIDTLNKTQSVFAREFVGKRYDVGDKFNFMKTSIDYALQHPQIKESLKNYVIALGKQLEKLDDCSSSGHL

SEQ ID NO: 16373 - protein, 109 aa, Brassica napus
MKIILSIFFVASFLLITSSLASATISGGGGGGGAVAPAPEIKDGAELEKWCGGKCEVRCEEAGMKDRCLKYCGICCKECKCVPSGTYGNKHECACYRDKLSSKKTPKCP

SEQ ID NO: 16374 - protein, 766 aa, Glycine max
  misc_feature (462)..(462): Xaa can be any naturally occurring amino acid
MGAVILPDLGTEILIPVCAIIGIAFALFQWVLVSKVKLSAARDASSNAGGGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIXPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKI

SEQ ID NO: 16375 - protein, 300 aa, Streptococcus thermophilus CNRZ1066
MHFYLISFKIILLQLEKENRMETYTLSNGVTIPKIGFGTWQIPEGEEAYNSVSFALKAGYTHIDTAQIYGNEVSVGKAIADSDVAREDLFLTTKLWNDKHDYDLAKASIDESLERLGVDYLDLFLIHWPNPKALRENDAWKVGNAGAWKAMEEAYKEGKVRAIGVSNFMQHHLEALFETAEIVPHVNQILLAPGCTQEDLVAYCRERDILLEAYSPLGTGSIFGNEDVEAVAERNGKSVAQVALRWSLQKGFLPLPKSVTPKNIEANLDIFDFDLSEEDMAVLDKIQGIKTQVDPDTVNF

SEQ ID NO: 16376 - protein, 333 aa, Bdellovibrio bacteriovorus HD100
MMKLTVIPGDGIGPEIMAQVVRVLKHVHAPFEYEEHQAGEVALNSLGELLPQTTIDSINKTKLAIKGPTTTPVGGGHKSINVTMRQKFDLYANVRPVRSLPGVQCVCSDVDLTIVRENTEDLYAGIERMVDEDTAESIKRITRKGSERIARYAYDLAQKTGKPRMAIVHKANIMKLSDGLFLKVAQEVGWQYPEITTKDVIVDNACMQLVTKPQQFDVIVTENLYGDILSDLCAGLVGGLGVVPGANIGANHAIFEAVHGSAPDIAGQNKANPTALLQSAVMMLQHVGENAKADAIMKALIAALSDVNARTGDLGGKGTTVSFTDAIIQRLGH

SEQ ID NO: 16377 - protein, 859 aa, Zea mays
MAEAHAEAMDGSTWEDMMRRILPPGTPIPEAPPNLDYSIALEYDGPPVPYELPRVDPVEIPAIPTAEPVSGSQVLGGLPVAPVVQPIRLPVSRIARCADPVAAQAAGSSESVLHNQEFSDDDEEGDDSRSQSHGSAQSSPGPQNRPERQEGRRGPVVTFGFTPDSKYESKEFEEMSEQYVAVTKKEKRRRACYRCGKRKWESKESCLVCDARYCGYCVLRMMGSMPEGRKCVNCIGQPIDESKRSKLGKNSRTLSRLLSPLEVRQILKAEKECQANQLRPEQLIVNGCPLRPEELTDLLSCSRPPQKLKPGKYWYDKESGLWGKEGEKPDRIISSNLNFTGKLQVNASNGNTQVYMNGREITKIELKVLKVANVQCPRDTHFWVYDDGRYEEEGQNNIKGKIWESALARFACALFSLPVPPGNSNGTRDEVPYTARAVPDYLDQKRIQKLLLLGPPGAGTSTIFKQAKYLYGTRFTQEELEGIKLMIQSNMFKYLGILLEGRERFEEEALSRLNYTISQGEETQHDENKANGSNSCIYSINARLKKFSDWLLDIIAMGDLDAFFPAATREYAPFVDEMWKDPAIQATFKRKEELHFLPDVAEHFLSRAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPVSGSSRPLVNKMMQSKELFEATIRQPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 16378 - protein, 444 aa, Oryza sativa Japonica Group
MEALWKQASRLKEQVSRQGVFKPFGAAYGNSENAFTDESEVNLHQRLEKLYLSTRAAKHFQRDIVRGVEGYIVTGSKQVDIGNKLSDDSQKYGTGNTCTSDNTLSKAAMYYGKARSLMEKERGNMLRAFGTQVAEPLRAMVMGAPLEDARHLAQRYDRMRQEAEAQAVEVSRRQNRVRESAPNGDVITKLEAAEYKLEELKSSMVGLGKEAVAAMAAVEAQQQRLTLQRLIAMVEAERAYHQRVLEILDHLEQEMVSERQKIEAPPTPSAENYMAQPPPSYDEVNGMFASSSVDDSVTSVDFFLGEALDSFKAESESELNLSAGDIVIVRKISTNGWAEGECKGKAGWFPHGYIERRERVLASKHESAVLAGRSLVYSEPGNILSSNIYRVQTKQKTWPRQRERARWRDDESTREIAAFAVGVTPVTSPTRPTYRYSLRFTIHR

SEQ ID NO: 16379 - protein, 268 aa, Erythrobacter sp. NAP1
MTQSIPYWHVDAFSAKPFGGNQAAVMVMDEWLPDETLVAIGGENLFAETAFVIPDASGEADWELRWCTPTCEIALCGHATLASGHVLLTHHEWGKGRDRVTFRTRKSGVLEVRRDGEGYALALPAIATEPAEHPQASALMGAEPQSIHRSELGYNIMLYRDEAEVRALTPDIRGLERLGADQFIATAPGDNSDIASRVFVPGGGVDEDSVTGSAHAALTPYWAAKLGRDAFTAHQASERGGDLTLRLDGDRAWLGGPCVTVVEGRFLL

SEQ ID NO: 16380 - protein, 437 aa, Shigella dysenteriae
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLP

SEQ ID NO: 16381 - protein, 491 aa, Gibberella zeae PH-1
MSKTKSKKRKQNAQAQAQSDNPRKIAKTTSPSIPTPPPDGSTFEPKNLHTVVSEEELEIAIDTLTSLAQYPGLIKSKLCKDLRVAVYDFRQACTTGVNNAAGANLTAQVTAALADRKYTEARIHLAEMKIRGEQPKLGALCRWVRDLDVISGLSTVPDQQGLVVRSEREETLIKVIDAVLRVCGHEDRNPNAVVQPSSIALQEIWDLRPDTPTEQVYATVLDSSLVASAPDSLKKNLRIIETTPGPERKPPNHHDAILYASTPDAVPLSTTPPPTTYTPHPVVDGLSVATHVLYPEECKAIIAAGESVNFVPDAPLREDGDVSILAHNFYWVVDQTFHDTLWSRIRPFVPASMNGRLARGVNRRFRVYRYVPGAEYRAHIDGAWPPSGITKDDKYVYDSSPAEKKQSSLFTFLIYLNQDFEGGETTYFLPAAREGVLNAYPVRPIMGGAAIFPHGEINATLHEGTGVRKGAKYVIRTEIEYDIEPSEEVKV

SEQ ID NO: 16382 - protein, 160 aa, Magnetospirillum magnetotacticum MS-1
MVAPPILSLRFSETGRTRFTVHVEPGPHIHRSLQTIRALGRRAGVALNPGTPASAIEPLLDMVDLVLVMTVNPGFGGQSFIHSALETVSRVKALVGGRNIDISVDGGITPETAGPAAQAGANILVAGSAAFKGGPAAYQKNIAAIREAAGAATGRDGVRC

SEQ ID NO: 16383 - protein, 414 aa, Virgibacillus salexigens
MKTFEELESTVRSYSRGWPTIFEKAKGYKLWDVDGNEYIDFFAGAGALNYGHNNDVMQQKLIEYIQNDGIIHSLDMGTNPRKDFLERFNEVILNPRHLDYKVMFPGPTGTNTVESALKIARKVTGRDTVISFTNAFHGMTIGSLSVTGNSFKRHGAGIPLHHSVSMPFDDYVEDQDSIAYLERFLEDSGSGVALPAAIILETVQGEGGINAASMEWLKKVEAICKRWDILLIIDDVQAGCGRTGTFFSFEPAGIKPDIVCLSKSIGGIGLPMAITLIKPEYDQWGPGEHNGTFRGNNLAFIAATEALSNWEDSTFSEAIQRKASLIQERIESIITKFPSLAGEERGRGLMQGIAIQEDDLSNQICAEAFSRGLIVETSGPNDEVVKFLPPLVIDEEGINSGFDILEDAIKQAIK

SEQ ID NO: 16384 - protein, 519 aa, Zea mays
MMIARRLLRSNNAPAQASSLLKHVMTGTASLQGYADSLLDATVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLISASLTGLPALHQKFDLPAPFVLHTDCPHYWRYHLPGETEEDFATRLATNLENLILKEGPETVEFLSPKLIAAFIAEPVMGAGGVIPPPKTYFDKVQAIVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 16385 - protein, 123 aa, Triticum aestivum
  misc_feature (51)..(51): Xaa can be any naturally occurring amino acid
EFGTREIAGTFVLVYTVLSATDPKRTARDSFIPVLVPLPIGFAVFIVHLVXLPITGTGINPARSLGAAVMYNQHKAWKDHWIFWVGPLLGATVAALYHRFVLRGEAAKALGSFRSTGAATART

SEQ ID NO: 16386 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALRYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 16387 - protein, 390 aa, Enterococcus faecalis V583
MKLQVTKKAEHKFKKGYPLIQKEDLQQVPAPLPTDWLTLIDSKGQRLAEGYLGEQNKGIGWLLSWHGPINQSFFQQLFEISREKRTSFEKDSLTTAYRLFNGEGDGIGGLIIDRYADYAVFSWYNETLYQKKAELLTAFRTVYPDIIGAYEKIRFSTKDLPESQFLYGEQAPEPLLVTENGVQFATYLNEGLMTGIFLDQKEVRGRLVDGFAVGKTVLNMFSYTGAFSVAAAMGGAVATTSVDLAKRSLPKTTEQFEVNHLNLAPQKIIVMDVFDYFKYASRKGLSYDMIILDPPSFARNKKKVFSVAKNYGELVKDSIDILTDKGTLIASTNAANLSLAKYQKMVITALQEKNVRYKITDTYQLPADFQVNPNFPEGNYLKVLFIEIEK

SEQ ID NO: 16388 - protein, 156 aa, Campylobacter upsaliensis RM3195
MQILEGKLNLKGDEKIAIINSRFNHIITDRLVDGAKDAFLRHGGKEENLSLVLVPGAFEVPFALKVAIESKKFDAICCLGAVIRGSTPHFDYVSAETTKGIANVSLTHNVPVSFGVLTTDNLEQAIERAGSKAGNKGFEAMTSLIEMLGLTHILKA

SEQ ID NO: 16389 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEFARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 16390 - protein, 416 aa, Marinobacter sp. ELB17
MSTLSVAKITQPLFDVHAVRRDFPILSQQVNGKPLVYLDNGASSQRPEAVLQAMDSYYREMHSNVHRGAHTLADRATSAFEGARKKVQQFLNAPSAREIIWTRGATEAINLVANGLAPLLKPGDEILLSQMEHHANIVPWQMLAERTGARVLPIDVTPEGELDMDSFHSLLSERTRILAITHVSNALGTVNPVADMVAKAKAQGVITLVDGAQAVPHFQPDVQALGCDFYVFSAHKLFGPTGIGVLYGKAELLEAMPPWQGGGEMIERVSFAGTTYNTLPYKFEAGTPAIAEAVGLGAAIDYLATLDRDAMEAAENALLQRANELVTSVPGMTVIGTARHKVPLISFKIDGLHPSDIGTLLDQQGIAIRAGHHCAMPLMEYYGLPGTARASFAFYNTLEEVEQLFAALQKIQRLFT

SEQ ID NO: 16391 - protein, 267 aa, Escherichia coli W3110
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIAAYAAKHNATPAQVILAWAMGEGYSVIPSSTKRKNLESNLKAQNLQLDAEDKKAIAALDCNDRLVSPEGLAPEWD

SEQ ID NO: 16392 - protein, 577 aa, Zea mays
MGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGSWLTPIPPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKLATERGRKARPNLKVGICGEHGGEPSSVAFFAKAGLDYVSCSPFRVPIARLAAAQVLV

SEQ ID NO: 16393 - protein, 212 aa, Sulfolobus solfataricus P2
MYRAIFVDFGNTLVGFKPAFYEKLQTILREHGYDVDIRRVFRAYVKAMAVNNYSQPTDIKEFLYNLNIPPSDRLISHIRGSDIRDGEAFIYDDVMEFLETIRSTNTKLILLSNSSPRTKKLLEELGLVKYFDDLVLSHEIGIVKPNPKIFAIAILKGGYPALHIGDIYEIDYVGARRSYVDAILLDRYDFYPEIKEKVRNLREIIPMVTKNL

SEQ ID NO: 16394 - protein, 252 aa, Triticum aestivum
  misc_feature (206)..(206): Xaa can be any naturally occurring amino acid
  misc_feature (208)..(208): Xaa can be any naturally occurring amino acid
EVTIPIFGQEVFYGVDTATCSEQLNFIVDALKPSKLRSLVDPMSQEVEAYFAKWGQDGIVDLKHELEQVLMFISSRCLLGYEVRDMMLEEVYSLFHDLANGLNFLSFLFPYTTTPRNRRRDKAHIRLKEIFTATTMSRRSSGRVEDDALQRLMNSKYKDGRFTTEAEISGMIMGLVVAGHISSTSTSTWTGACMLSNTKFLIAAMXEXKHIISKYKNQIGYEALSEMDTLHRCIKGGNRMHTSAPVLVRKAH

SEQ ID NO: 16395 - protein, 219 aa, Shewanella oneidensis MR-1
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARQLVKLGGDPVYREGVITDNGNVILDVYNLKILNPKELEDKINAIVGVVTNGLFAKRGADVLLVGTPEGVKTFTA

SEQ ID NO: 16396 - protein, 337 aa, Arabidopsis thaliana
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGLLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 16397 - protein, 324 aa, Oryza sativa
  misc_feature (254)..(254): Xaa can be any naturally occurring amino acid
  misc_feature (274)..(274): Xaa can be any naturally occurring amino acid
  misc_feature (294)..(294): Xaa can be any naturally occurring amino acid
MSVVSSNPLYLTPAQSHELADIANRMVAKGKGLLAADESTGTIGKRFSSIKVENNEENRRLYRQLLFTTDAAQNLHNYISGVILYEETLFQKTDAGVPFVEILNKAGIIPGIKVDKGTVPLAGTNGETTTQGLDGLDERCKKYKSAGAHFAKWRCTLKIGANEPSNLSIIENANVLARYASICQQNGLVPIVEPEILPDGDHDLERCQVVTEEVLAAVYKALNDHHVFLEGTLLEPNMGTAGQSCPKKYPNEQXALPTVTALRRTGSVGGPEVXFLLRRQSEEGASLNLNPLNXGPIPRPGAFLFTFCPGLEPVLYKRLGVEKP

SEQ ID NO: 16398 - protein, 218 aa, Ostreococcus tauri
MLEKVGIEPKFLNGLRVTDAATMEVVEQILTGKVNKSLVSLISVAGGRAVGICGKDGNLLRGKVKNEELGFVGDVTQVDTSLIRELVNAGYIPVVATVAMDAQGQALNVNADTAAGAIAAKLGAEKLILMTDVPGVCTDKDDPNTLIRELTMEETHKAIAGGVIAGGMIPKVECCMNSITNGVKSAHIIDGRAKHSLLLEILTDEGVGTVITEDVIAV

SEQ ID NO: 16399 - protein, 324 aa, Streptomyces collinus
MAHAVRFHETGGPDVLSWEEVTVGEPGPGEVRVRHEAVGLNFADTYFRTGLYPVRLPEGMGVEAAGVVEAVGEGVTGVAAGDRVTYTGSPLGAYSTERIMPASHLIVLPRQISCETAAAMTMRGLTAAYLLRRIHTLKSGDTVLLHAAAGGVGLILSQWAALLGIRVIGTVSSEEKAELALAHGCEHVIRYRHEDVAERVRELTGGAGVPVVFDSIGKDTFAGSLASLARRGLLVCFGTASGPVPPIDAMRLALAGSVFVTRPALADYIADPAERAALAGELFEHVVAGRIRIEINQRYDLKDAEQAHRDLESGRTTGSSVFVL

SEQ ID NO: 16400 - protein, 206 aa, Borrelia burgdorferi
MAKIIGISGGSGSGKTTVVSKISEFIPEFVLISQDNYYKSVGDYEHEFSKVNFDHPDAFDNNLFYEHLKNLKKDSPIDMPLYDFINHKRQLKTVLVVPTPVVIVEGIMIFVEERVRNLIDLKIYIDTPNDIRFIRRLRRDISKRGRTVESVIDQYLNTTRWGYYRFIEPTKEYADLIIPEGGHNDKALYVLSTFLKSLSKEGLDFT

SEQ ID NO: 16401 - protein, 211 aa, Streptomyces coelicolor A3(2)
MTRPSARHVLPEFTERTSAGTRTSDPYSKLLQERIVFLGTPVDETSANDVTAQLMYLEHQAPDRDIELYVNSPGGSFTAMTAIYDTMRYVACDVATTCLGQAGPSAAVLLAAGTPGKRAALPGARVVLHQPALTEPVRGQAGDLAVHAAELVRVRARLEEILVRHTGRTPGQVAADLERDTVLDARQAREYGLVDRIVPGRRTPPASSGAR

SEQ ID NO: 16402 - protein, 371 aa, Campylobacter coli RM2228
MANLSLIMLAAGNSTRFDMGVKKQFLRLGDDPLWLYATRNLSTFYPFKKIVVTSSNTSYMKKFARNYEFVEGGATRAESLKKALEIIDSEFVMVSDVARVLVSKSLFDRLIENLDKADCITPALKVADTTLFENEALQREKIKLIQTPQISRTRLLKQALNQNLDFTDDSTAISAVGGKIWFVEGEENTRKITFKEDLKKLDLPRPSNEIFCGNGFDVHEFGEERPLLLGGVEIHPTMGLKAHSDGDVLAHSLTDAILGAACLGDIGELFPDTDEKFKNANSMNLLKEAYKRVKEFGFELVNIDICVMAQTPKLKDFKEAIAQNIANTLNVDEFRVNIKATTTEKLGFIGRKEGMAVLASANLKYFDWTKI

SEQ ID NO: 16403 - protein, 368 aa, Campylobacter coli RM2228
MKEQILEKLKSVKYPGFDKDIVSFNFVKDIKTENENVIVELEIVSSNPQVSEELRKNIDEALASLNLKNLQIHIITPKIPEEKSNSRSGKNIAPQVKNFIMVSSGKGGVGKSTTTVNLAISMAKMGKRVGILDADIYGPNIPRMLGETKTQPEVVGQRLKPILSHGVYMMSMGVLIEEGQGLMWRGAMIMKAIEQLLADVIWPELDVLFLDMPPGTGDAQITSAQSIPITAGVCVSTPQTVSLDDSKRALDMFNKLHIPIAGVIENMSGFLCPDNGKEYDIFGKGTAEDMAKAYKSEVLAQIPIEMIVREGGDEGKPVSFYHPESVSAKRYLMAAEKIWQFIEKINNEGGADNSAIQPVMNGKSACSH

SEQ ID NO: 16404 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEGARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 16405 - protein, 552 aa, Zea mays
MVSSPQANKFPLRKQISSPSSSCMAPHVLLVLVILLYLVRTLRPWRSRRNSTCCTPSLPPGPVPWPVVGNLPEMMLSDKPAFHWIHHIMKEAGTDIACIKLGGVHVIPISCPKIALEVLSNQDANFASRPLTFASKTFSTGYRDAAMSHCGDHWKKMRRVLASEIVCPSRHRWLHDKRADEADNLTRYVYNLATKAGSSGAVDVRHIARHYCGNVVRRLMFNTRYFGKPQPDSGPGPLEVQHVDAVFTSLGLLYSLCVSDYLPWLLGLDLDGHEKMVKEANERVTRLHDAVIDERWRLWKSGDRRELEDFLDVLIMLKDAEAGRPVLSIEEVKALLMDITFASMDNPSNAVEWALAEMVNNPTMLKKAVDEIDSVVGQERLVQEHDIPRLNYTKACIREAFRLHPVAPFNVPHVAVADATVAGYRIPKGSHVILSRTGLGRNPDVWDDPLRFDPERHIPLSPEMEVSLVERDLRFISFSTGRRGCIAAALGTDMTIMLFARLLQGFSWSKMTGVAAIDLSESRHNTFMARPLVLQAKPRLPAHLYPGILLCK

SEQ ID NO: 16406 - protein, 236 aa, Geobacter metallireducens GS-15
MRSAGQIVAEILDILRSEVRAGVTTLFLDGLAESEARKRKAVAAFKGYGGFPYALCCSLNEQVVHGMPSKRELVEGDIVSLDFGVVYSGYYADAAITVPVSKVTAQAERLVKVTEESLYCAIEAAVPGNRLSDISHAVQGYVERHGFSVVRDFVGHGIGKKLHESPQVPNFGEPGRGVRLKPGMVLAIEPMINERSYQVKVLADGWTAVTCDGGLSAHFEHTVAITEHGPEILSKL

SEQ ID NO: 16407 - protein, 584 aa, Synechococcus sp. WH 8102
MLRALLLILGLCISSTSAAAAPVSRDDPESADPGQAAISTAAGDAVVVTANPRASRAAVAVLKAGGSAVDALVSAQAVLAVVEPQSSGLAGGGFLMHWDARQQQLQVLDGREVAPLSSRPDDLLQPSGEPLPWREATSRPQAIGVPGTVALLWDVHQQHGRLPWATTLQPAIRLARDGFRPSPRLRRSIGIAQRIGVDHSPAFQALYLPGGQPPPANRPFRNPALARTLELLAKDGGPSFYNGELAQQILAGMAALQTDQPDFRGWSPADLAGYAVVQRSPLCHRLRSYRLCTVPPPSSGGLAVLQTLALLNQSNALSGPADPQTWRLLARAQAWADADRLYWVHDPKDGAIPTGPLLDPVYIQSRAIALQTSPAARPTPGLPPGLAAYPYALPEQSREQGTTHLAIVDGEGNLAAYTSSVETVFGSRHLVAGMVLNNQLTDFAFRPSINGQPVANRRRPGRRPVSSMAPMIVFERGQPLLSVGSPGGRSIPHVLSRVLLASLIWREPPARAVGLPHLSRRRNGLVLEQDPPLPWPVALDQLTPGDQPIRSQRLGSGTALLQKINGRWHGAADPRREGTALSAD

SEQ ID NO: 16408 - protein, 286 aa, Solanum lycopersicum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWNDHWIFWVGPMIGAALAAIYHQIIIRAMPFHRS

SEQ ID NO: 16409 - protein, 412 aa, Burkholderia thailandensis E264
MGDMLRSTTMASAFPALAQRVNGAPLAYLDNAATTHVPQPVLAAIRGFDEHDRANIHRGVHTLSQRATDAYERSRDTLARFVGASDDHLLVFTSGTTDSLNLVAHGLSLAGHTRSVLREGDEIVVSALEHHANLVPWQMAARRCGATLRILHPDSHGRLHVQDLERLLTPRTRVFAVTACSNATGERPPYEALLAAARAAGALTVLDAAQAVGHEVPDLSKLACDFMAFSGHKMYGPMGTGALVGRRDALERLVPLRFGGDMVSWVGETDATFAALPARLEGGTPNVAGAVGIAAAADYIDAIGRTLIDAHVRALRDHAAAGLAALDGVTVLAPQSPSAIVSFVADDAHPHDIGTLLDERGIAVRTGFHCAQPLLDRLGCGPTTRASFALYNTHDEVERLVAGVAQALKVLR

SEQ ID NO: 16410 - protein, 237 aa, Physcomitrella patens subsp. patens
MRGILIDWLVEVGEEYKLVPDTLYLTVSYIDRFLSCNIVTRQRLQLLGVSCMLIAAKYEEICAPQVEEFCYITDNTYQREEVLEMERKVLMELKFELTTPTVKSFLRRFIRAAQATCKAPNLILEFLGNFLAELTLTEYVFLGFLPSMIAASAVYMSKLTLDPSTRPWDVTLQHYTGYKASDLEKCVRLIHDLQRNTKNCTLPAIREKYRNHKFKCVATLTPPSVLPPEFFKDAECC

SEQ ID NO: 16411 - protein, 307 aa, Physcomitrella patens subsp. patens
EPLSITDLALPPRHGSDVRVAYQGVPGAYSEAAAAKAYPRCEAVPCDQFEAAFQAVELWLVDRAVLPIENSLGGSIHRNYDLLLRHRLHIVGEVQLGVHHCLLGLPGVKKEELLRVVSHPQALAQCEHTLVKLGVAREAVDDTAGAAQFIAAHQLRDTGAVASARAAEIYGLEILMDGIQDDLDNVTRFLMLAREPIIPRIDRPFKTSIVFTLEEGPGVLFKALAVFALRSINLTKIESRPQRKRPLRVVDDSNNGTAKYFDYLFYVDFEASMADVRAQNALGHLQEFATFLRVLGSYPMEVSPMRA

SEQ ID NO: 16412 - protein, 300 aa, Campylobacter upsaliensis RM3195
MSSIAIIGAGKWGSALYHALNTKNTCLISSPTPREMPHFIPIKEALKCDYLIFALSAQALHTWLKTHFKNQNAKVLIASKGIEAGTGLFLDEIFMEFLDENQICVLSGPSFATEVENHLPTALMINGKNLALCKEFANFFPSFIKTYIDDDVRGAEICGAYKNVLAIASGICDGLKLGNNARASLISRGLIEMRRFGKFFKAKEETFLGLSGAGDLFLTASSMLSRNYRVGLMLAQGKNLREILQTLGEVAEGVETAFAIEKLAKKNQIYTPIVSEVVSILQGESVRNSVEKLLKQKDWI

SEQ ID NO: 16413 - protein, 823 aa, Coccidioides immitis RS
MKARGKVRIPRTGVMSRGGTADFDTLWNVLASSMSEIHTKNASSLSFEEIYRSAYKAVMKKQGLVLYNKVIEFERTLLRDNLRKKITDLITPLLLPNTELANAMEQENERRVVGERFLSKIRDVWEDYQLCMGMIADVLMYMDKSVVAEHRSPSLYVASMCSFRDIVLRLGLEMDSQASVASVLQSTILFLIQLEREGIIIDRPLIRHCIYMLEGLYETEEEDESTKLYITSFEPAFLDSSRGFYETEGQKLLSTTDAPSFCKRAVTRIREEQERCHHTLSISTEPKIMWVIDEFLLKQNIPEIIKMEGSGVKEMLDNDRLADLAIIYDLISRIDLQKTALTQEVQARIIELGNQINKAAKEYLQGPQPTSNGGQAQSNGAKAPEEQKSPASLQTAAAIKWVDDVLQLKKRFDHVWENAFRKDQGMQASLTKSFSDFINVNPRSAEYLSLFFDENLKKGIKGKSEEEVDILLENGITLLRYIRDKDLFETYYKKHLSRRLLMKRSVSMDAERQMISKMKMEVGNTFTQRLESMFKDMAISEDLSSSYKDHISQSNGPDPKRIELEMSILTSTMWPMEIMGKDSASHAPCNFPKNIDLLKQSFESFYLGKHSGRKLTWQAGMGSADIRATWVRPNGKTERHDLNVSTYAMIILLLFNDLPASESLTFEEIQARTNIPTHDLIRNLQSLAVAPKTRVLKKDPMSKEVKPTDRFYFNEKFQSKFTKIKIGVVSSSGNKVETKDERSETEKKMNDERGGSVEAAIVRIMKQRKRLAHSQLVNEVISQLASRFVPNVDMIKKKIESLIDREYLERLPDVEPASYGYIA

SEQ ID NO: 16414 - protein, 318 aa, Listeria monocytogenes
MSNEYFDPKLKIFSLNSNRELAEEIAKEVGIELGKSSVTHFSDGEIQINIEESIRGCHVYVIQSTSNPVNQNLMELLIMIDALKRASAATINIVMPYYGYARQDRKARSREPITAKLVVNLIETAGATRMITLDMHAPQIQGFFDIPIDHLNAVRLLSDYFSERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEEKWIDKMEQLSVAALLGEAIVRVHENASVSSLFE

SEQ ID NO: 16415 - protein, 202 aa, Carica papaya
FGGVYRGVYDAQDVAVKVLDWGEDGFATAAEAAALRTSFRQEVAVWHKLDHPNVTKFIGASMGTSNLKIPPKDATSDGHNPLPSRACCVVVEYLPGGTLKKFLIRNRRKKLAIKVVIQLALDLSRGLSYLHSKKIVHRDVKTENMLLDTHRTLKIADFGVARVEAQNPRDMTGETGTLGYMAPEVLDGKPYNRKCDVYSYGV

SEQ ID NO: 16416 - protein, 446 aa, Rhodococcus sp. RHA1
MDIARLNFSHGDHTDHEANYRRVRAAADNTGRAVGILADLQGPKIRLGRFADGAAVWTAGEQVRITVEECEGTHDRVSTTYTHLAQDARPGDRLLVDDGKIALTVIDIDGNDVVCRVTEGGPISNNKGVSLPGMNVSVPALSGKDIDDLEFALRLGVDLIALSFVRAPTDIDRVHEVMDRIGRRVPVIAKIEKPEAVDDIEAIVRAFDAVMVARGDLGVEVPLEHVPLVQKRIVQIARENARPVIVATQMLESMIDNSRPTRAEASDVANAVLDGADAVMLSGETSVGAYPIETVATMARILSAVEHQSTTVPDLTHIPRTHGGVLSFAARDIGERLNATALVAFTQSGDTARRLARLHTPLPLLAFTPVPQVRNELALTWGTETFLVDPVASTDEMIRQVDTALLRLGRYQRGDLVVIVAGSPPHTVGSTNLIHVHRIGEDDFTK

SEQ ID NO: 16417 - protein, 401 aa, Prochlorococcus marinus str. MIT 9301
MTPERLGLLWGITVFAGACARLFSSFTGFPSVVLLLLSGLLIGRSGLGLVEPLDLGQGLETIVGLLVCLVLFEGGLNLKLPEGNIRNTVLKISLVRLFISLSAGIFIAHWLAGLSWQVAGIYSAIVLATGPTVVSPLVEQIKLASPLSEVLKAEGLLLEPIGAVLALLLLELTLGDLRGINDVFIALMQRLGGGVLIGLSAGWLLSEILKKIKNEASFGIELQVTLGFIFLVYGICEYFLPESGLPASVAAGFIVGKREVIDKERLDNLIGELAQLAITVLFPLLAADVSWGELSPLGWGGVVCVFMLMVIVRPISIWIATIGRDLNLKEKIFLAWLAPRGIVTAAVASLFSIRLEQAGILGAGRLQGLVFLTILMTVGIQGLSAKPLVNRLKLGQKNNFD

SEQ ID NO: 16418 - protein, 364 aa, Rhodococcus sp. RHA1
MAPQTFKIASIPADGVGKEVVAAGRRVLDVLAEQSGGRFAFEWEEFPWGCGYYEQTGKMMADDGLDTLKAFDAIYFGAVGWENVPDHISLWGLRLNITQNFDQWANVRPVKFLPGVQSPLRKADDTELDWIVVRENSEGEYAGLGGRNLSGRGPGNEVALQTALFTEKGCERIMRFAFDLARTRTVKKVSSVTKSNAQQYGMVLWDEVFNRVALDYPDVATESVLVDAMSAKFILHPEDLSVVVASNLNADILSDLGSALAGSLGIAASANLNPERRFPSMFEPVHGSAPDIAGQGISNPIGAIASAALMLDHFGLHDEARRVEAAIEAATASGALTRDIGGSSDTDAVTEAIVHALQTALTPA

SEQ ID NO: 16419 - protein, 616 aa, Sulfolobus solfataricus P2
MTSVSNSDKLLRKELGLLDLTFLSLSAMIGSGWLLASLSVASIAGPSGILSWIIAGIMVMFIGLAYAELGSSIPKTGGIVRYPVYSHGSYTGFVIAFLYLLSAISTPSIEALATIEYLTNVNPTLSKLLTNSTVVNGTPVTILTLPGLLFSILLLFIYFLVNYYGIKILGKTNSAITVWKLIIPVVTFMLLFFAFKSSNFTNYGGLFPKSVASNYGGPVGMLYAIPSAGIIYSYLGFRQPIEYSGEAKNPERNVWRAIILSIVIAILIYTFLQIAFIGAINWVSAGVTPGNWSALLNSKWANSPFYSELEAEGLAIAGAWGYVLLIDAVLSPSGTGLVYTGTSARTLYGLSAEEYFPLIFKKLNSYRIPIWSLIVSLIASIIFLLPFPSWYLLVGFNSSATVLTYIMGGIGLQTLRKTAPDLKRGIKIPFASIIAPVATIVSLLIVYWSGFTTLFYIISALFIGIPIFWINYAVKILGLKKWIGISLGISQLVVNIILTIIGYYSLVLNNDNPILYFALFILMALTPLVVAYLTVNTNEKVHLKSGFWLMGLIITIYIISYPSEFGPSSNSAPIRFPYDIAIISIIGIIFHYLAVLSGFRTREIEEIIEDQKERRD

SEQ ID NO: 16420 - protein, 420 aa, Sulfolobus solfataricus P2
MMEEVLSSSLYTQQVKKLYKVGELLGLDNETLETLSQPERIIQVKIQIRGSDGKLKTFMGWRSQHNSALGPYKGGIRYHPNVTQDEVEALSMIMTWKNSLLLLPYGGGKGGIRVDPKKLTKEELEQLSRKFIQAIYKYLGSELDIPAPDVNTDSQTMAWYLDEYIKITGNVDFAVFTGKPVELGGIGVRLYSTGLGVATIAKEAANKFIGGIEEARVIIQGFGNVGYYAAKFLSDMGAKIVGISDSKGGVINENGIDVGKAMEIKEKTGSVTNYPEGRKVTNEELLISDCNILVPAALENVINKFNAPKIKAKLIVEGANGPLTADADEIMRQRGIVVVPDILANAGGVVGSYVEWANNKMGQIISDEEAKKLIVDRMNNAFNTLYDYHQKKLEDHDLRTAAMALAVDRVVRAMKARGLL

SEQ ID NO: 16421 - protein, 590 aa, Zea mays
  misc_feature (570)..(570): Xaa can be any naturally occurring amino acid
MPRDLRAVTPSPPAGAALRAPGPRNASSRISRGGSGGARSLLQLASGPELLASGSTASVPGSGNRNATLPRSPSSGLGVCVFGAGDSRSANKRKEKLLGFGDHTFRTFLDAAHWSWHFGFSQSLPLSAYSSNPERMDQYEVLEQIGKGAFGSALLVRHKAEKKKYVLKKIRLARQTDRTRRSAHQEMQLIATVRNPFIVEYKDSWVEKGCYVCIVIGYCEGGDMAEAIKKVNGNHFSEEKLCKWLVQLLMALDYLHANHILHRDVKCSNIFIARDQSIRLGDFGLAKILTSDDLASSVVGTPSYMCPELLADIPYGTKSDIWSLGCCIYEMAALRPAFKAFAAELLKHPHLQPYVLQVQLKSSPSRTTSPIYQALTDKVKKMTFVSDTADSARRRAARRSSLGSERTVTFCKPSPERNSVSSTRSIKEYTTTTQSARELSVGSSLQVDDEVTSKAVVTKTAGVLRTPSKSRAPASKTLVAARSRLDPPKTSYARTNRAELDSRTPLSKSSARTARRASLPLAAYRAPSGGRAGSFLEQLDSPDVSVNAPRIDRIAEFPLASSEEPLGAHXNKKLSCSTPPFSTRVHHERT

SEQ ID NO: 16422 - protein, 428 aa, Streptomyces coelicolor A3(2)
MPDPALNVAELLDLDRRHVWHPYGPMPGRQDPLVVESASGVRLRPADGSGELVDGMSSWWSAIHGYNHPVLNAAAREQLERMSHVMFGGLTHEPAVRLAKLLVDMSPEGLEHVFLADSGSVSVEVAVKMCLQYWRSLGRPGKHRLLTWRGGYHGDTWQPMSVCDPEGGMHELWSGVLPRQVFADAPPAEYEETYADHLRSMVERHAGELAAVIVEPVVQGAGGMRFHSPAYLRVLREACDAHDVLLVFDEIATGFGRTGALFAAEHAAVTPDVMCVGKALTGGYLTMAATLCTSRVAEGISRGEVPVLAHGPTFMGNPLAAAVACASIGLLLGQDWLAEVKRIETGLGEGLAPAAGLPGVRDVRVLGAIGVVQLDHAVDMRAATKAAVREGVWLRPFRDLVYTMPPYVTGDADVARIARAVCAAAREG

SEQ ID NO: 16423 - protein, 73 aa, Brassica napus
  misc_feature (51)..(51): Xaa can be any naturally occurring amino acid
MQNSEAKRRKIHNPKQQPLTPLPPIIGKKASSMNKPDRVYAVSHQTEMFSXDSSEYRALRRSYLLLEEDSFAL

SEQ ID NO: 16424 - protein, 337 aa, Erythrobacter sp. NAP1
MRTVLITGSAGFIGYHLAQLLLDEGFRVVGYDGMTDYYEVALKERRHQMLLQNANFSCKVGMLEDFEALHSLAMDAKPDAIIHLAAQAGVRYSLENPRAYVDANLVGAFNVMECARELGVDHLMMASTSSVYGANEDMPFAEREKTDHPLTLYAATKKANEAMAHSYAHLWNLPTTMFRFFTVYGPWGRPDMALFKFTRGILEGKPIDIYNEGEMYRDFTYVTDLVRGIRLLLDQPPVRPDSRDDITEWDSLSPAAPWRVANIGNSDKVRLMDFVEAIEAECGCKAVKNFMPMQKGDVPATWADARLLKELTGYAPETDIRTGVKHFVAWYRDYYQV

SEQ ID NO: 16425 - protein, 362 aa, Lactobacillus reuteri
MKRYLILEDGTVYTGEGFGATKATLGEVVFTTGMVGYQEAITDQSFANQILVFTNPLIGNYGINSEDNETLYPQIKGVICHHVARVPSNWRMTDSLPNFLAKHHIPGLQGIDTRELVRKLRQYGTLRGIMTDNVTDIKDKLEQLKQTSPTQNIISKVSTKESYANPGTKRTVVVLDFGMKNSILRELNKRNCNAIVLPYNASISEIMVFNPDGILLSNGPGDPLEMTTIAETVAELEKHVPIFGICMGHQIFALANGAKTYKMKFGHRGFNHPVRNLKTGKIAFTSQNHGFAVDPSSIDDTDLQITHLEVNDGTVEGLQHSKYPAFSVQFHPDAAPGPHDAEQLFDKFMALIDSNKEVLTYA

SEQ ID NO: 16426 - protein, 572 aa, Synechococcus sp. WH 8102
MLSIASADRWSDPMPTTATTFEEFRQRVDYSLLQALKPDPEATSDGNDHRPRPVFSGHWVPVRPTPIPEPKYVAHSFILFAELGISDDLAHNSDFTRLFSGDASVAAEPMHSWGWATGYALSIYGTEYIQQCPFGTGNGYGDGRAMSIVEGVFEGQRWEMQLKGGGPTPYCRGADGRAVLRSSVREFLAQEFMHALGVPTSRSLTLYRSEAETVRRPWYSDHSRSFDPDVMVDNQAAISTRVAPSFLRVGQIELFARRARDNAHPNAHDELRLIVQHLIDRNYRAEIDATLPFHQQVLELARLFRGRLTALVANWMRVGYCQGNFNSDNCAAGGYTLDYGPFGFCELFDPRFQPWTGGGAHFSFFNQPAAAEANYRMFWRSLRTLLEGDDAAQRELDQLNEGFAVAMQQQLEAMWASKLALPAYDETLVTELLQLLVAAKADYTKAFRLLSTIPDHVAELHPSFYLPSSEDLDQRWQTWLQRWRERITANGDLEETSAAMRRVNPAITWREWLIAPAYQQAEQGDNSLVLELQTLFSSPYSAPSTELAARYDQLRPQQFFSAGGIAHYSCSS

SEQ ID NO: 16427 - protein, 499 aa, Marinobacter sp. ELB17
MKVAAIFGFKNPEIKALHLTWIAFFITFYVWFNMAPLASSMLKSVNWLTADDLRLFAICNVALTIPARIIVGMALDRFGPRRVFSILMVLMSIPALTFAFGNTMTQLLVSRLVLSSIGASFVVGIHMTAMWFKPRDIGFAEGFYAGWGNFGSAAAALTLPTIALQMYGGDDGWRWAIAQSAIVMALYGVYYWFAVTDGPVGTVHRKPRKASALEVSTWGDMVKLILWTIPLIGVLAILVWRIQNMGYLSVTGAVVAYVVICSIVCYQIAQILRVNVPILKKGVPEDDKYPFNSVAALNSTYFANFGAELAVVSMLPMFFEETWSLGAAAAGMVAASFAFVNLVARPMGGLVSDRMGNRRFVMLSYMFGIAVGFALMGMLNPSWPLIIAVGVTVFTSFFVQGAEGATFGIIPSIKRRLTGQISGMAGAYGNVGAVVYLTIFTFVTPSQFFYIIAAGAFVSWVLCFMWLKEPESGFADEYAVSSVDLQIEEEDRIRTASLG

SEQ ID NO: 16428 - protein, 180 aa, Oryza sativa
MGDYTIQISTKLIDQLARDDEKIKKKTRKPKPKKTVKQHQQEPQDNSRELPASEPKAPPGWPLQPPMYLPVTPAPPPPPPAFSELEAIRAVLEESEKVQEKLNKQHAGMRDELIKKSKDLRDKEFKLPYQNPTPCTEERSNCRQCYVSNAQDPLKCAEAVKRFEACVRLARQRGNTKVAQ

SEQ ID NO: 16429 - protein, 309 aa, Helicobacter hepaticus ATCC 51449
MRGFKIFSGSAHTLFSNEVAKCLDISLSKTTINRFSDGEINVQIGESVRGKDIFIIQPTCAPANDHLMELLIMTDALKRSGAKNINAVIPYFGYARQDRKVVPRVPITAKLVANLIEQSGIHRVITMDLHAEQIQGFFDIPVDNLYGSIVFRDYLKTKSFKNPIVASPDIGGVARARHFADRIGMDLVIVDKKRERANESEVMNIIGDVDGKDVILIDDMIDTAGTMCKAADVLKSRGANSVIALGTHPVLSGPALERIAKSALDEVVVTNSIPLRVAHPKIKVLSVAPLFAEVIRRICHNESVNSLFF

SEQ ID NO: 16430 - protein, 261 aa, Marinobacter sp. ELB17
MKNDAYASWLEKLLPIVHHAGNAIMDIYAGDIDVRTKSDASPVTEADELAEALILPALQALDRRIPIVAEEQAAAGNTPKTGDRFWLVDPLDGTKEFINRNGEFTVNIALIENGVPVLGVVLAPALKRLFAGGRGLGAFIEENGERKAIQCRPVPAAGLTVVASRSHGDEAALARFLAGAKVASQTSAGSSLKLCLLAAGEADVYPRLGPTMEWDIAAGDAVLRAAGGRLITLDNKPMVYGKPNFANPHFSAWGLRAGDRS

SEQ ID NO: 16431 - protein, 565 aa, Arabidopsis thaliana
MASTPKLTSTISSSSPSLQFLCKKLPIAIHLPSSSSSSFLSLPKTLTSLYSLRPRIALLSNHRYYHSRRFSVCASTDNGAESDRHYDFDLFTIGAGSGGVRASRFATSFGASAAVCELPFSTISSDTAGGVGGTCVLRGCVPKKLLVYASKYSHEFEDSHGFGWKYETEPSHDWTTLIANKNAELQRLTGIYKNILSKANVKLIEGRGKVIDPHTVDVDGKIYTTRNILIAVGGRPFIPDIPGKEFAIDSDAALDLPSKPKKIAIVGGGYIALEFAGIFNGLNCEVHVFIRQKKVLRGFDEDVRDFVGEQMSLRGIEFHTEESPEAIIKAGDGSFSLKTSKGTVEGFSHVMFATGRKPNTKNLGLENVGVKMAKNGAIEVDEYSQTSVPSIWAVGDVTDRINLTPVALMEGGALAKTLFQNEPTKPDYRAVPCAVFSQPPIGTVGLTEEQAIEQYGDVDVYTSSFRPLKATLSGLPDRVFMKLIVCANTNKVLGVHMCGEDSPEIIQGFGVAVKAGLTKADFDATVGVHPTAAEEFVTMRAPTRKFRKDSSEGKASPEAKTAAGV

SEQ ID NO: 16432 - protein, 270 aa, Shewanella sp. ANA-3
MKPEELIDEVIAIATDAGRTIREIYLKGNFERETKSDNTPVTSADLAANQLICERLAALTPDIPILSEEAADIPLSVREGWKRYWLVDPLDGTGEFIAGSGDFSVIIALVEHNRPVMGVVYVPMTQVCYYAIAGLGAYKRTDKQEVRISSRQIQHREQVSLRLAVSRRQDPQSVLTLFNQPKHCELVVMGGAALKSCLVAEGRADCYVRVGPTGEWDTGAAQIIIEEAGGQLMDTELQPLTYNERETLENPNFIVVGAPNLEWDKILIGE

SEQ ID NO: 16433 - protein, 305 aa, Saccharomyces cerevisiae
MAKDIEISASESKFILEALRQNYRLDGRSFDQFRDVEITFGKEFGDVSVKMGNTKVHCRISCQIAQPYEDRPFEGLFVISTEISPMAGSQFENGNITGEDEVLCSRIIEKSVRRSGALDVEGLCIVAGSKCWAVRADVHFLDCDGGFIDASCIAVMAGLMHFKKPDITVHGEQIIVHPVNEREPVPLGILHIPICVTFSFFNPQDTEENIKGETNSEISIIDATLKEELLRDGVLTVTLNKNREVVQVSKAGGLPMDALTLMKCCHEAYSIIEKITDQILQLLKEDSEKRNKYAAMLTSENAREI

SEQ ID NO: 16434 - protein, 677 aa, Arabidopsis thaliana
MDSEGVLMPLIHKHRMMPWNDLRRGDCCGRFESICDGYYCKICDIFVHKKCGESSEYIEHPSHPNHTLQLLSTRGNSHDCDLCGKNIGDLFYRCEICDFDMDLYCAKYPPPEVINISKTHHHKLNLLKELIQFDCDANVALMINGFPYKCYECDLFFHKDCVWHPPEVNHTLEVNHSYHSLHPLKLHTGQLPNYSDRKCRLCAKEIEVGLFYHCSLCNFTLDMSCVLNPPQRYLWNLKAHDHQLTLLPSLRSFLCSACGLNGDRSPYICVQCDFMIHQVCLHLPRVININRHDHRVSRTSVLGVVNSVCGVCRQKVDWTCGGFSCPRCPGYAAHSLCATREDVWNGKELEGVPEEIEDIEPYVVIDDNTIQHFSHKEHYLRLHVNSVLCDDNKRCSACTHPICLQSFYGCMDCDFILHQNCAGFLRMKWHVLHNERLTLVTNETEVFKCYACERWSNGFRYQQGYKSFDVRCGSISEPFFHPSHPDHPLYCILPYGKIFCNGCYKFKYGMLVCVEYECNHLICFNCATLPPVVKHRVDDHPLSLCYGEKASGICWCDICEAKADPEIWFYTCKDQRASLHTSCVLGDFSGLMPGSTLKSASNSSEVLLNNIVSRPFCSFLELMPGSTLESAGKSVEVGLNKSTSRPFCISCKLHCIFPIILKRLGTSDEYFCSILCI

SEQ ID NO: 16435 - protein, 233 aa, Candida glabrata CBS 138
MDQNIDLNNYVSMLDAIISVSDPDKVSPKKIRKALEQLFSVSLENKKKEVNELIVARFQILQADPHILVSNEEFQNLKMIRGNYDALLSSKSMEKKHKLTESSKKTRIQVKKKKSKKSSKDGEKKVANPNSNAINSMKLRLSDDLYKFLGERELPRTQVVKQVWDYIKEHNLQSPEDRREIICDDRMRPIFGDKMTMFALNKILSKHLTKIEPKSEEADNSRLSVKLEDGTQA

SEQ ID NO: 16436 - protein, 670 aa, Glycine max
MQFPSGAGGGGGGGGAGGEIHQPHHYRPQWFVDERDGLIGWLRSEFAAANAIIDSLCHHLRVVGDPGEYDMVVGAIQQRRCNWNQVLMMQQYFSVADVAYALQQVAWRRQQRPLDPMKVGAKEVRKSGSGYRHGQRFESVKEGYNSSVESYSHDANVAVTGGTEKGTPVVEKSEEHKSGGKVEKVGDKGLASVEEKKDAITNHQSEGSLKSARSTEGSLSNLESEAVVNDGCISNSKGNDLHSVQNQSQSQSLSNIAKTFIGNEMFDGKTVNVVDGLKLYDDLFDSTEVANLVSLVNDLRVSGKKGQLQGSQAYIVSRRPMKGHGREMIQLGVRIADAPAEGENMTGASKDMNVESIPSLFQDIIERMVSSQVMTVKPDCCIVDFYNEGDHSQPHSWPSWYGRPVYVLFLTECEMTFGRVIASEHPGDYRGSIKLSLVPGSLLVMQGKSSDFAKHALPSTRKQRILVTFTKSQPRKSLSSDAQQLASAVASSHWGPPPSRSPNHVRHHVGPKHYATLPTTGVLPAPPIRPQMAAPVGMQPLFVAAPVVPPMPFSAPVPIPAGSTGWTAAPPPRHPPPRVPAPGTGVFLPPSGSGNSSQQLPASTLAEVNPSTETPTMPEKENGKINHNSTSASPKGKVQKQECNGHADGTQVEPALETRLDSNDKAAPSH

SEQ ID NO: 16437 - protein, 428 aa, Prosthecochloris aestuarii DSM 271
MKGHIDTDFDRGHIWHPYTSMRDPLPVYPVARASGVTIELEDGRKLVDGMSSWWAAVHGYNHPVLNHAVTRQLDSMSHVMFGGLTHEPAVKLAGQLIELTPEPLQKVFFSDSGSVSVEVAIKMALQYWQAAGLSRKRRLLTVRSGYHGDTFGAMSVCDPDTGMHSLFTGMLAEQLFAEAPQCGFDAAWNENGIEDLHQKLRQHHEAVAAVIIEPVVQGAGGMRFYSPHYLIRLRELCDEYGVLLIFDEIATGFGRTGKMFALEHAGVVPDIMCVGKALTGGYMTLAATLAADHVADTISSAEPGLFMHGPTFMANPLACSVASASIDLLCSRDWEQEVQDIQGALQDGLSPCSRFSGVHDVRVLGAIGVVELCQPVDMAAVQNFFVERGAWVRPFGRLIYLMPPFIISPSEMVILTRAVRDAVRLIAS

SEQ ID NO: 16438 - protein, 166 aa, Candida glabrata CBS 138
MEEVDSQGDLPRDVRLLHLLLASQSIQQYEDRVPLQLMDFAHRYTRGVLMDAMVYNDYASENAPGGSNAAANATNAKNAPKANTLGSGMTSNGGKNINVEDVRLAIAARTQYMFKPTAPKELLLQLAAERNKKALPQVMGSWGVRLPPEKYCLTAKSWDLDEKEEK

SEQ ID NO: 16439 - protein, 279 aa, Prochlorococcus marinus str. MIT 9301
MRHFADLLLNKNNSKANDQVPFIQRRRGIEIKSSREINLMKKSSRIVATVLREINDLIKPGMSTKDLDDFAEKRIKSFGAVPSFKGYHGFPSSICSSINNEVVHGIPSKNKIIKNGDLVKIDTGAYLDGFHGDSCISICVGEVSPKAQKLSDIAFKALYAGLSKIKAGNTLLDVAGEIEDVVVKNGFSVVEDYTGHGVGRNLHEEPSVFNFRTKELPNVVLREGMTLAVEPIVNEGTKFCKTLNDRWTVITKDGKLSAQWEHTIVVLKDGIEILTDRDF

SEQ ID NO: 16440 - protein, 426 aa, Yersinia kristensenii
MGVDLNNCRIGIIGLGYVGLPLAVEFGKKFHTLGFDINSKRIEELSEGVDFTLECSSEELKDASFLTYSSDVERLKGCNVYIVTVPTPIDDYKQPDLTPLIKASETLGKVLKVNDVVVYESTVYPGATEEVCIPVLEKVSGLKFNQDFYAGYSPERINPGDKEHRVTTIKKVTSGSTPATAEFVDDLYKSIITAGTHKASSIQVAEAAKVIENTQRDLNIALINELAVIFNKLGIDTEEVLKAAGTKWNFLPFRPGLVGGHCIGVDPYYLTHKAQAIGYHPEVILSGRRINDSMSKYVASQLIKAMIKKRVQVEGARILLMGLTFKENCPDLRNTKVVDIISELKEYNVIADVYDPWVNAEEAKHEYGINILKNMPINQYDGVIFTVAHSQFKALSNDDIKGLVKPNGVIYDLKYIIDPKIVDIRL

SEQ ID NO: 16441 - protein, 333 aa, Yersinia kristensenii
MRDNQKTWLITGVAGFIGSNLLESLLLLNQKVVGLDNFATGHQYNLDEVQSLVTEDQWAQFTFIEGDICDADVCQKAVVGVNYVLHEAALGSVPRSIADPLTTNAANITGFLNMLVAARDKKVDSFTYAASSSTYGDHPALPKVEENIGNPLSPYAVTKYVNELYAQVFARTYGFKTIGLRYFNVFGKRQDPNGAYAAVIPKWTSAMINNDDVFINGDGETSRDFCYIENVVQMNILAALANDAAKNEVYNVAVGDRTTLNELFNALKNALRNNNVLYEKSAVYKDFRSGDVRHSQADISKAKRSLGYIASHNIFDGVEEAMPWYIRFFDVKQ

SEQ ID NO: 16442 - protein, 355 aa, Gibberella zeae
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQVIMW

SEQ ID NO: 16443 - protein, 332 aa, Gossypium hirsutum
MRKIMGAKVLFFFALLSFSAVSAFAQDEEDQGLVMNFYKDSCPQAEDIIKEQVKLLYKRHKNTAFSWLRNIFHDCAVQSCDASLLLDSTRRSLSEKETDRSFGLRNFRYIETIKEAVERECPGVVSCADILVLSAREGIVSLGGPYIPLKTGRRDGRRSRADVVEEYLPDHNETISGVLDRFAAMGIDTPGVVALLGAHSVGRTHCVKLVHRLYPEVDPALSPDHVPHMLHKCPDQIPDPKAVQYVRNDRGTPMVLDNNYYRNILDNKGLLIVDHQLAYDKRTRPYVKKMAKSQDYFFKEFSRAITLLSENNPLTGSKGEIRKQCNLANKLH

SEQ ID NO: 16444 - protein, 515 aa, Corylus avellana
MAKLILVSFSLCLLVLFNGCLGINVGLRRQQQRYFGECNLDRLNALEPTNRIEAEACQIESWDHNDQQFQCAGVAVIRRTIEPNGLLLPQYSNAPELIYIERGRGITGVLFPGCPETFEDPQQQSQQGQRQGQGQSQRSEQDRHQKIRHFREGDIIALPAGVAHWCYNDGDSPVVTVSLLHTNNYANQLDENPRHFYLAGNPDDEHQRQGQQQFGQRRRQQQHSHGEQGEQEQQGEGNNVFSGFDAEFLADAFNVDVDTARRLQSNQDKRRNIVKVEGRLQVVRPERSRQEWERQERQERESEQERERQRRQGGRGRDVNGFEETICSLRLRENICTRSRADIYTEQVGRINTVNSNTLPVLRWLQLSAERGDLQREGLYVPHWNLNAHSVVYAIRGRARVQVVDDNGNTVFDDELRQGQVLTIPQNFAVAKRAESEGFEWVAFKTNDNAQISPLAGRTSAIRALPDDVLANAFQISREEARRLKYNRQETTLVRSSRSSSERKRRSESEGRAEA

SEQ ID NO: 16445 - protein, 414 aa, Synechococcus sp. WH 8102
MTAAPLPSTGAVTGLGETLAFFRDPSFSQRRFSELGDVFETKLLAQSIVFIRGERAIGDLLKQEDCLQGWWPDSVRQLLGSKSLANRSGADHKARRRVVGQLFSSAALSRYTPAIEALVNDLANELQQAEGPIPLAARMRRFAFSVIATTVLGLEAENRDALFADFEIWTRALFSIPLALPGTPFARALAARQRLLARLKTVLQTNNNRQQGGLDLLSGGLDEAGLPLDDDDLVEQLLLLLFAGYETTASSLSCLFRALLLNPEVEQWLMQDLNNHERPSRLDATVLEVMRMTPPVGGFFRQNTQSIELADVAIPQGRVIQVVLSSSSTTNQIDLETFRPQRHLDGSFQQTLLPFGGGERVCLGKALAELEIRLMAMGLLQRVQLHLEPDQDLNLQLIPSPTPRDGLLVRATAR

SEQ ID NO: 16446 - protein, 198 aa, Helicobacter hepaticus ATCC 51449
MLVTKPAPDFTAEAIKADGTFEDSFNLYKNIGKNGAVVFFWPKDFTFVCPSEIIAFDKRVKDFEARGVKVIGVSIDSKEVHFAWRNVPVNQGGIGAVTFPMVSDITKQISRDYDVLFNGAVALRGSFLIDKNKVVRHAVINDLPLGRNVDEMIRMVDAMLFVEEHGEVCPAGWNKGDEGMKANAKGVAEYLAKNADKL

SEQ ID NO: 16447 - protein, 264 aa, Marinobacter sp. ELB17
MGRFDGRAAIVTGAGSGIGRATALRLACEGAQVIMADTSELGLAETGNLMPEGAEYLRRLVDVADEAQVKELVSDAMDAFGKIDILCNIAGIASTGKGHPPVIENERDEWDKVLSVNLIGTMLLIKHVAPHMQARKLGSIVNTASIAGIRSGAGGNAYSASKAGVINLTMTAACDLGDHNIRVNAVCPGLVETGMTRAVFDYARTHEKAHKLGARCELRRYGDPEEIAAAILFFASDDASYITGQALPVDGGNTASLNLPGMKV

SEQ ID NO: 16448 - protein, 292 aa, Saccharomyces cerevisiae
MVLTRQVLEEVENTFIELLRSKIGPLVKSHAGTNFCSYDDKANGVDLVTALDKQIESIIKENLTAKYPSFKFIGEETYVKGVTKITNGPTFIVDPIDGTTNFIHGYPYSCTSLGLAEMGKPVVGVVFNPHLNQLFHASKGNGAFLNDQEIKVSKRPLILQKSLIALEGGSERTEGSQGNFDKKMNTYKNLLSESGAFVHGFRSAGSAAMNICYVASGMLDAYWEGGCWAWDVCAGWCILEEAGGIMVGGNCGEWNIPLDRRCYLAIRGGCESMEQKRFAESFWPHVAGELEY

SEQ ID NO: 16449 - protein, 255 aa, Marinobacter sp. ELB17
MSNPLFDMTGKVALITGSTKGIGLSIAEEMARLGAKVVISSRKADACEQVANELKGKGYEAIAIPCHVGKKDDLQNLVNKTNEAWGSIDVLVCNAATNPVYGPSSEMTDEAWDKIMDTNVKGTFWLTNMVLPQMAEKGEGAVVLLSSIAGIRGNTTIGTYGVSKAAEAALARNLAVEWGPKGIRVNSIAPGLIKTDFARTLWEDPVRVKRAEDKTPLRRIGDPVDIAGLAVFLSTKASAYITGQTIVADGGETIC

SEQ ID NO: 16450 - protein, 225 aa, Brassica napus
MMNSIFGKRKTPAELLRENKRMLDKSIRDIERERQGLQTQEKKLITEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAAPAAKNKVVQAEAAGAEDGGGIDSDLQARLDNLRKM

SEQ ID NO: 16451 - protein, 842 aa, Anabaena variabilis ATCC 29413
MRAVLMAGGSGTRLRPLTCDLPKPMVPILNRPIAEHIINLLKRHHITEVIATLHYLPDVLRDYFQDGGDFGVQMTYAVEEDQPLGTAGCVKNIAELLDETFLVISGDSITDFDLGEAIAFHKQKQSKATLILTRVPNPIEFGVVITDEAGKIKRFLEKPSTSEIFSDTVNTGTYILEPEVLEYLPLNTECDFSKDLFPLLLAKDEPMYGYVAEGYWCDVGHLDAYREAQYDALERKVKLDFAYRENSPGLWIGQNTYIDPSAHIEAPVVIGNNCRIGARVQIEAGTVIGDNVTIGADANLKRPIVWNGAIIGEEAQLSACVISRGTRVDRRAHVLEASVVGSLSTVGEEAQISPGVRVWPSKKIESGAILNINLIWGNTAQRNLFGQRGVQGLANIDISPEFAVKLGAAYGSTLKPGAKVTVSRDQRNVSRMVTRSLIAGLMSVGVDIQNLDATAIPIARTVIPTMGVAGGIHVRVHPDRADYILIEFMDHKGINISKAQEKKIEGAYFKEDMRRALTHEIGDVAYPSQVIDLYCTAFEKLLNVSTLHNSRAKVVIDYVYAVSGAVLPQMLDKFGADAVVLNASLNKNAVTTTDREGLLTQLGHVVEALKANFGVQVSANGEQLILVDESGYPIRGELLTALMVDMILTSNPRGTVVVPVHASSAVEQVARRHDGRIIRTKANATALMEACQKNPNVVLGGSGETGFIFPQLHPGFDSMFCIAKIIEMLTIQERSLATVRSELPRVIYRTHTIRCPWSAKGALMRYLVETHPAQNLELIDGVKIRQPFDDSWLLVLPDASEPLVHLYANSHERDWVDETVRDYRSRVQSFVERQQEYHPAEV

SEQ ID NO: 16452 - protein, 468 aa, Prosthecochloris aestuarii DSM 271
MKFGGTSVGTASAMRRAMAIVADVKKKKSAPLVVLSACSGMTNLLIEIAGAAGEGRLGDALAMAEEVRLHHLSIAGELVKDPVRSAALQEKIEGYVNELEMLVKGVDIVGELTARSFDTFCSFGELLSTTVFSEAMLDAGHACSWVDARSVMITDDNFGTARPLEGRCEENVHSVIKPLLDAGTIVVTQGFIGASADGKTTTMGRGGSDFTAALLGAWLPSDQIQIWTDVDGVMTCDPRIVPQARSIRVLTFSEAAELAYLGAKVLHPDTIAPAVKQNIPVYVLNSLHPDAKGTVITNDPDILDGMSYGGLVKSIAVKKGQCIVNFRSNRMLGRHGFLIEFFNVFARAGVSVEMISTSEVSVSLTVSDTAAVDGLVRELAGMGEVELEHNVATVSVVGDNLRMSRGVAGRIFSALKDVNIRMISQGASEINVGFVVEEREVPKAVENLHHEFFSHDDTRGIFETPAGK

SEQ ID NO: 16453 - protein, 629 aa, Burkholderia thailandensis E264
MTDRIRPRPSRSRAGAIAAAFFAVAAAGCANAPGPSAQNAAASASAASAASAASATPGASPSEPAELSSWVDKPGWTAQRDMIAAAHPLAAQAGQEMLKAGGTAVDAAIAAQMVLMLVEPQASGIGGGAFLLHANGKTVEAYDGRETAPAAATDRLFYGADGKPLPRAAPGARTVGVPGVLRMLELAHRAHGKLPWRRLFQPAIRLAEQGFPLGPRLAAALANDPSLASDPAARACFYDKNGAPKPAGATLRNPQLAATLKLVAAHGANAFYTGAIARDIVAKVRQAPNPGVLSVQDLARYRAKVREPLCADYRKWIVCGMPPPSAGGLVVAQILGLLEAQPDWRQIGAQKPVRNATGVEPTPFAAHQFSEAGRLAYADRAQYVADPDFVAPPGGSWTSLVERRYVAERARLIGDASAGTASAGSPSGLPPASAADRGAEPPSGSQITVVDRYGNAVSMTSTLDERFGSRLMVRGFLLNSQLLDFSPVSAEHGKPVANRVQPGKRARSTLAPELVFEKGSQRLMMALGSAGGAFAANDVAKTLVGMIDWGMTMQQAIALPNFGSRNGPTELEKGRVSDALAQALKERGHDVRVVELGSSLQGIQRINVEGQSVWFGGSDPRSDGVVSGD

SEQ ID NO: 16454 - protein, 1351 aa, Candida glabrata CBS 138
MPKSYNENDIWKIRDVFGRDLSYISSCLPSLEDYKQINLNSSDLESGYSPLHVTLRERLLQKSFLLYKRWVDDEKQMSYKIGQHILARKDREGLTPMDLYNIEFQRALKVKPQLLEYTIDNGNLKPKVIFEKVNHLDSEGIATTKSCSNNELLRSTSFLEIPQNYSDMAKIRNLGGSHLLTFGSNVNAQLGTGNKDDRQHFHETDYQQLGGDLPLDPKKFSIKEVLMSRYHCLVINSFGEVFTCGNSNRGRLGNGETNTTVSVFTKIATFETGVRHVSISNHHNLLVDGNGYIYSWGWNQYYQLGYTSSNKQGDSKHTLCKSSPKRIPYFDNINIKYVACSKVHSCALSQDNKLYLWGLNLGQMGNKKPLHVNLDISHDHNNGYIIESPLVIDLSHLQVEQVLALELVTFIRCSGNTLIVLTDFCMRTFKISTPKPKNPTRIDIFSHYTPKTISADVVDMKCSNKVGNHLFFKYASGRVGYLSLKKENVESWSKLSNELPISFSWKPNFARNNCTDFAVGYNGDIIICTYGGEIFISRNHAEFERIYSNKLITGRAVKISSDTSLGSVAIIKQDYLFMPAKYLKDTFDFDLAIYSPIYQNVGDTLSLGSLGLQCHVKETDSQLFLSSKSNISNLRYSEINGSSVNENQIKCSSYDVILNNDRGIIECYSFKSLFSLRCSKFLNAILNDGKFTVNNELFFTANETANGILQIKTHDLTTSAVYYKISVDLVHFLLTDVKPANQQRSIAILSITDNYAHGTTLRNALSSYLLGMLTNDTDENRIKSPGNHLLGDTILRLKDKTLIVDSFLLSARSNYFKGLLSNSVFCEKDNDGKYLINLEIYSYKQFDIILKYLYGVDFSDLHPHYESEDGGLTNFLESLVLADELCLEPLKCYMQVLLSQFIDGNSIIPLFIYSVRSNAEMLCLLCSTFIAIHIGVLFVKDNVQLISQNFDDSHWKILQNNISYITSEQLNHELWYNNSTDNWRSLFKNDINKFNSKFISPKDKFSPIFDIKDTLEVSSKKTSTDRRRSSTSTRPIKFKNTTMNNTSDNPHRRQSNGSVSIAEKLSASNSSDEDSQFIEVTRKPKRKSVSNIQESQTPVPKLHPPKPNILIHRKLSGDEKLLPSLISNEPIVEIPNQKKNQSEIGPKKPISFKKTSQKERIKTTTQADKQKENKTKESAWTNQKQNSSLSNPKDNQTSKLAALPSLNDSKLQKQDLKPNKKSKKKANNKQSAEFISSGNFAGLTPYLSTVHKESVTTDTTPSWTASTVSDFKQKVEAQEFEKWFQEESKRVQLELERRGSSHHDELKVLYDSSQNIPGFVIDSNVKKAGRKIKGKFKAKLKNKDENINSIQ

SEQ ID NO: 16455 - protein, 332 aa, Prosthecochloris aestuarii DSM 271
MIITVLGAGSWGTTLAVLLANKGYAVSLWAHRPDFAQELARTRENVKYLPGVTFPDGLEIAQDINAAATDADVIVAAVPSQAVRETMELLAGINLDGKLMVNVAKGIELGSGKRLSEVILETLSGVDPSMVSVLYGPSHAEEVSGLQPTTVVAASSNLDTAKRVQEIFHTRMFRVYVNTDIVGVEIAGSVKNIIAIAAGIADGIGFGDNAKAAIITRGLAEISRLSAAMGGDPMTVSGLSGIGDLVVTCLSKHSRNRYVGEQIGKGRSLDDVISHMNMVAEGVLTTKAVVELSNRLGVDMPITRTVYAMLFEHKPVEDAILDLMTRDPKPEL

SEQ ID NO: 16456 - protein, 506 aa, Wolbachia endosymbiont of Drosophila ananassae
MGIKSVVLCILDGWGNGVENSKYNAISNANPPCWQYISSNYPKCSLSACGTDVGLPGGQIGNSEVGHMNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 16457 - protein, 506 aa, Arabidopsis thaliana
MFFSKDLPSPTSVFTAYASMAGYMMMIRSMAHELIPAPLQDFIYRTLRSLFFRSSSSTLTLTIDDDNMGMNNEIYRAAQTYLSTKISPDAVRLRISKGHKDKHVNLYLSDGEIVNDVYEDVQLVWRFVTDGGDKKGGGGGVGGRGGGGGRRGGMDDDGKSEYFELSFDKKHKDLILNSYVPYIESKAKEIRDERRILMLHSLNSLRWESVILEHPSTFETMAMEDDLKRDVIEDLDRFIRRKEFYKRVGKAWKRGYLLYGPPGTGKSSLVAAMANYLKFDVYDLQLASVMRDSDLRRLLLATRNRSILVIEDIDCAVDLPNRIEQPVEGKNRGESQGPLTLSGLLNFIDGLWSSCGDERIIIFTTNHKDRLDPALLRPGRMDMHIYMGHCSFQGFKTLASNYLGLSDAAMPHRLFPEIERLIDGEVMTPAQVAEELMKSEDADVALEGLVNVLKRKRSESENCDDESKKMKIREYPTLRRHEQSMFSLENLTNGGFDKIWYFTSFF

SEQ ID NO: 16458 - protein, 325 aa, Pichia ciferrii
MSSHQFLINQTTLAAPPVHLVEKPSLINGIPDNILALIAPVIAYYSYSGFFYVIDTLEIAELYRIHPPEEVSSRNKATKFDVLKDVVLQHFIQSVVGYIFTYFDPIQYTGDEEYQAWKLQQTLPFLPFDVAYYWNMYGWSCLKIGLAFLIIDSWQYWLHRIMHLNKTLYKRFHSRHHRLYVPYAFGALYNDPFEGFLLDTLGTGIAAIVTQLTPRESIVLYTFSTLKTVDDHCGYSLPYDPFQILFPNNSIYHDIHHQQFGIKTNFSQPFFTHWDVFSNTRYKEIDEYREKQKAITIAKYKEFLHDREIAKQKKKAEIYKDKKTD

SEQ ID NO: 16459 - protein, 258 aa, Xerophyta humilis
  misc_feature (2)..(2): Xaa can be any naturally occurring amino acid
EXGRGRKLSKFALDELGSIDIWINNAGMNKGFRPLLEFSDEDINQIVSTNLVGSLICTKEAMRVMSSQAKGGHIFNMDGAGSGGSSTPLTAVYGSTKCGLKQLQGSLVTECKGSKVGIHTASPGMVLTDLLLSGSSLRNKQMFNIICELPETVARTLVPRMRVVKGSGRAIDYLTPPRILLALVTAWLRRGRWFDDQGRALYAAEADRLRNWAESRARFSFTDAMEMYTDSTWVSVFSLSVVCAFIILSTTGGSFPHT

SEQ ID NO: 16460 - protein, 205 aa, Coxiella burnetii RSA 493
MTEFKSAPAYQEAKYLTSAAEFDQLPPDQGAEIAFIGRSNAGKSSALNIITGIKGLARTSKTPGRTQMINFFALNEHERLVDLPGYGYAKVPRMVQKRWEELVDSYLKNRRCLKGLVVVMDIRHPLKEMDEDVIEWAVNYDIPIHILLTKSDKLSQNAAKKTLGEVQTAISAYGEKLTLQLFSSHDRTGLDEVKAVLSQWFRSEP

SEQ ID NO: 16461 - protein, 275 aa, Xerophyta humilis
SLQQVEEVKCLLRIIPIWSTGIIYYIAIVQQQTYVVYEALQSDRHLGNTSFLIPAASYSVFAMLAMTIWIPIYDRIIVPRFRKLTGQEGGITLLQRMGVGLVLAIIGMVVSAIIEIQRRSYAIHRPTIGTAPSGGAISSMSSLWLIPQLVILGLSEAFNAIGQIEFYYKQFPENMRSVAGSLFFLGAATANYLSGALIGVVHRVTGRGAGKNWLAGDLNKGRLDYYYFFIAGLGVLNLVYFMMCAKWYKYKEADSSSNAGEISLVDEIISKEPLV

SEQ ID NO: 16462 - protein, 311 aa, Pseudomonas fluorescens PfO-1
MSALSPLSPNTPRIALIGECMIELQQRADGSLQQSFGGDTLNTAVYLSRAMGGKAQVDYVTALGDDSFSDAMCRIWADEGIGLDLVQRLPGRLPGLYCIQTDAAGERRFLYWRNEAAVRDCFTTPASAPILAALADYDVLYFSGITLAVLGALGREKLIETLIEARQRDARIVFDNNYRPRLWASVEEARAAYRSVLPHVDLALLTVDDEQALFHFEDCDAVFAAYAQIGTPEVVLKRGAEACLIRCDGEAFEVPAQKVETVVDTTAAGDSFSAAYLASRLSGASPVRAAEAGHRLASQVIQVPGALIPKD

SEQ ID NO: 16463 - protein, 384 aa, Bacteroides thetaiotaomicron VPI-5482
MDIEHVRSRFIKHFDGTTGFIYASPGRINLIGEHTDYNGGFVFPGAVDKGMLAEIKPNGTDKVRAYSIDLKDYVEFGLNEEDAPRASWARYIFGVCREMIKRGVDVKGFNTAFSGDVPLGAGMSSSAALESTYAFALNELFGEGKIDKFELAKVGQATEHNYCGVNCGIMDQFASVFGKAGSLIRLDCRSLEYQYFPFHPEGYRLVLMDSVVKHELASSAYNKRRQSCEAAVAAIQKKHPHVEFLRDCTMDMLEEAKADINAEDYMRAEYVIEEIQRVLDVCDALEKDDYETVGQKMYETHHGMSKLYEVSCEELDFLNDCAKEYGVTGSRVMGGGFGGCTINLVKNELYDNFVEKTKEAFKAKFGRSPKVYDVVIGDGSRKVE

SEQ ID NO: 16464 - protein, 850 aa, Coprinopsis cinerea okayama7#130
MSSRPLPNPPFQYPQNYWGPVYGDSRNNHHYQDQYHNPYGYPNYAHQPPDFDEQPATSSIPVGTLLHKGFYDLLAMIPTPSPSRLIWGSPPSPNKSSDLQAGPRYEEIVPPANAAIKATPKKGRRVSKDMVSKPTGFVHLVHASDADQYEALLTRWGPDGIGKLGDPQWANPIKNRVRMLNQAKAVNEVVNACKPSQGSVYGDTTFGQLHVVNGISSATSSSLTTGAIENMSIGPYRYDGLPQRWGGGSTLRKATGGLQTHPEVYEGQDRGASPVMDLPPPPPAKPIIPSLTTLEKAVAARIYFENIYFSLFRHVPSREQRRLAMERDMAAMGLDSAQKEILRARWRQNETEYLRQTRQKLDASAFIKLKTIGHGAFGVVSLVKEKSSGNLYAMKQMRKADMLRKGQEGHVRAERDILKSASLVHSPGGAEWIVRLHYSFQDRDNLYLILEYMGGGDLLNLLIERDIFEEDFTRFYVAEMILAIEQCHKHGFIHRDIKPDNFLFDPEGHIKLSDFGLATDLHWAHDTSYYEQQRLHLLHKYGIDLEDPNGIADGRKTKRLDPKQIELLMGGGDGKTGIFTWREKNKRKLAYSICGTNSYMSPEVIRGHGYTYSCDWWSLGVIMFECLYGYPPFVSNSRHVTRQKILNWKQSLRFPSRPRVSPEGVNLMQQLLCEPEDRLGSQASSSVFRPDSLVVQARRSGFMPQAGSTTSVDGAHLIKAHPWFKGIDWDNIHKYPAPYRPELTSPDDTRHFDSDIPPEPLAPANGAPPDATRDPMLKDKVHGEDILNVRKALAFAGFTHKSPRAIEYVRVDRAFDPMPTPRGGGHEDALRGRSPVRETRTIGKGRAISL

SEQ ID NO: 16465 - protein, 366 aa, Thermotoga maritima
MGSDKIHHHHHHMKIAVLPGDGIGPEVVREALKVLEVVEKKTGKTFEKVFGHIGGDAIDRFGEPLPEETKKICLEADAIFLGSVGGPKWDDLPPEKRPEIGGLLALRKMLNLYANIRPIKVYRSLVHVSPLKEKVIGSGVDLVTVRELSYGVYYGQPRGLDEEKGFDTMIYDRKTVERIARTAFEIAKNRRKKVTSVDKANVLYSSMLWRKVVNEVAREYPDVELTHIYVDNAAMQLILKPSQFDVILTTNMFGDILSDESAALPGSLGLLPSASFGDKNLYEPAGGSAPDIAGKNIANPIAQILSLAMMLEHSFGMVEEARKIERAVELVIEEGYRTRDIAEDPEKAVSTSQMGDLICKKLEEIW

SEQ ID NO: 16466 - protein, 195 aa, Prochlorococcus marinus str. MIT 9301
MANLNQPPSRVTPNLLHILNAFTDSSNTIINSIVELNSNTINKYELITETGHLKLDRVGYSSLAYPFAYGCIPRTWDEDGDPLDVEIVGVTEPLIPGSIVEARIIGVMKFDDGGEVDDKVIAVLADDKRMDHISSYEDLGDHWLKETKYYWEHYKDLKKPGTCTVNGFFGIEEAVKVIKDCEERYKKEIDPKLVN

SEQ ID NO: 16467 - protein, 363 aa, Shewanella oneidensis MR-1
MGFKCGIVGLPNVGKSTLFNALTKAGIEAANFPFCTIEPNTGVVPVPDPRLDALAAIVNPQRVLPTTMEFVDIAGLVAGASKGEGLGNKFLANIRETDAIGHVVRCFDDDNIVHVANKVDPARDIEVINTELALADLDSLERAVIRQQKRAKGGDKDAKFEVEVLEKMRPVLDEAKMLRSMDLSKEELEAVAYLNFLTLKPTMYIANVAEDGFDNNPHLDAVRAIAEKENAIVVSVCAAIESELAEMDAEERDEFMADLGLEEPGLDRVIRAGYQLLSLQTYFTAGVKEVRAWTVSVGATAPQAAGVIHTDFERGFIRAQVVAFDDFIAYKGEAGAKEAGKLRVEGKTYIVQDGDVMHFLFNV

SEQ ID NO: 16468 - protein, 426 aa, Escherichia coli
MSFNLENYKIGIIGLGYVGLPLAVEFGKKIKTLGFDINEKRIKELSAGNDFTLECSSDELAQAYYLQYSCDYKELATCNVFIVTVPTPIDEYKQPDLTPLVKASETLGKIIKKDDIIIYESTVYPGATEEVCIPVIEKISGLVFNIDFFAGYSPERINPGDKEHRVTTIKKVTSGSTPEIAEIVDKLYGTIITAGTHKASSIRVAEAAKVIENTQRDLNIALINELAMIFNKLGIDTEEVLKAAGTKWNFLPFRPGLVGGHCIGVDPYYLTHKAQAIGYHPEVILAGRRINDGMSKYVASQFIKAMLKKKLQIEGANVLIMGLTFKENCPDLRNTKVVDILAELKEYNVNVDIYDPWVDVEEAYYEYGVNVLNTLSDKKYDGVIFAVAHSQFKNMSKEEVHGIIRNDGVIYDLKYIIDPNLVDIRL

SEQ ID NO: 16469 - protein, 507 aa, Gossypium hirsutum
VNPSLLFLSLLFLFNGCLARQTFSSQQSQNECQINRLRASAPQTRIRSEAGTTEWWNPNCQQLRCAGVSVMRQTIEPNGLVLPSFTNAPQLLYIVQGRGIQGIVMPGCAETFQDSQQWQHQSRGRFQDQHQKVRRFRQGDIIALPQGVVHWSYNDGNERVVTINLLDTGNSANQLDNIPRRFHLAGNPEEEQRQLRRLAQQMQGRSERGEESEEEEGEGEEEEEEDNPSRRSRHQEEEEQGRESSSCNNLLCAFDRNFLAQAFNVDHDIIRKIQRVRGNRGTIIRVRDRLQVVTPPRMEEEEREERQQEQRYRHTRGGSQDNGLEETFCSMRIKENLADPERADIFNPQAGRISTLNRFNLPILQRLELSAERGVLYNRAGLIPQWNVNAHKILYMLRGCARVQVVNHNGDAVFDDNVEQGQLLTVPQNFAFMKQAGNEGAEWISFFTNSEATNTPMAGSVSFMRALPEEVVAASYQVSREDARRIKFNNKNTFFFTPSQSERRADA

SEQ ID NO: 16470 - protein, 477 aa, Coxiella burnetii RSA 493
MLRSTKIIATLGPATDDLSILEEIIHEGVDIIRLNFSHGTHEKHKQRIEMVRKAAKKQERVIGILADLQGPKIRISSFKTGKINLKKGELFILDAGLPPEEGTEKSVGIDYKNLPKDVKAEDILLLDDGRLTLKVQNVKGEQIICRVVEGGALSDHKGINRLGGGLSAEAMTEKDINDLKFAVDFDVDYVAISFPRDAQDILKAKHLVQGYKGKAGIIAKIERTEAVKNIDAIIEASDGVMVARGDLAVEIGDAQVPLVQKDIIHRARSMDKPVIIATQMMESMIHATVPTRAEVSDVANAVLDNTDAVMLSAETAVGDYPVLAVAAMARTCVVSESQPRSHISRHRVECRFKRIDEAIAMATMYAANHLDIKAIITLTESGITPLWMSRIRTAIPIYGLSRFDKSLGRMTLYRGVYPIKFDPTQYTRDEINVKAVETLQSQDLLKNGDLVVLTKGDYMGVGGGSNAMKIMVVGKVV

SEQ ID NO: 16471 - protein, 419 aa, Haloarcula marismortui ATCC 43049
MGMTQVTTLECTLCGAEYDPNRIIYTCPEHEGVKGILEVTYDYDAIDDAFDGDLGGPIASQWKYEAFLPVAADADIVTLNEGGTDLFDAPNLSAALGVETLVKDDGRNPTGCFKDRASAIAVTKAKHAGRDIITCASTGNAAASLSGYAARGGMDCRIFVPGDAPTGKLAQPLVYGADVLAVNGNYDEAYDLSVEVTEKYGWYNRNAAINPFQVEGKRTVGHELADQSIARGHVPDWVVFSMGDGCTIAGAWKGFKEFYDLGYVDDHPKMLGVQAEGASAIHDAFHNHEDIDDIAETLADSIAVGRPRNTIKACRALEQSGGTSVLVSDEEILEAETLLGSTEGIYSEPAGAAPIAGVQTALDRGIIEQDETVVVVSTGFGLKDTKSAEKATGGVDRIDPEIAEVEGLYGTAEEAAADD

SEQ ID NO: 16472 - protein, 375 aa, Kluyveromyces marxianus
MLRLTNARTFVKPLRATAFGSFRTMASVAIPEKQKGVIFYENGGKLEYKDIPVPKPKPNEILINVKYSGVCHTDLHAWKGDWPLATKLPLVGGHEGAGVVVAMGENVKGWEIGDYAGIKWLNGSCMSCEFCELSNESNCPDADLSGYTHDGSFQQYATADAVQAARIPKGTDLAEIAPILCAGVTVYKALKTAGLKAGDWVAISGAAGGLGSLAVQYAKAMGYRVVGIDGGEEKGKLAKQLGAEAFVDFTKTKDMIGEIQEITNGGPHGVINVSVSEAAMNASTQYVRPTGTVVLVGLPAGAVIKSEVFSHVVKSIAIKGSYVGNRADTREAIEFFAAGKVKSPIKVVGLSELPKVYELMEQGKILGRYVVDTEK

SEQ ID NO: 16473 - protein, 237 aa, Zea mays
  misc_feature (5)..(5): Xaa can be any naturally occurring amino acid
  misc_feature (25)..(25): Xaa can be any naturally occurring amino acid
PCLSXRHQTLLTGFFNHSVQVIISXGRSNHNVSQVSEGVLSGDENHTEDTPTRHALSPYLEYMAYLYQRMDPLPEQERFEINYRDFLQSPLQPLMDNLEAQTYETFEKDTVKYTQYQRAIAKALVDKVSEDEVSTTRTVLMVVGAGRGPLVRASLQAAEETGRKLKVYAVEKNPNAVITLHSLIKLEGWESMVTIISSDMRCWDAPEKADILVSELLGSFGDNELSPECLDGAQRFL

SEQ ID NO: 16474 - protein, 817 aa, Ostreococcus tauri
MDRDHASSGTGDGSGTHATSRTNAEGSLTERVKHAVRSMSANEYSCVKSTLPTFASIKRKHLERLVRATWASEFEAENAEEIARALARVNVLRSPLSALRRAGLLHALARYGSNSMLYPLYAWREKLFDEPLEAYSSDDRSELARARRKMCAEFNRGAGAKDRQGQNACAGLVAPCAALVRAKVKFHRHFVAFENNYSVDAREEVLLDDEDDIGMSDPISSLSLCALIAISGKARRVLDVAAPLLPDLSEWVTEANAADGLQWAELVAFVARMALQEADLAYGAALFVAATLAEEKRLSESDNEKFQVEYDALRQCFAVARSKVYLHEESVHELGVNAPDFLETETDIKEILSANAPAKKHVLDTTFINLMDADVSGEPMSVTYATPVVGETPPLIEFDGPGSHAVDWYNPFGLAPPQDLGVRPGHRRKPSDFDLEAFAAPLEFTPLQSGPASELTYVDPFATPANAPNADALDMNALTQLLGTPKRMPSPSRQGAHTPQKPPRSPMHQPDWFVEIPLAELEFGRQIGRGAFGEVFRGKFRGTDVAIKRLCVLDGSAAAPMMTSEETSDDRGLAEFKRELSFLSRLRHRHIVQFIGAATEPPNLCIVMDYCDKGSLYAYLHNQSKTLSAFKVLKWMSEAAKGLVYLHASGIIHRDVKSGNLFIDDGGSIKIGDFGLSKFHSGASTSGGMMSVVGTYQFMAPELLNGQPRYTSAVDVYSFGIVMWECLTREEPFVGLSPMQIVAALLRGERPGDGATETNDMELPEEYLERMRACWDAEPGVRPAMKDVAPELERLFLNEKRRVLAAKRAVDQTPSLI

SEQ ID NO: 16475 - protein, 438 aa, Bacteroides thetaiotaomicron VPI-5482
MDTKELKIAVAGTGYVGLSIATLLSQHHQVTAVDVIPEKVDMLNRKQSPIQDEYIEKYLSEKALNLTATLDGAKAYSDADFVIIAAPTNYDPVKNYFDTHHIEDVIDLVLSVNPDAVMVIKSTIPVGYCRGLYLKYARKEVKKLNLLFSPEFLRESMALYDNLYPSRIIVGYPKLIDGEQFDEENEAIKAIADVLTLEKAAHAFAALLQEGAIKKDIPTLFMGIKEAEAVKLFANTYLALRVSYFNELDTYAEMKGLDSQSIIQGVGLDPRIGTHYNNPSFGYGGYCLPKDTKQLLANYQDVPQNMMTAIVESNRTRKDFIADQVLRKAGYYTASCSWDAQKEQKITIGVYRLTMKSNSDNFRQSAIQGIMKRIKAKGATIVIFEPTMQDGETFFGSQVINNLVEFKEISQAIIANRYDACLDDVKEKVYTRDIFQRD

SEQ ID NO: 16476 - protein, 379 aa, Kluyveromyces marxianus
MFRLARAQTSITTTSKALGGSRRLFVRLNSSFAIPESQKGVIFYENGGKLEYKDLPVPKPKPNEILINVKYSGVCHTDLHAWKGDWPLPVKLPLVGGHEGAGVVVAKGENVTNFEIGDYAGIKWLNGSCMSCELCEQGYESNCLQADLSGYTHDGSFQQYATADAVQAAQIPKGTDLAEIAPILCAGVTVYKALKTADLQPGQWIAISGAAGGLGSLAVQYAKAMGLRVLGIDGGPVKEELFKSLGGEVFIDFTKSKDMVADIQEATNGGPHGVINVSVSEAAISMSTEYVRPTGVVVLVGLPAHAYVKSEVFSHVVKSISIKGSYVGNRADTREAIDFFTRGLVKSPIKVVGLSELPKVYELMEAGKILGRYVVDTSK

SEQ ID NO: 16477 - protein, 429 aa, Ralstonia metallidurans CH34
MSAIVDIIGREVLDSRGNPTVECDVLLESGVMGRAAVPSGASTGSREAIELRDGDKSRYLGKGVLKAVEHINTEISEAIMGLDASEQAFLDRTLIELDGTENKGRLGANAMLAVSMAVAKAAAEEAGLPLYRYFGGSGAMQMPVPMMNIVNGGAHANNSLDIQEFMIMPVSQTSFREALRCGAEVFHALKKILSDKGMSTAVGDEGGFAPNFSSNEECLNTVVQAIEKAGYKAGEDVLLALDCAASEFYHEAEGVYSLEGEGLKLTSTQFADYLANLCDKFPIVSIEDGMAEGDWEGWKTLTDKLGKRVQLVGDDLFVTNTKILKEGIEKGIGNSILIKINQIGTLTETFAAIEMAKRAGYTAVISHRSGETEDSTIADIAVGTNAGQIKTGSLSRSDRISKYNQLLRIEEDLGDIATYPGKSTFYNLR

SEQ ID NO: 16478 - protein, 327 aa, Candidatus Kuenenia stuttgartiensis
MGIEDSIRTYGAKIDDMLRELIPVDEENYLSEPIWYHMNTKGKRVRPAICLITCEALGGNPENALSFALAIEVLHNMFLMHDDIEDGDTVRRDQPTVWVKYGTANAINAGDYLLACAYKSTLASPVAPEKRLKLLEALTLTYGKTVEGQALDINARAAESFTVAAYMKMVELKTGYYLACGMVGGAIVAGASNEVVEKIWMLGKNMGPAFQIRDDLIDLTHGKGRGGVIGSDIKEGKASFLYSYVLQIASGEQKKKLREIMLKPREETTADDIEWVLDVYRRYDAMKYAQDYAENLVQQAYKTINEIPVDDKTIFKEIASFMAQRMS

SEQ ID NO: 16479 - protein, 188 aa, Erythrobacter sp. NAP1
MTAHPGANIIPIHGKAPKIHETAFIAPGSTIIGDVEIGAGSSIWYNCVVRADVFKIRIGERTNVQDGSVLHCDPPRPDDPDGCPLIIGDDVLIGHMAMVHGCTIHDRGFVGLGAIVMNKAVIGSDAMLAAGAMLTERKVMGERELWAGRPAKKLKDLSDAAIMGMKIGTAHYAENAKHHTTAVRDALG

SEQ ID NO: 16480 - protein, 208 aa, Sinorhizobium meliloti 1021
MRNPVDTAMALVPMVVEQTNRGERSYDIYSRLLKERIIFLTGPVEDHMATLVCAQLLFLEAENPKKEVALYINSPGGVVTAGMAIYDTMQFIKPAVSTLCIGQAASMGSLLLAAGHKDMRFATPNSRIMVHQPSGGFQGQASDIERHARDILKMKRRLNEVYVKHCGRTYEEVEQTLDRDHFMSADEALDWGLIDKVITSRDAVEGME

SEQ ID NO: 16481 - protein, 430 aa, Halobacterium sp. NRC-1
MRVSIVGSGYVGTTVAACFTDMGHDVVNVDIDQDIVDAINAGKAPIHEPGLDDLLATHGGDTLAATTDYEDVLETDVTFLALPTPSKEDGSIDTSIIEAAAETLGDTLREKDGDHVVVTKSTVIPRTTTETLAPILADASGKQLGADLHVAMNPEFLREGTAVEDFQNPDKIVFGSDSETAIDTLHEIFKPLIEASDATVVETGVEEAEMIKYANNAFLASKVSLINDIGNICKEFGVDAYEVADAIGLDDRISERFLRSGLGWGGSCFGKDTNAIIHAATETGYEPAMLEAAVAVNDRQPERLLSLLDDHGDVESERVAVLGLAFKPGTDDVRDSRAIPVINGLQERGANVAAYDPVAAENMRTHFPDIEYTDAPQDALADASACVVCTDWDEFAVLDDEFDAMETRVVVDGRRIIERRDGLTYEGLTW

SEQ ID NO: 16482 - protein, 887 aa, Coccidioides immitis RS
MEGFVVLWGIFLLWLGKMSLSTLLRISGLRKERHDASFLKTSEKSSSKQKTVDAGAVDGESAENLYPENVETIRSREFPLLKSTTYLDHGGATLYAKSLIDDFSREMTSHIFGNPHSASSSSQLSTQRVDDARLRLLQFFNASPDDFDIVFVANATAGIKLVTEALRDYDQRGFWYGYHLDSHTSLVGPRNVATRGSRCFLDSNGVQEWIDGLGASPSGQEEKPYPKLFAYPAQSNMTGSRLGLEWCKSIRAKTGGKQNVFTLYDAAAHVSSSPLDLSDSDSAPDFTVLSLYKIFGFPDIGVLIVRKEARHTFEKRTYFGGGTVGMVISLGEEWHAKRNDAVHDGLEDGTLPFHSIVAVHSALDVHKRLYGSMRNVSWHTAALAKNLYCRLEGLRHSNGEKVCEIYKSSYSTYGDPATQGPVVAFNLKDSRGSWVGSSDVEKLAAVKDIHIRSGGLCNPGGIASYLHFNPEEMKRNYTSGLRCGDETDLMGEKPSGAIRVSLGAMSSMRDIDTFVNFISDFYVEKEKRTSLPEAPVPSTPLNPEFYIEQIYVYPIKSCGALVIPEGEQWEVKPEGLAWDREWCLIHLGTNTALNQKKYPRMALIRPIIDFKKGFLRITCGTTGSEDWNSIEIPLFPDDTKGQTAVQMQQNAKAATVCGDTVTVRVYSTPTVTAFFSDFLSTPCTLARLPPQSTMRYYKPRLPATETNKRSSILSTTFSKPRPSLHRNPILLSNESPMLLVSRSSVNRLNEEIKTRQNNAKTVPCNVFRANIIVSEDLSPSRMDRRTGDNESLTEHPYIEDHWSGFRIGNWRFDVLSSCQRCQMVCIDQDTGVRSEEPYSTLAKTRKINGKVYFGRHICLANASSGRQGLCPTVKVGDRVEPFYGRFG

SEQ ID NO: 16483 - protein, 174 aa, Ralstonia metallidurans CH34
MALYQLGEIAPTIHDDAYVAAEATIIGNVTLKARASAWPGVVIRGDNEPIVVGEDTNIQEGSVLHTDPGRPLTLGDKVSIGHQAMLHGCTVGEGSLIGIQAVVLNGAVIGKECLVGAGAVVTENKVFPDRSLILGAPAKVVRELTDADVANLYRNAETYAKRQATYKTDLKRIG

SEQ ID NO: 16484 - protein, 697 aa, Marinobacter sp. ELB17
MSEVVTYSREGNIGVITVNYPPVNALSHAVRSGLIAALEQGQEDSEAKVLLLVCEGRTFIAGADIREFGKPMQKPGLPELVETYENSDKPLVAAIHGTALGGGLEMALGCHYRIALNSAKIGLPEVKLGLLPGAGGTQRLPRLTGAQKALEIITSGEFVGAKDALALGILDVVDDGKDVKAAGLAYAQQIADEGKPVRRVRDLKDKIAADKGSDVFDQFRAVLQKKARGQFSPFKCVDAIEAAFDLPFAEGMKRERELFTECMDSPQRAGQIHSFFAEREVSKVKGLSKDTPVRDVNSVGIIGAGTMGGGIAMNFANVGIPVIIVEMKQEALDKGLGIIRKNYENSAKKGRLTQQQVEDRTALITGSLSYDDFKSVDLVIEAVFENMAVKKEIFAKLDGICKPGTILASNTSTLDIDEIASATRRPEDVVGMHFFSPANVMKLLENVRGSKTSDEVKATVMAVAKKIKKVGVLVGNCHGFVGNRMLHRRGAEAMTLVNEGATPQQVDKVLTDLGYPMGQFAMSDLAGIDVGYRIREELRNAGEQVAPSWMDKLAEQNRLGQKTMKGVYAYEEGSRTPVPDPEVERVIEDFRNEQGISSREITDQEILERCMYVMVNEAAKILEEGVADRALDIDVVWIYGYGFPAYRGGPMFWADQVGLDLILAAVEKYHGDVGGEQWKPADLLKQLVADGKKFGDL

SEQ ID NO: 16485 - protein, 413 aa, Pyrococcus furiosus DSM 3638
MKAVILAGGFGTRLRPISSTRPKPMVPVLGKPNLQYILEALEKVSEIDEIILSVHYMRGEIREFIQERMVDYPKDIRFVNDPMPLETGGALKNVEDYVSDDFLVIYGDVFTNFDYSELIKAHKENDGLITVALTKVYDPERFGVVIVDEEGKIIDFEEKPRKPKTNLVDAGIYMVNKEVLKEIPKNKEVYFEREILPKFVSQGLVYGYRMPKEYYWIDLGTPEDLFYAHQIALDQLSRENGYMILGENVEIPEDVEVQGPVYIDNNAKIGHGVKIKAYTYIGPNTIIEDKAYIKRSILLGSDIIKERAELKDTILGEGVVVGKNVIIKENAVVGDYARINDNLVIYGAKILPWKKVEEYEAYIRIKLDPTKVRPELTPERCPLGLPECIYKKFKAIAGEKPPCDECIENQWLF

SEQ ID NO: 16486 - protein, 419 aa, Candida glabrata CBS 138
MDADNIEDIEEQPVSTIPEDVQTRYIHWKKNTKLLYDYLNTNSTKWPSLTCQFFPDLDTSSDQHRLLLSSFTSSQLPEDESVYISKISTLKHLNWSSLNNFDMDEMEFKPDPSVKLPPKNLTTEVSIRFPNGDCNRSRYLPQNPDLIAAASSDGSVYIFNKTKHGNSVLRSKSSDDFQARLFSGSHDAQNLDNFNEAVSLSWNKHKEGILGVSYSQGQCNIWDVKKFSRSNILISQPELTVTFDSNGCNDLDWMPMHDSMFIACGESNKLGLFDMRLNGEKEVNSISNYKHEDGINTCKFNPGNSLLVASADTCGRINLWDIRKLDQEPISTMQHGSSISTIEWNPNIGVVFASAGQEDGLVKLWDASVGKEIFVHGGHMLGVNDISWDMHDPWLMASVSNDNTIQIWRPAKNIVSKPS

SEQ ID NO: 16487 - protein, 325 aa, Thermotoga maritima
MGSDKIHHHHHHMSVNLKGRSLLTLLDFSPEEIRYLLDISKQVKMENRSKLRTERFKGMTLAMIFEKRSTRTRLAFETAFAEEGGHPIFLSPNDIHLGAKESLEDTARVLGRMVDAIMFRGYKQETVEKLAEYSGVPVYNGLTDEFHPTQALADLMTIEENFGRLKGVKVVFMGDTRNNVATSLMIACAKMGMNFVACGPEELKPRSDVFKRCQEIVKETDGSVSFTSNLEEALAGADVVYTDVWASMGEEDKEKERMALLKPYQVNERVMEMTGKSETIFMHCLPAVKGQEVTYEVIEGKQSRVWDEAENRKHTIKAVMIATLL

SEQ ID NO: 16488 - protein, 140 aa, Xerophyta humilis
MAANLRPVYGYTVFYVKDVTESVAFYAKAFGYRVRRVDNSNRWGELESGETTIAFTPMHQKETDGRSGVVHIPEPGEKNPVEVCLAYEDVDAAYKRAVENGAVPVSPPEDQVWGQKVGYVRDINGITVRLGSHVKEPTRQ

SEQ ID NO: 16489 - protein, 948 aa, Sorghum bicolor
MAASVSGATICLQKPGSKSRRARDATSSFARRSVAAPRSPHAAKASVIRSDAGAGRGQHCAPLRAVVDAAPIATKKRVFYFGKGKSEGDKSMKELLGGKGANLAEMSSIGLSVPPGFTVSTEACKQYQDAGCILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQGNRLWMLQCRTGKRTGAGAVKIAVDMVSEGLVERRQAIKMVEPGHLDQLLHPQFENPALYKDKVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWLSLNGSTGEVILGKQPLSPPALSGDLGTFMSWVDDVRKLKVLANADTPGDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDGVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 16490 - protein, 400 aa, Salinibacter ruber DSM 13855
MCRTPTDSPALNSEQERTRWPSHASRSSFRSGLNPPMSLQCGLVGLPNVGKSTIFNALSSAGAEADNYPFCTVDPNVGVVPVPDDRLPRVAELAGSPETIPTSIEFVDIAGLVEGAAEGEGLGNQFLAQIREVDAIIHVVRCFEDEEVAHVAGSVDPTRDVEVINTELLLKDLETVEKRLDTVKTAAKKGDQEAAEELEVFERLHDHLSEGAWARSFEAGAAERPLVDELFLVTDKPVLYVANVGENDLPDGNAYVDQLRPIAQNEGTRVVVTSAELEAQLTELDPEERQLFLDDSGLQRAGLERLIHAAYDVLDLITFFTADEKGAYAWAIEEGTRAPQAAGEVHSDFEQGFIKAETIHFSDFDEAGSEAAAREAGLLRTEGKDYVVEDGDVMEFRFNV

SEQ ID NO: 16491 - protein, 785 aa, Arabidopsis thaliana
MLTRVWKDPWIPTILARPAKSILNIRDSLLYVNDLIDQNTNLWKLDRLQALIDPVDIPLILGIRPSRTYLSDGFSWSHTKSGNYTVKSGYWVARDLSRPTCDPPFQGPATCQRLTYRHMGTDKGCPRCEEVEETINHLLFHCPPSRQIWALSPIPTSGNIFPRNSLFYNFDFLFWRDREFGIGEKNFREPPPETLVLALQETAVWKQATLKEDDSTRPIVFVGSSQTPSTLLPECQLDASWHVDDTLSGHGWAMECMISIGDTSGTFASDCSDLIAILDNQDDWLTFAAELASYLSSKLVVSLFKTPVKMASLTLRCDSTHLLPSRDVVKGTKPFGTSLVYPRIISKKFNVRMRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 16492 - protein, 135 aa, Brassica napus
  misc_feature (84)..(84): Xaa can be any naturally occurring amino acid
  misc_feature (92)..(93): Xaa can be any naturally occurring amino acid
  misc_feature (101)..(101): Xaa can be any naturally occurring amino acid
  misc_feature (103)..(106): Xaa can be any naturally occurring amino acid
  misc_feature (108)..(112): Xaa can be any naturally occurring amino acid
  misc_feature (114)..(115): Xaa can be any naturally occurring amino acid
MASSMLSSAAVATSPAQATMVAPFTGLKSSAAFPVTRKSNTDITSIASNGGRVSCMKVWPPVGKKKFETLSYLPDLTDVELAQXADYLLRNXXIPCVEPEXGXXXXVXXXXXRXXPGVYLLRFSPSPPHPSYTFP

SEQ ID NO: 16493 - protein, 391 aa, Coxiella burnetii RSA 493
MSNLNLHNKRVMIREDLNVPMKNGKITNDERIVRALPTIQKAIEQKARVMILSHLGRPEEGKFEKEFSLAPVARLLSKKLNQKVPLINDWLKGVAVEPGQAILCENVRFNKGENENNTELAKRMAELCDIFVMDAFATAHRAQASTAGVAAYAKLACAGPLLISEVEALSRALENPQKPLVAVVGGSKVSTKIHLLENLLDKVDQLIVGGGIANTFLKAQGYSIGKSLCENEWLDAAQQFWEKAAEKNVSLPLPVDVIVADELSEDAKATVKNIDAVTSNESIFDVGPNTSATYAKLMAQAGTIVWNGPIGVFEIEAFSQGTRALAQAVAKSTAYSIVGGGDTLAALDKFNLTDQMSYVSTAGGAFLEFLEGKILPAIKILTQRAKEYEQK

SEQ ID NO: 16494 - protein, 246 aa, Corynebacterium efficiens YS-314
MVSAIRTGYRLIDTAYNYENEGAVGVAIRESGVPREELIVTSKLPGRFHEFELARPRIEESLYRLGLDHIDLLLIHWPNPNRDLYVQAWQALIDARDRGLVRHIGVSNFLPEHIDRLEAETGELPVVNQIELHPYFPQVEQVEWHNARGIVTEAWSPLSNGRGLVDEPLLTDIGRRYGVGGGEVALAWHHARGIVPIPRSTNPERQKSNLEAVHLTLSDEEVSAITALGRPDGRIKDQDPAVYEEF

SEQ ID NO: 16495 - protein, 283 aa, Prochlorococcus marinus str. MIT 9301
MNDSQRVSILSEALPYIQSFSGRKIVIKYGGSVMEDDDLKNAFFRDIALLSTVGVCPIVIHGGGPEINNWLKKLEISPKFENGLRITDQKTMEIVEMVLMGRVNKQIVKGINKTGSLAVGISGLDGNLIQSRELGDGSHGLVGEVTKINPEILDPLISKGYIPIISSIGSTVEGISHNINADFVAGEIAAAISAEKLILLTDTQGILKEKDNKNSLVEKTNLKEARDLIDKKIVTEGMIPKTECCIRALAQGVKAAHIIDGRVQHSLLLEIFTNTGIGTMIVA

SEQ ID NO: 16496 - protein, 334 aa, Coxiella burnetii RSA 493
MSFNIAINGYGRIGRNILRALYESGKNKDLKIVGINDLGDIKTNAHLTKYDSVHGRFSGEVGVSGNSLVINGDKIEVCAIRNPEELPWRNLEVDLVLECTGLFTSKEKAEAHLKAGAKKVLISAPAGNDVKTIVFGVNENIISSDDEIISNASCTTNCLAPLVKVLNDEIGIERGLMVTVHAYTNDQNLTDSYHKDLHRARAATQSMIPTKTGAAAAVGLVLPELDGKLDGYAIRVPTINVSVIDFTFDAKKLVSASDVNAMMKKAAQGKMKGVLGYNDEPLVSIDFNHDPHSSVFDAGQTRVIDQLVKVVSWYDNEWGFSNRMLDTALAFLKA

SEQ ID NO: 16497 - protein, 357 aa, Bacteroides thetaiotaomicron VPI-5482
MVTYNVSLENKVVLVTGAAGFIGANLVKRLLNEFDTVKVIGIDNITEYYDVRLKYERLQELSAYGDRFVFIKDSIAKKEIVESIFTNYHPQVVVNLAAQAGVRYSITNPDAYIESNLIGFYNILESCRHHSVEHLVYASSSSVYGCNKKVPYSTDDKVDNPVSLYAATKKSNELMAHAYSKLYNIPSTGLRFFTVYGPCGRPDMAYFSFTNKLLKGETIQIYNYGNCKRDFTYIDDIVEGIVRIMQHAPEKRNGEDGLPVPPYKVYNIGNNSPENLLDFVTILQDELIRAGVLPNYYDFESYKELVPMQPGDVPVTYADTTPLQQDFGFKPSTSLREGLRKFAGWYAKYYGTFKYHP

SEQ ID NO: 16498 - protein, 301 aa, Gossypium hirsutum
MASSWFFIVFLVLTVASVRCTTVDHMPSTDEDARDYSKLKTKTEEATDEHHSRTQQAKDELKSKADHAANEVKSNTQQAKDRASEVGKEAKEYTESWTEWAKEKISEGLGFKQDDDPKGSVEKAFDSVADTATKTKDKLQDMASGAGEYSAGKAKDMKDTAYKTDDVKNAAKGKSSEMRQATTEKARELADSAKENANTAYIAAKEKVRDMADRTSEMTNEAQERGARKAEEAKEVVAEKAEGAAEETKKKNEERGESLKWAKEKAKQGYDAAKSKAEETIESAKDTIASGYESRSRNHKN

SEQ ID NO: 16499 - protein, 254 aa, Oryza sativa Japonica Group
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKVMKSDTVIHL

SEQ ID NO: 16500 - protein, 447 aa, Corynebacterium efficiens YS-314
MTPTGHDHRQTVTFYILGGAGDLVRRLLIPGMAGYLREYEGTRINIVATGRSEIDDYPQLVRDSLAAAGTDIDDRVVDSLAGHASFLASDATDPAELQELLDSREPGDRPVLYFALSPSVTAQAVDALAGVTLPEGIVLALEKPFGEDADTARELNEKLWKITDEEHIFRVDHFNCETALSNLVGLMGANAILSAGWNNRAVESIEIVYDESLGLEGRAEFYDSNGAVRDMLQSHLLQVMAHALAADTDDTVTDILAATDIDPGSVRRARYTAGEAGGEQLPDYAQEEGVDPERGTETLFQLTAHVDTDRWRGVPITLRSGKALGKPRREIAISYRREGYPEEVELQPGSRLVFPFTDEVVLEANVSDHGYSHNLQRVELRTELVPSKLSAYGRVVRAILDMSDTAEVPADAPARAWEIVEPVLTAFANDEVPLEEYPAGSAGPAGW

SEQ ID NO: 16501 - protein, 384 aa, Pisum sativum
MGLVCSRNRRYRDSDPGENAQAAEIERRIESETKAEKHIQKLLLLGAGESGKSTIFKQIKLLFQTGFDEAELRSYTPVIFANVYQTIKVLHDGAKELAQNDLNSAKYVISDESKDVGEKLSEIGSRLDYPHLTKDLAKEIETLWEDAAIQETYARGNELQVPDCTKYFMENLQRLSDANYVPTKGDVLYARVRTTGVVEIQFSPVGENKGSGEVYRLFDVGGQRNERRKWIHLFEGVTAVIFCAAISEYDQTLFEDESKNRLMETKELFEWILKQPCFEKTSFMLFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 16502 - protein, 445 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAHTFTDWNNGELSSYLIDITKDIFTKKDEDGNYLVDVILDEAANKGTGKWTSQSALDLGEPLSLITESVFARYISSLKEQRVAASKVLSGPKAQPAGDKAEFIEKVRRALYLGKIVSYAQGFSQLRAASEEYHWDLNYGEIAKIFRAGCIIRAQFLQKITDAYAENPQIANLLLAPYFKQIADDYQQALRDVVAYAVQNGIPVPTFAAAVAYYDSYRAAVLPANIIQAQR

SEQ ID NO: 16503 - protein, 757 aa, Streptomyces collinus
MLFDTLTDAIGRTPLVRLRLGAERGVEVYAKLELQNLFAMKDRVARNILLEARALGTLRPGAPVVESSSGTMALGVALVGRSLGHEVHIVTDPRIDPVTLAKLRALGCRVHVVEAMTSHGWQSARLERLAELMAELPGAFWPQQYTNPDNPGAYRGLARELLDSLGHIDTLVGAVGSGGSLCGTGRVLRETLPDVRVVGVDCVGSALFGQPDVPQRLQSGLGNSLLPKNLDRLLVDEVHWLNDHEAFAATRDLAREQQIFGGNTSGSVYRVLGDLARRAEPGSRIVGILPDRGDRYADTVYSDDHWEEHALHTLPAADRPAVVTAGTAVTTWSRQTYRAPDDLRRHLVFVESNTTGTGMLALDLARDTLGTEPVLLTGDPGRYRGLEATGAEVIRCDTNSDAALRAALQDRFRREEIAGVTTTSDFYVPAAARLARWLGLPGNPPEAVTACRDKSALRALLRRAGVHQPRYAVVREPGEVAAAVARTGLPCVVKPADDSGSVNVLLCTDEAQARAQAERILAVTTNVRGMPTARTVLVEEYLDGPEYSVEMFSQDGEAVCVGITAKSVTGDPHFVEHRHLFPAPLPAATAERITETVMAALDAAGIRLGATHTEVKLTGSGPAVIEINPRPAGGMIPELVRLASGVDLLEQQLKAATGQAPDLKPGHGAHAGIQFLLADADGVLDAVDGVARARAVDGVEAVTVTVAPGAVVRRARSAGDRVGHVIACRPGPEQVTAALDEARDLLRLTVGEPAGAR

SEQ ID NO: 16504 - protein, 384 aa, Pisum sativum
MGLVCSRNRRYRDSDPEENAQAAEIERRIEPEPKAEKHIQKLLLLGAGESGKSTIFKQIKLLFQTGFDEAELRSYTPVIFANVYQTIKVLHDGAKELAQNDLNSAKYVISDESKDIGEKLSEIGSRLDYPHLTKDLAKEIETLWEDAAIQETYARGNELQVPDCTKYFMENLQRLSDANYVPTKGDVLYARVRTTGVVEIQFSPVGENKRSGEVYRLFDVGGQRNERRKWIHLFEGVTAVIFCAAISEYDQTLFEDESKNRLMETKELFEWILKQPCFEKTSFILFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 16505 - protein, 195 aa, Zea mays
MAVQESAAQLSMTLKVQEYPTLKVPYETLNKRFRAAQKNIDRETSHVTMVVAELEKTLSSCPAVDSVVSLLDGVVEKLSVLKRKAVESIQAEDESAKLCKRRIEHLKEHSSDQPAAASMWKRKRMDRMMVEHLLRCGYYNTAVKLARQSGIEDLVNIEMFLTAKEVEESLERRETATCLAWCHDNKSRLRKMKSC

SEQ ID NO: 16506 - protein, 406 aa, Streptomyces coelicolor A3(2)
MRRGGPSVLGIVLAGGEGKRLMPLTADRAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSFGVITPGSDGQTVTGFLEKPADPPGLADDPGCVFASMGNYVFTTKALVEALHRDAEDPDSVHDMGGSILPQLTDRGEAALYDFSANHVPGETTRDQGYWRDVGTLDAYYDAHMDLIAERPAFNLYNRDWPVYTHSTQLSPARFNAGGIASESIISAGCLIRGQVTRSVLSPGVVVDPGAVVQGSVLHDNVHIGRGAVVRGAVLDKNVQVPPGATIGVNPQRDGELYTVSKGGVIALGKGQRVP

SEQ ID NO: 16507 - protein, 405 aa, Enterococcus faecalis V583
MRNFKKSDKLNNVSYDVRGPVLEEAERMQEEGIRILKLNTGNPAPFGFDAPNEIVRDMIVNVRDSEGYSDSKGIFSARKAIEQYCQLKKFPNVTINDIYTGNGVSELITMCMQGLLNNGDEVLVPMPDYPLWTASVSLAGGTPVHYICDEQAEWYPDIDDIKSKITSNTKAIVIINPNNPTGALYPKELLLEIVEVARQNDLIIYSDEIYDRLVMDGLVHVPIATLAPDLFVVTLNGLSKSHRVAGFRCGWMVLSGDKSRVKGYIEGLNMLASMRLCSNVLSQQIIQTALGGYQSVDGLLLPGGRIYEQREFIYNAINDIPGLSAVKPKAAFYIFPKIDTAKFDIYDDEKFVLDFLHKHHILLVHGGGFNWQQPDHFRIVYLPKMEDLKTTADKMREFLSTYKQK

SEQ ID NO: 16508 - protein, 328 aa, Halobacterium sp. NRC-1
MRILVTGGAGFIGGHLAERFVSRGHDVVVLDNFDPFYDTRIKDHTVEVCQNLADDGDGSYRLVEGDVRDAELVEELVADVDYVYHQAGQAGVRPSVEDPRKYNEVNVDGTLNVLDAARKTEIERVVFASSSSVYGKPEYLPYDEVHPTTPVSPYGASKLAAERYVCAYSEVYDLPTVALRYFTVYGPRMRPNMAISNFVSRCLNGEPPVVYGDGTQTRDFTYIEDVVDANEALLTDDAADGEVLNIGSTDNIDILTLAEEIRDQVAPELDIEFAERFEADAEHTHADISKANELLGYEPSRTIREGVQEFVEWYRANRDWYEPLVLES

SEQ ID NO: 16509 - protein, 161 aa, Zea mays
MAQRDKKEEPTELRAPEITLCANNCGFPGNPATQNLCQSCFSASRSPSSPTSSSSSLASAASQPRPAALVVDAAAVEALAAPAAAAAGQATEAAARASASRCSSCRKRVGLTGFRCRCGELFCGAHRYSDRHGCSYDYRGAARDAIARENPVVRAAKVVRF

SEQ ID NO: 16510 - protein, 251 aa, Brassica napus
MEDDELEAMRAHFPLSFGKTSIVSPPSESIHSATRRADAGASSDSKPSSGFPSLSSSSNSWIQSVRRPKRNPNSTGGAKSSLSPSEDDVSVEDDGVMVGPPPPPPTRDGNDSDDMIGPPPPPRTADVDSDEDDVDDDDDEENRYKIPLSNEIQLKGHTKIVSCLAVDNAGARVLSGSFDYTVRMYDFQGMNSRLQSFRQIEPSEGHQVRSLSWSPTSGQFLCVTGSAQAKIYDRDGLTLGEFMKGDMYIRD

SEQ ID NO: 16511 - protein, 372 aa, Shigella flexneri [sequence omitted]

SEQ ID NO: 16512 - protein, 309 aa, Halobacterium sp. NRC-1
MPTALVTGVAGFIGSHLAAALLDRGYDVRGVDNFATGHDQNLEPLRGTGDFSFYEADIRDADLVADVTNGVDYVFHQAADSSVPRSVEDPVTTTDVNCTGTATVIDAAREADVDTVVVASSAAIYGSTETFPKVESMTEQPESPYALSKHYTEKLALQASELYDIDTAALRYFNIYGPRQDPNGDYAAVIPKFISLMLDGERPVIYGDGEQSRDFTFIDNAIQANIRAAEGDVTGEAFNVGCGGRVTVNELVDVLNDLLDTDIDPIYDDPRPGDVRHSHADISKARELLSYEPEVGFSEGLEQTIPYYR

SEQ ID NO: 16513 - protein, 588 aa, Oryza sativa Japonica Group
MAATTHAASLSFLLSHPHPTSPNPNPNPNLPLRRAPHRVRCATDAAATRHRRAADENIREEAARHRAPNHNFSAWYAPFPPAPNGDPDERYSLDEIVYRSSSGGLLDVRHDMDALARFPGSYWRDLFDSRVGRTTWPFGSGVWSKKEFVLPEIDPDHIVSLFEGNSNLFWAERLGRDHLAGMNDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYRYYKSGWTEFTPQVAEPTFASAIQIGDPVSVDRAVVALKATDGIVEEATEEELMNAMSLADRTGMFACPHTGVALAALFKLRDQRIIGPNDRTVVVSTAHGLKFSQSKIDYHDSKIEDMACKYANPPVSVKADFGAVMDVLKKRLKVPCSWHMNTASICSECRPCLSVVLNFLVTFHPYLVKAGKLIIVECKMHGSWLHLHQCPVAKEIADYTISA

SEQ ID NO: 16514 - protein, 491 aa, Coccidioides immitis RS
MSDQAVGDFGLIGLAVMGQNLILNAADHGFTVVAFNRTVSKVDRFLENEAKGKSIVGAHSIQEFCAKLKRPRRIMLLVMAGKPVDDFIDALLPYVEPGDIIIDGGNSHFPDSNRRCKYLKERGIRFVGTGVSGGEEGARYGPSLMPGGNEEAWPYIKDIFQSIAAKSYGEPCCDWVGDEGAGHYVKMVHNGIEYGDMQLICEAYDIMKRGLGMTAAEMGDVFEKWNKGVLDSFLIEITRDVLRYNDEDGKPLLEKILDTAGQKGTGKWTAINALDLGMPVTLIGEAVFARCLSALKSERVRASKILGGPKPEFSGDRQEFIANLEQALYASKIISYAQGFMLIQNAAKEYNWKLNKPSIALMWRGGCIIRSVFLKDITNAYRNDPDLENLLFDDFFNKAIHTAQPGWRDVVSKATLWGIPTPAFSTALSFYDGYRSHDLPANLLQAQRDYFGAHTFLIKPECANERYPAGQNHHVNWTGRGGNVSASNYQV

SEQ ID NO: 16515 - protein, 311 aa, Thermotoga maritima MSB8
MGSDKIHHHHHHMFLVISVVGSSNIDIVLKVDHFTKPGETQKAIEMNVFPGGKGANQAVTVAKIGEKGCRFVTCIGNDDYSDLLIENYEKLGITGYIRVSLPTGRAFIEVDKTGQNRIIIFPGANAELKKELIDWNTLSESDILLLQNEIPFETTLECAKRFNGIVIFDPAPAQGINEEIFQYLDYLTPNEKEIEALSKDFFGEFLTVEKAAEKFLELGVKNVIVKLGDKGVLLVNKNEKKHFPTFKVKAVDTTAAGDVFNGAFAVALSEGKNPEEAVIFGTAAAAISVTRLGAQSSIPAREEVEAFLKNL

SEQ ID NO: 16516 - protein, 370 aa, Pichia farinosa
MTSTPYKIEKPFRVAIIGSGNWGTAVAKLVAENARDKPEIFEKQVNMWVFEEQVEGRKLTEIINTDHENVRYLPGVKLPENLVANPDVVETAKDADLLVFNIPHQFLPNVCKQLVGKVSSGTRAISCLKGLEVNAEGCKLLSQSITDTLGIHCGVLSGANIANEVAREKWSETSIAYLVPSDFRGEGKDIDSFVLKEAFHRTYFHVTVIQDVIGASIAGALKNVVACAAGFVDGAGWGDNAKAAIMRIGLKEIIHFASHYELFGIKGAAPQPTTFTEESAGVADLITTCSGGRNVRVGKYMVEKNVSAWEAEKVLLNGQSSQGIITAKEVHELLTNYKLNDQFPLFEITYKVIYENAEINSIPHILESDN

SEQ ID NO: 16517 - protein, 441 aa, Coprinopsis cinerea okayama7#130
MQRRSFTALNSVFCVDAQYEFVKELGQGAYGCVVAARHRQTGEGCAIKKITNINTKRILTKRCLREIRRDRLLHHFRGHKNITCLYDMDIVFQPNGNFDEVYLYEELMEADLHAIIRSGQPLTDAHFQSFIYQTLCGLKYIHSANVLHRDLKPGNLLVNADCELKICDFGLARGYTPGSGTSRAAGNQGFMTEYVATRWYRAPEIMLSFANYSTAIDVWSVGCILAELLGGRPIFKGRDYVDQLNQILHYLGTPSEDTLRRVGSPRAQDYIRSLPIRPRISFSTLFPQANPLAIDLLSRMLCFDPARRISCEEALNHPYLAVWHDPADEPNCDSIFDFSFEEEDSIEGMKRLIVEEVNNFRAEVRAQARGSAQNHRSTKDSDNLGIPSRDEIISSPVKEFGPHPGHTSNYTTNAPRAPSPIMDDPSAELERELASTHISKK

SEQ ID NO: 16518 - protein, 420 aa, Triticum aestivum
MGRKRAVLVGINYAGTKAELKGCHNDVARMRRCLVDRFGFDDDGAGIRVLSDADRAAPQQQPTGANIRRELARLVADARPGDSLFFHYSGHGTRLPAETGQDDDTGFDECIVPSDMNLITDQDFTELVQKVPDGCLFTIVSDSCHSGGLLDKAKEQIGHSTKQNKAQQGKREDRSDSGSGGFRSFLKQTVREAFESQGVHLPRRGGQQSSYDDDAESEEPSLDSGTDGHVKNRSLPLSTFIEMLREKTGKDDIEVGSIRMTLFNVFGEDASPKIKKFMKVMLEKLQQGQHGGVVGLVGALAQELLRAKLQGKQEELKPAMEQEVHGVEEVYAGTAARAPHNGVLISGCQTDQTSADATTAKGLSYGALSNAIQAILAEKDGKVSNKELVLRARGLLSKQGYKQQPGLYCSDRHTEVAFIC

SEQ ID NO: 16519 - protein, 260 aa, Shewanella oneidensis MR-1
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 16520 - protein, 184 aa, Prochlorococcus marinus str. MIT 9301
MDLSSIPPSPMKGIVNIVVEIPAGSRNKYEYCSEAGIMALDRVLHSSVRYPFDYGFIPNTLADDGAPLDAMVIMDEPTFAGCLIKARPIGVLDMHDCGAYDGKLLCVPMANPRQANIVSINQIAPNQLEDVAEFFRTSKGLDGRTVQIDGWRDFDVVENLLKSCMPLKKKNFKVLKKSNISKLN

SEQ ID NO: 16521 - protein, 199 aa, Vitis vinifera
MSRSLGIPVKLLHEAAGHVVIVELKSGELYRGSMIECKDNWNCQLENITFTVKDGKVSQLEHVFIRGIKVRFMVIPDMRKNAPMFKRLDARVKGKGSALGVGRGRAVAMRARAQAAGRGAPPGRGNVTSSKSCSARHSSRQQNEIEISTSAVRNWGIRNNIHASARVNLKPLPHREDGHIDASSPELINGDHYFHPILP

SEQ ID NO: 16522 - protein, 542 aa, Coxiella burnetii RSA 493
MLKRSISPFALLLTSVSAILGSGWLFAAYYTSELAGPSAILAWLIGGSAAIIIAFVFAELCAMLPITGSSTRIPYYTHGTLVSFLFAWIIWLTYASFASTEVQAVLQYFSYFFPSLVQSNAGLTGFGYFLATLLMLAISALNVFSLRWLLRCNNVLTLLKIAIPVIVALVILAVYFSPHQLLHPGHSSFMPYGMHGVFAAVSGGGIVFAFNGFKQACEMAGEAKKPARALPFAVIGSVIVCLIVYLLLQFAFLTSIIPSNLIHGWSHLALPGGTSPLTAVAHQGHLDILLPVLYAGAVIGPMAAALMYTSSAARSLYGMSKSHHIPPLFQRLLHGNPVVAIITNFLLGMSLFAPLPGWNSMITFLTSLIALTYGIGPICLLTLRKQLPDYQRPFKLPFVTVWATFAFYLCTLLTYWSGWAVISKLGIALVVGLLVLFIHRAFISPDERVPLNAKAALWVWPYLVGVTLISYLGDYGGGKGVIPPGWDFGVIGLFCIMIMWLALKFRLPTILTQHYMKDGDFTHQPPEQETDGTQEPAFAQHG

SEQ ID NO: 16523 - protein, 308 aa, Serratia marcescens
MTIRNLAVIGECMIELSQQGAQLTRGFGGDTLNTAVYLARQMPKQTLQVDYVTALGTDSFSGEMAWRQEKIETGLIQQFDNKLPGLYVIETDAAGERTFYYWRNDAAARYWLAGPQADALCARLAQFDYLYLSGISLAILAPADRTKLLTLLRRCRANGKQVIFDNNYRPRLWPSREETQQAYREVLACTDIAFLTLDDEELLWGKQPVEQIVTRTQALGVGEIVIKRGADACLVFNLEGERLEVPAIALPPERVVDTTAWGDSFSAGYLEVPLNGGGARQAAQRGHQLAATVIQHRGAIIPAAAMPA

SEQ ID NO: 16524 - protein, 461 aa, Streptomyces coelicolor A3(2)
MTVSPPSTASTASTGSTGSTGSTATTGPSAGLAAPPSEPSAPRAGTAAPTGRPDIVDLYLKHIGSGRAVMGRVMGGMAEVRSEGVWIHADDGRRFLDFGGYGVFIMGHRHPAVVEAVHRQIDTHPLASRVLLEPVAARAAQALAAHTPPGLDYVHFVNSGAEATEAALKLARAHGLTSVITTRSGFHGKTLGALSVTANTTYQTPFQPLLPDVTQVAYDDPADLEQALAAHRDRACVIVEPVQGEGGVRIPRPGYLGQVRALCRTYGALLVVDEIQTGMGRLGTWWGVDAEDVRPDVLLVGKGLSGGVVPVAAMVATAEAYAPFSRDPYLHTSTFGASPIACAAALATVRAMEEEDTVARAAALGPRILTAVRDVCAPYQGGLVREVRGRGLLIGIEFAEEQAVGELMLELISRGVLVNNSLNSTRVLRLTPPAVVEDSALDLFLTTLGAALRGTADRMTG

SEQ ID NO: 16525 - protein, 442 aa, Prochlorococcus marinus str. MIT 9301
MAIRLVLVRHGLSSFNAKGLIQGRTDDSLLTDEGYEQARKAGKALSKINFDKIYSSPLVRAAETAKTIKKTFTKDQDIVFDDNLLEVDLSEWSGLKIDEIKKKFPEIYPIWKSDPENLILKRKDNKTYKPIQELFFQATNFVENILKIYQDKDGANILVVGHNAILRCLILSLLGKPKQGFRKIRLENASLSILNISKEDNSFKTQIECLNQTSHLNKNIPNQIGDSRIFLIRHGETNWNKEGRFQGQIDIPLNENGKDQARKTFEYLRNISFNKAFSSSMERPYETAQIILQNRKDLKIERIDSLVEISHGLWEGKLEAEIREQWPVLLKNWHDKPEKVIMPEGESIKDVSERSVEAFEKICFSQKDNDLSLLVAHDAVNKTLICKILGINYSNIWMIKQGNGGITIIDLFNDPNKPPVISALNITTHLGGILDSTASGAL

SEQ ID NO: 16526 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDVDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 16527 - protein, 384 aa, Haloarcula marismortui ATCC 43049
MFLYLYSIFGNCFHPITRPGGCDRRHENGFPQPTRNGSMRAAIYRGPGDITVEEVPRPEIESPTDAIVRVTHTAVCGSDLWFYRGQSDREEGSRVGHEPMGIVEEVGDDVRSVEPGDRVFAPFVVSCGRCEFCRKGLHTSCVNGDSWGGDNGGGQGEYVRATEADGTLVRVPDRHADDEDTLEAILPLTDVMGTGHHAAVSAGVSEGDTCIVVGDGAVGLCGVLAARRLGAERIIAMGHHEDRLELAESFGATETVAARGQDAVDAADDLTNGGANHVLECVGAASAMETAIDVCRPGGTVGYVGVPHGLDDSGLDMFSLFGDNIGLNGGIAPVRAYADELLADVLQGTLDPSPIFTKTVDLNGVPEGYQAMDEREAIKVLVKL

SEQ ID NO: 16528 - protein, 380 aa, Zea mays
  misc_feature (322)..(322): Xaa can be any naturally occurring amino acid
LGDTIEQVCTKKQAGTGPEFPGSRVVRPAAAAPPPPRPRRLAPARCAAGSATDTATAGPTRVTTVSNRGDSLAICRVLNGMWQTSGGWGRIDRDAAVDAMLAHADAGLSTFDMADHYGPAEDLYGMFINRIRRERPPEFLEEVKGLTKWVPPPVKMTRSYVEDNINRSRKRMDVTALDMLQFHWWEYSNPGYLDALKHITDLKEEGKIKTVALTNFDTDRLQIILESGIPVVSNQVQHSIVDMRPQQRMAELCQLTGVRLITYGTVMGGLLSEKFLDTNVSIPFAGPPLNTPSLQKYKRMVDAWGGWSLFQTLLQTLKKVRXVAGSMVGVRLGLSEHIKDTNAIFSLELDEEDMNIITEVSKRGRNLIDIIGDCGDEYRA

SEQ ID NO: 16529 - protein, 300 aa, Ashbya gossypii ATCC 10895
MLRQSIKGIGSGSWIRCNSSSSTAALVYKQLHKHKVKPPVPKFETSSWSANSAVASILYETPAPSREPKKQCVLNCLVQNEPGVLSRVSGTLAAKGFNIDSLVVCSTEVPDLSRMTIVLQGQDAVVEQARRQIEDLVPVYAVLDYTNTDLIKRELLLTRISLLGAEYFEELVARHAGLTEACSDAAENVSADQTFHPSNLPLSELQRMKHEHLNAITNLATNFGGRVVDISESNCVVELSAKPSRISAFLKLIKPYGVLEVARTGMMALPRTPVDDETTNQENMVADASEAVDISQLPPG

SEQ ID NO: 16530 - protein, 111 aa, Picea sitchensis
MDPLVWHKVAGISGIAALGLGTYGAHMFKPANPAYKEVWHTASLYHLIHTAAMLAAPATKHPHIFGALLTSGIIAFSGTCYTVALLEDRKYSSMAPFGGFAFIGAWASLLF

SEQ ID NO: 16531 - protein, 349 aa, Picea sitchensis
MATTFGTINTSTSPHNPNKSFEIVQPPNDSISSLSFSPKANYLVATSWDNQVRCWEVLQTGASMPKASMSHDQPVLCSTWKDDGTAVFSAGCDKQAKMWPLLSGGQPVTVAMHDAPIKDIAWIPEMNLLATGSWDKTLKYWDTRQPNPVHTQQLPERCFALSVRHPLMVVGTADRNLIIFNLQNPQTEFKRISSPLKYQTRCVAAFPDKQGFLVGSIEGRVGVHHVEEAQQNKNFTFKCHRDSNDIYAVNSLNFHPIHQTFATAGSDGAFNFWDKDSKQRLKAMARSNQPIPCSTFNSDGSLYAYAVSYDWSKGAENHNPATAKHHILLHVPQETEIKGKPRVTASGRK

SEQ ID NO: 16532 - protein, 179 aa, Brassica napus
MENDVKVAEKVEEADRLLPPQSLPSNSDEEEPESESEAEAAFESRDKIVIVDFESAGDPAAVPPFSWRKLWLFTGPGFLMSIAFLDPGNLEGDLQAGAIAGYSLLWLLMWATAMGLLIQMLSARVGVATGRHLAELCRDEYPTWARYVLWSMAELALIGADIQEVIGRGVNWADWTNSF

SEQ ID NO: 16533 - protein, 198 aa, Streptococcus pneumoniae
GIEDILVVTGKSKRSIEDHFDSNFELEYNLKEKGKHDLLKLVDETTGIRLHFIRQSHPRGLGDAVLQAKAFVANEPFVVMLGDDLMDITDDNAVPLTKQLMNDYESTHASTIAVMPVPHEEVSAYGVIAPQGEGINGLYSVETFVEKPAPEDAPSDLAIIGRYLLTPEIFEILENQAPGAGNEIQLTDAIDTLNKTQR

SEQ ID NO: 16534 - protein, 247 aa, Ralstonia metallidurans CH34
MFTRLKEDIDTIMLRDPAARSRLEVLTCYPGLHAVVFHRVANACWRGGFHWLGRWISHWSRFLTGIEIHPAVKLGRRVFIDHGMGVVIGETAEIGDDCTIYQGVTLGGTSLYKGQKRHPTLGVGVVVSAGAKVLGGFEVGAGARVGSNAVVLKPVPAGATAVGIPARIIMPDAPSTQQGAKQEFSAYGITPNADDPVSLALKSLIDNAAKQHDRIEAVLAALDRLGEHLENTPNDRFDASELRKLMK

SEQ ID NO: 16535 - protein, 431 aa, Anabaena variabilis ATCC 29413
MLSIPINQHLPHTPHLVTSLPGPRAKAIVERDRAVTSPSYTRDYPLVVNRGEGCMVEDVDGNVFLDMTAGIAVTATGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHQQFPRMSLPRGKGLMVAVDLLDEDGNFDSKLRDRIIQEAFYHGLLLLGCGKAAIRFCPPLVINREQIQTTLDILAEILR

SEQ ID NO: 16536 - protein, 608 aa, Oryza sativa Japonica Group
MHPLCALPLLITLLLISSVPLSVQESDAFFRYTNCTTASYQCGSLKLDVDYPFSANGVDRPNYCSYPGYRLICNPDNKLMIHMNSTVFQVTDIDYGNKFLAVIDQTQPQETCPDRYHNTTIDESRFMYTDLDQFLTVYVNCSAKSSSLPFIYDLLSCVSGGSSYYRLHKNKDDSLESDILGSCSSSFVVPFNSTMAGSLAAGNSSLVDVIRGGFTARWKVGVGYRIMFFIRYRLYLLTNLRASQGSKISKKKAIAIGVSVVSGVILLFLLLMCTLCVKKFWHGLLSSMGKSKEAPNIESFLQKHEAQHPKRYSYSEVKTMTKSFSHKLGQGGFGTVYMGKMPNGKPIAVKLLKSCKDDGQEFMNEVASISRTSHVNVVTLLGYCIQGSKRALIYEFMPNGSLERFAFRPNSETEDSLSWEKLFDIAIGIARGLEYLHRGCNTRIVHFDIKPHNILLDQDFCPKISDFGLAKLCKQKESIISIDGARGTIGYIAPEVFSKQFGDASSKSDVYSYGMMILEMVGARKNISASADVSSKYFPQWIYEHLEGYCVTANEIRLDTSVLVRKMIIIGLWCIQLLPNNRPSMTRVVEMLQSSADDLKIPPQSFLS

SEQ ID NO: 16537 - protein, 198 aa, Streptococcus mitis
GIEDILVVTGKSKRSIEDHFDSNFELEYNLKEKGKHDLLKLVDETTGIRLHFIRQSHPRGLGDAVLQAKAFVGNEPFVVMLGDDLMDITDDHAVPLTKQLMNDYETTHASTIAVMPVPHEEVSAYGVIAPQGEGINGLYSVETFVEKPAPEEAPSDLAIIGRYLLTPEIFEILENQAPGAGNEIQLTDAIDTLNKTQR

SEQ ID NO: 16538 - protein, 198 aa, Streptococcus oralis
GIEDILVVTGKSKRSIEDHFDSNFELEYNLKEKGKTDLLKLVDETTGMRLHFIRQTHPRGLGDAVLQAKAFVGNEPFVVMLGDDLMDITNEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 16539 - protein, 275 aa, Cryptomeria japonica
VVEQQGLAAKDYTDPPPAPLVDFEEFKLWSFYRALIAEFIATLLFLYITVATVIGHKRTAANCGSVGILGIAWAFGGMIFVLVYCTAGISGGHINPAVTFGLFLARKVSLPRAVLYMVAQCLGAICGVGLVKAFQKSFYDMYGGGANSVAPGYSKGTGLGAEIIGTFVLVYTVFSATDPKRSARDSHVPVLAPLPIGFAVFMVHLATIPITGTGINPARSFGAAVIYGHDKIWDDQWIFWVGPFLGAFAAAFYHQYILRAAAIKALGSFRSNPNV

SEQ ID NO: 16540 - protein, 770 aa, Oryza sativa Japonica Group
MGISSAIQWWDEWQLRILALSSLLVQYILLVMAPRRKFPMKFYLRYIIWLAYLSSDALAIYALATLFNRHKKQDYGHAHNTSILEVLWAPIFLIHLAGQDSITAYNIEDNELWTRHALTSLSQITIAIYVFCKSWPGGDRRLLQAAILLFVPGVLKCLEKPWALSSASINSLVSSPKNVRRTTNREVKKDPIQDFIDKVNESRLEDGRWEESSSPADFKPSELFVDLASPSSDDRLSKLLSFLQREGDESYILLQKSLYETFDLLYTKEKMFPIILSALKRQQNYVNTNVDTDEGKKEQETLKGFCGSMLRGLLPYLSFVAIGLFHQSHRKAYNHTDVKVTYTLLCCTAVLELYGPTLQKILTSGQARVQKTSFNMNSPKSVGKVNHAKHDVQAKSKAKGKLPVYDIMDDMVSQYSLLGYFVRNRKHSVIMGVAEFLSCKDYLDQRWRMKSCSSSRNITNLVLGHVKRWWNDEITNVSCYRKFNDNRGQWTLESEVFLQQLGWSLEGAFDESVLLWHLATDFCYYHICGSHDCEHATKTCFQGTSDLKSESPTFCEESIHQGRAVHCREMSNYMMYLLVVNPEMLMAGSRRNLFTDAYNQLKGMFNKKSTPLNEGELAGTIISEVQVHVQQPIKEKTIEDKTPAPSNKTGLIDDAWSIAEVLLNLHDEEKMWRVIEGVWVEMLCFSAARCRGYLHAKSLGTGVEFLSYVWLLMHYMGMETLAEKLARAELPNGACSGDSRTTHAEHSSGKEQVAGASSNDGITVVVDKNG

SEQ ID NO: 16541 - protein, 322 aa, Coccidioides immitis RS
MENYQKIEKIGEGTYGVVYKARDLSNQGRIVALKKIRLEAEDEGVPSTAIREISLLKEMHDPNIVRLLNIVHADGHKLYLVFEFLDLDLKKYMEALPVSEGGRGKALPDGSLNMSRLGLGEAMVKKFMAQLVEGVRYCHSHRVLHRDLKPQNLLIDRDGNLKLADFGLARAFGVPLRTYTHEVVTLWYRAPEILLGGRHYSTGVDMWSVGAIFAEMCTRKPLFPGDSEIDEIFKIFRIRGTPDERSWPGVTSFPDFKSSFPKWRREDIRKIVTGLEESGLLLLDAMLEYDPARRISAKQACVHPYFRSCSSTYSGRSKTNYQ

SEQ ID NO: 16542 - protein, 128 aa, Mesostigma viride
MQAVAMSVSVPSVAAFAPALPQRLVARKPQAAARVPAKCARKAVVCQAQKNEAAVAVSAAAIASSVAFAAPAQAIIEDAMYTEGAGIALGLNSGALGFVMLGAFTLVWSLYSSYTRSLDSSEDGGLDL

SEQ ID NO: 16543 - protein, 500 aa, Solanum lycopersicum
MAIGSLARRKASTILSSRYLKYSFSLSRGFASGSDENDVVVIGGGPGGYVAAIKAAQLGLKTTCIEKRGTLGGTCLNVGCIPSKALLHSSHMYHEAQHSFASHGVKFSSVEVDLPAMMAQKDKAVAGLTRGIEGLFKKNKVNYVKGYGKFLSPSEVSVDTVEGGNTIVKGKNIIIATGSDVKSLPGLTIDEKRIVSSTGALALTEIPKKLVVIGAGYIGLEMGSVWGRLGSEVTVVEFASDIVPTMDGEVRKQFQRSLEKQKMKFMLKTKVVSVDTVGDSVKLTLEPAAGGEQTTLEADVVLVSAGRVPFTSGLGLDKIGVETDKAGRILVNERFASNVPGVYAIGDVIPGPMLAHKAEEDGVACVEFIAGKEGHVDYDLVPGVCYTHPEVASVGKTEEQVKALGVDYRVGKFPFLANSRAKAIDDAEGIVKVIAEKGTDKILGVHIMSSNAGELIHEAVLALNYGASSEDIARTCHAHPTMSEALKEAAMATYDKPIHM

SEQ ID NO: 16544 - protein, 231 aa, Zea mays
MASSSDPWMKEYNEASRLADDISSMIADRGSLPQSGPEIMRHTSAIRRKITILGTRLDSLESLFGRIPPKSITDKEMHKRQDMLSSLKSKAKQMATSFNMSNFANREDLLGQSKMPDDMSRVAGLDNQGIVGLQRQIMKEQDEGLEKLEETVLSTKHIALAVNEELTLHTRLIDDLEDHVDVTNSRLQRVQKRLAILNKRTKGGCSCTCLLLSVVAIVILAVIVWLLVKYL

SEQ ID NO: 16545 - protein, 411 aa, Vibrio sp. Ex25
MSEIPIYVDFIGKGRHVCSLIYFFCIFILEVVLGKLALLVLEDGTVFHGVSIGADGISVGEVVFNTSMTGYQEILTDPSYSQQIVTLTYPHIGNTGTTSEDEESSSIHAQGLVIRDLPLIASNFRNEQSLSDYLKSQNIVGIADIDTRKLTRILREKGAQNGCIFAGNNLDEALALAKAKEFPGLKGMDLAKEVTTKEAYQWKQGSWTLEGGLPEAKDDSELPYHVVAYDFGAKRNILRMLVDRGCRLTVVPAETSAEEVLAMNPDGVFLSNGPGDPEPCTYAIEATKVFLEKGLPIFGICLGHQILALASGAQTVKMKFGHHGANHPVKDLERNVVMITSQNHGFAADEATLPENLRATHVSLFDGSLQGIHRTDKPAFSFQGHPEASPGPHDAAPLFDHFIELIKKHSA

SEQ ID NO: 16546 - protein, 364 aa, Shigella flexneri 2a str. 301
MMSKNYHIAVLPGDGIGPEVMTQALKVLNAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDIQCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 16547 - protein, 279 aa, Haloarcula marismortui ATCC 43049
MTQQQSPTDGGPRASGMPMLGLGTWQNEDAEQCAESVRTALEAGYRHIDTAQAYDNESAVGDGIAAADVDRDDIFLATKVWISNLSHDDVIETTEESLDKLGVDSVDLLYVHWAAGEYEPEETLPAFDELVDRGLIDNVGVSNFEPHHVETAMDVLDAPVFANQVETHPFLQQSELREHAAEQDYELVAYSPLARGEVFGHDVIEAIADDHDASEAQVSLAWLREKGVTAIPKATSEAHITDNLASLDLSLTDADIDRIDNIDTVDRRVDPDFGPAAWD

SEQ ID NO: 16548 - protein, 372 aa, Ashbya gossypii ATCC 10895
MAAVKRIVVLPGDHIGREVVEEAVKVLGAVEQSLSDVHFDFQYHLVGGAAIDATGSALPDEALGAAKEADAVLLGAVGGPKWQGGAVRPEQGLLKLRQELGVYANLRPCNFAADSLLELSPLRPEIARDTDIMVVRELLGGSYFGERHEDEGDGVAWDTDKYTVKEVQRIARMAGFLALQHDPPLPVWSLDKANVLASSRLWRKTVEETFQSEFPNVQLQHQLIDSAAMILVKNPRAFNGVVVTSNMFGDIISDEASVIPGSLGLLPSASLASLPDSKSAFGLYEPCHGSAPDLPAGKANPIGCILSAAMMLKLSLNMVAAGEAVEQAVQEVLDSGVRTGDLLGSSSTSEVGDAIALAVKEALRRQSAAGLS

SEQ ID NO: 16549 - protein, 389 aa, Helicobacter hepaticus ATCC 51449
MVLDNVSLIMMAAGDSTRFCASNAQTFRCKKQWLRVGEEPLWLVATRNLTHHFSFKQVILTASSKDYVYMQNISPYKVVQGGQTRCQSLRNALKYVDTPLVLVSDVARWDSSDSIIKTMLKALDESVACVVPFVGVADTSFYEGEYLKRESIKLIQTPQLSRVEDLQEALKDTSKDFSDESSALYALGKKIAFVQGSELMNKLTFSSDLKAHITRLSPPSKRVFIGNGIDVHQFEKNKQMWLGGVEIESPFGFKAHSDGDVVLHALSDAILGAIGGGDIGEWFPDTDETYKNADSKMMLSEIYTFAQSVGYELYNADISIIAQTPKIAPYKSAMRECIARILRVPNAHINIKATTTEGLGFVGREEGVCVEACVSMGFINWHTYIKDLH

SEQ ID NO: 16550 - protein, 313 aa, Anabaena variabilis ATCC 29413
MSPKTALNLFSLLWQNYSARVPYARTYEQMITAAGGTVANDHIAFRSLRLLVDSPRGKVNLGINYLSQIAEALGYEPAGEYNFPQTHLYARHYRHPQQIEFDLPKLFISELIVDELPDNIIQLITQTVSTVADEFTSPLTYFSPAEGNDGVIAQQLQKFFTRPWMTPRRSVVEAVNQVTQYGAWVLLHGYAVNHFTGYVNRHQTPEYADIDDTARGLANLGVPMKAEIEGDVTWGLRQTATQAVKEMVTVIDDISGQEVEIPWTYAYYEIAQRYPLQVEPGKEKLFDGFLGNNAQQLFEMTRLVECDAAKIGK

SEQ ID NO: 16551 - protein, 525 aa, Graphium sp. ATCC 58400
MMDPFYLLGGCCVFGIVYKSVATLYVNYVHGKTARELGCKPLPKERTRFFGLDILRREMKADREMYLPSDIMTRFEEVGATTYEYQMLNEKHIATCDPLVIQTVLATQFKEFTFGNRPWGTVLGNGIFSIDNIGDNKEWLHTRAMLKPQFLRNQVSDLELEEGHVRNFMSVLKVGDDGWTPKVNLQHMFFNFTLDSATEFLFGKSADCQLLFAPGGDPKGVSKPLRAFLKALDVAKETVNTKWFLGNNGWIADSPTFRKNCAYVNDFMDALIAKTKAELEAKPKGSKPSGGREKYHFLHAMLDETDDKVELRGQALNILLAGRETTASLLGWLWYYLARHPIEFQKLRAAVLKDFGTAENPKPMSFESLKACDQLQYCNNEILRLFPLVSYNSRMALTDTTLPRGGGPDGNSPIFVKKGQQIVYHPHAMHRRKDIWGQDADEFRPDRWKTLRPGWEYIPFNGGGRICMGQQFALTEASYLTVRLLQRFDRIENLDPNPVLKQKFRIVNTPGEGVLVRLHEAAAGA

SEQ ID NO: 16552 - protein, 183 aa, Microcystis aeruginosa PCC 7806
MSLDNLRSTSNFWPIVDVSQAAFIAPNATVMGDISLAVGVSVWYGAVLRADVERIEIGSYTNIQDGAILHGYPGKITILEDYVTIGHRAVIHAAHIERGCLIGIGAVILDGVRVGAGSIVGAGSIVTKDIPPRSLVVGIPAKRVREVSSQEAQELIEHAERYAKLALVHGGKGTDTGFPKGAV

SEQ ID NO: 16553 - protein, 500 aa, Campylobacter upsaliensis RM3195
MANLYLMRSKSDDLNTLITKKLLANYTKHYKNVAIYCPVIYVHRIAAVQEWLEEFNIKQSSKESYGFTLRDAMNTFSHDSHYFFNKILEEYENLKAKYDFVLVTSFSEFGILDGFELSVKLAKNLNTPIAAIIDQKDQNIAKKIFDESLKGEKYALIDANFDFNELINLKEYEFITPNRFKFELIKKSVKNKKIVVLPESDDERILRASEILLRSNVVHLILLGNETKIKEDALKLGLDLNGIEVLDPANSPLCEEFSAMLYEARKAKGMSLEEAAKLVKDRTYFGTLLVHSQKADAMVSGASTTTAETIRPALQIIKTKEGINSVSGIFFMGLEDKVLAFADCAVNPNPTAEQLAQSAYVSALSARAFGLEPRIAMLSYSSGDSGKGESVDLVNEALKIAKEKYPDLQIDGPMQFDCAYDSKTAAKKMPNSTIAGKANVYIFPNLDAANICYKAVQRTANALAIGPILQGLKKPVNDLSRGCLVEDIVDTVILSAIQAQ

SEQ ID NO: 16554 - protein, 407 aa, Streptomyces avermitilis MA-4680
MAAEIVNPRSDSSTDQEGGAEPLDSFDPAFALHRGGKMAVQATVPIRDRDDLSLAYTPGVAKVCTAIAEQPELVHDYTWKSSVVAVVTDGTAVLGLGDIGPEASLPVMEGKAILFKQFGGVDAVPIALGTTDADEIVETVVRLAPSFGGVNLEDISAPRCFEIERKLQERLDIPVFHDDQHGTAVVTLAALRNAAKLTGRTLGELRAVISGAGAAGVAIAKFLLAAGLGDVAVADRKGVVSKDRDDLTPVKRELAEITNKAGLSGSLESALAGADVFIGVSGGTVPEPAVASMAEGAFVFAMANPNPEVHPEIAHKYASVVATGRSDFPNQINNVLAFPGIFAGALQVRASRITEGMKIAAADALADVVGDDLAADYVIPSPFDERVAPAVTAAVAAAARAEGVARR

SEQ ID NO: 16555 - protein, 304 aa, Triticum aestivum
  misc_feature (161)..(161): Xaa can be any naturally occurring amino acid
  misc_feature (175)..(175): Xaa can be any naturally occurring amino acid
  misc_feature (196)..(196): Xaa can be any naturally occurring amino acid
  misc_feature (233)..(233): Xaa can be any naturally occurring amino acid
MASATLLKSSFLPKKAEWGTTRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLAXSREAAYYQQGARFXAKWRTVVSIPNGPSELAPEIXLDGEHGIERTFEVAQKVWAETFYYMAQNNVMFEGILXLKPSMVTPGAECKDRATPEEVASYTLQLLQRRIPPSVPGIMFLSGPYSRRSPPTPSVRPRRSSRCRAHRRA

SEQ ID NO: 16556 - protein, 646 aa, Oryza sativa
MDHIFSTNAWLTIALVFIITLAAKVAVIREQHRALGSVFTLRSLGLAVTFLVGPECSDHFFHAPELEIAIDGLYEVTVPIFGKEVGYDIDLDTRNEQHRFFAKMLRPAKLRGHVLPMEYFGKWGECGVVDLMQEVDHVLMLIASRCLLGKEVRENMFDEVASLFHELMGGMHLISMFFPYLPTPGHRRRDKARAKLGEIFSQIVKTRKMSGRVEDDMLQDLIDSTYGDGRATTDTEVTGLLVALLFAGHHTSSTVAVWTALRLLTHPEHLRAVRAEQERLVAAAEQQRSHHGGGGGGGIDYGVLLQMDVLHRCIKEALRLHPVTPMILRRARRGFTVRDKEGGEYSVPAGRLLASPLVVNTLLPNIYKDPHVFDPDRFAAGRAEDKAVAGARDLAYLSFGAGKHACMGEGYAYQQIKVILSHLVSNFELKLESPFPETEDMLSMRPKAAVAPSPSPNPAGGEPVGVWPMEAAGRSSQRGGGGPRRLSGGGQRHGKAIGTRGSQIRRWWWRRPSTVGNAQASTSSPNSPRFAMVSSLQPAPMMELINATFVPLLPSLSVETTVTVGRSCIRRRRQSTPVEDQSPDLFDLIEDYFDGTLHTLNFITALDKSLHRAHDSKLILHLVLQRRYHHHAEASELYASMLGELH

SEQ ID NO: 16557 - protein, 416 aa, Ralstonia metallidurans CH34
MALIVHKYGGTSMGSTERIKNVAKRVAKWHRAGHRVVVVPSAMSGETNRLLGLAKEISAQPDPRELDMLASTGEQASVALLAIALHGEGIDAVSYTGWQVPVKTDSSYTKARIESIDDERILGDLDAGKVVVVTGFQGIDGDGNITTLGRGGSDTSAVAIAAAIEADECLIYTDVDGVYTTDPRVVEDARRLDQITFEEMLEMASLGSKVLQIRSVEFAGKYRVKTRVLSSLTDPLMPLEQEMHSGTLITFEEESEMEAAVISGIAFARDEAKITVLGVPDKPGIAYQILGPIADANIDVDMIIQNQSVDGKTDFTFTVPRGDYQRALTILNDNVKGHIGAESVSGDPKVSKVSVVGVGMRSHVGIASKMFRTLSEEGINIQMISTSEIKISVLIDEKYMELAVRALHKVFELDQA

SEQ ID NO: 16558 - protein, 54 aa, Glycine max
MFPGMFMRKPDKAAALKQLKSHAAMFGTWVVVIRVTPYVLHFLCAEKEELKLEL

SEQ ID NO: 16559 - protein, 501 aa, Ralstonia metallidurans CH34
MFAKIVATYRYFMSVVPFRLTPAIITTVVLVTLLLTPTPAGLKDNAWDLVAIFLTTIVAIILKVMPIGVMAMMAIVIVSLAQVTSNSSKGAIADALSSFDSPLIWLIVVAILISRGLKKTGLGSRIGLMFIALLGKRTVGIGYGLAICELVLAPFTPSNTARGGGIVHPIMRSIAGAFDSDPANGTQGKVGTYLALVNYHANPITSAMFVTATAPNPLVVDYVAKASGQSLHLSWTTWALCMLLPGLVCLLLMPLVIRVLCPPELKATPNAIEYAKGELARMGPLGGKERVMIGVFAMMLVLWANVPAMIWGPTFTLDPTVVAFLGLFALIITGTIDWDDVLSEKSAWDTLIWFGALVMLAEQLNKLGVIAWFSADMRDAIAASGMGWLSIAAILVLAFVFSHYLFASTTAHISAMMLAFLTVGAQLIPQPYIAPFMLMMTAGSAIMMTLTHYATGTSPIIFGSGYVTMGQWWRVGAVMCVFELVIFAVVGGIWWKILGFW

SEQ ID NO: 16560 - protein, 548 aa, Propionibacterium acnes KPA171202
MSRKPEPMTNPITNRGTAFTRAERLEHGMIGRLPAAVETLEQQAQRCYRQLQGLGCNIDRYVFLEELQNRNETLYYKLLVDHLVELLPVIYDPTVGEAIKKWSHAYRRSRAVYLSVDHIEDVRPSFETLELGPDDVDLLVVSDSEQILGIGDWGVNGTDISIGKLAVYTAAAGIRPERTIAVNLDVGTDNAYLLNDPSYLGNRHARVRGERYDELIHEYLEVASELYPHALLHFEDFGASNARRILVQNAANHRIFNDDMQGTAAIVLAAVISGLKVTRQSFADQRLIVYGAGTAGTGIADQIRAAMISDGLSQQEAVDRIWLVDRNGLVTDDMKGLPDYQEPYAKPVEKTRHWAHTNRHIGLTETIRRIHPTILIGTSTDHDAFTQQVVEEMCREVERPIIMPLSNPTEKIEAMPADVIAWSKGKALVSVGIPVAPFHYEGTRYEIGQGNNALLYPGLGLGVIVSGAERVSARMIRAAAEAVASQVDPRPAGSSLLPAVENLRASSATVAVAVVQAAIEEGLATKKPSNVVQAVQDAMWWPHYPPVG

SEQ ID NO: 16561 - protein, 679 aa, Dehalococcoides sp. VS
MSIWIALVVGLAGLVVAGLLARFVLRQDEGIAKVKEIASAIREGAMAFITREYTVMAIFVAAVTIILALLPSLGWPVSVSFLFGALCSGLAGFIGMSIAVRANSRTTTAASHSLNQGLKFSFRAGSVMGMSVVGIGIIGLSIMYFAFGSNADFLQILPGYGFGASSVAIFARVGGGIFTKAADTGADIVGKVEKGIPEDDPRNAAVVADFVGDNVGDVAGMGADLFESYVDSIIATMALATVGAFSMKLGYSLVPSEEAAFFLPMLVAAGGILASVIGIFLVRTGEKLQMKALLAALRKGTLAAAFLSAVFSFLAVWYLQADLGLFFAILAGLVAGVLIGESTNYFTSYVYKPTLDIAASCQTGAATNIISGFSVGLLSVVPPIILVVAAIVIAYTFGDVYGVALAGVGMLATLGIQDATDAYGPVADNAGGIAEMAGLPKEVRERTDALDSLGNTTAAIGKGFAIGSAGLTSLALLLSYTQAVGISASQVSLLDVKVLAGLLLGVMMPAVFCSLTLKAVGVTSFSIVNEVRRQFKEIAGIMDGTAKPEYGKCVDICTRDSIKQMILPGIITVVSPVIVGWLLGSVAVVGFLAGIILCGFILAVTFANAGGAWDNAKKWVETGAYGGKGSDAHKAAVVGDTVGDPMKDTAGPSLNIMIKLVAIIALVMAPILANFSGII

SEQ ID NO: 16562 - protein, 342 aa, Ralstonia metallidurans CH34
MPAMMKAAVVRAFGAPLTIDEVPVPQPGPGQIQVKIEASGVCHTDLHAAQGDWPVKPSLPFIPGHEGVGFVSAVGANVKRVKEGDRVGVPWLYSACGYCEHCLQGWETLCEKQQNTGYSVNGGYGEFVVADPNYVGLLPKNVDFIEIAPILCAGVTVYKGLKVTDTRPGQWVVISGIGGLGHVAVQYARAMGLRVAAVDIDDAKLAFARKLGAEVAINARTTDPAAFLQKEIGGAHGVLVTAVSPQAFSQAIGMVRRGGTISLNGLPPGDFPTPIFDVVLKAITIRGSIVGTRSDLQEALEFAASGVVKATVSTEKLDSINSIFDRMKAGQIEGRIVLDFSR

SEQ ID NO: 16563 - protein, 451 aa, Mycobacterium avium 104
MALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 16564 - protein, 263 aa, Propionibacterium acnes KPA171202
MSGKIAVLGCGTMAGALVGGLIDAGQMKAEDVVATARSASHRDEIANTLGVTTSGDNTTAVRDADLVILGVKPYAAVDVLEEVSGALKADAVVVSIAAGVTTEKLLMAWQGKIVRVMPNTPVRVGKGAFIVSSAPGSEDAAKKVGDLLESVGVVVTVPEELHNAATAVSGSGPAYVFLVAEAMIDAAVALGVPRDQASQLTVATLAGSAELLAGGEHPAVLRSKVTSPGGTTAAAVAALEAGGVRSVFADAMTACRDRAAGLS

SEQ ID NO: 16565 - protein, 566 aa, Vitis vinifera
  misc_feature (8)..(8): Xaa can be any naturally occurring amino acid
MTSVLDAXVDMKCYESLLFVAAGSSVSIIDLRTMQRVITTSCGTEDGLVWFRDFTDATCPVSSSHEDKSSSKFWDPVSERGIGTSGLSGLRDSSEQQLNQAITINQSVSLNGTSLLPNDCQKLPGLVLGFVSSSTSLSLTTESKYNEKTKIKDVGTVESKLGVVAADDGHCSGIGAFMLRKGGLAVNAEVATAWRVGIFNPMASGIGGGAFMIVQSSSTSKSEAFGGRETAPLVAPQNMYENNYRAQYLGTLAMGVLKEIAGLRDAGLKHGRLVWRSLFQPAIRLAKYGSVRSLLEEELNEKLSFLGGLAAAFRDQVHTDIEIKPGHNGPSLFAHRALLPARSEIFKNMLDLEGCKAAPSNTITLPELNHEELVSLLEFLYSGAATAGQAYEAIMEIKLLQWQPWPLSGQLASGTDLMTEGTFALVGIFHGKDSWFPACDDVFLPRRVGNPPGMRKKSRCSTALLPERVVQTLNLKLDDVGSQTQLHPRFNGSFAPDVDAAMDLMSLRFISNQSLLAAVQSGDLELLKQIIHKLIEEELSDQASISALMAENELKTTVLKTPRALE

SEQ ID NO: 16566 - protein, 402 aa, Ureaplasma parvum serovar 3 str. ATCC 700970
MNDYKQFFPWFKNNKDVIYLDSSATSLKPQVVIDAIVDYYTKYSTNPHNTDSNFTFHTHEIMNETRANVAKFINANFDEIIFTSGATESLNLIANGLRPHLKKGDEIILTYIEHASNLLPWYKLRDDLGVKIIFANQKNQFPQLSDFLKVISPKTKVVSFASGGNLIGNVLDENLIIKNIKKIKPDVLVCVDATQSIQHRMFDVKKCKSDFMVFSAHKLLGPTGIGVAYIKNDLIKKMQPLKYGGGMNFSIDLNSYQLYDNYMKFEGGTPHVAGFYGFNAALKFLMDIGYNKIHEHELKITKYARDQLALIPEIKTYVQDATSSTITFSYNGVFCQDFANYLGSKNIIVRSGLSCAKIINNVIQTECAIRASFYIYNDFNDVDRLIKAIKEYQKGDELNGIL

SEQ ID NO: 16567 - protein, 251 aa, Yersinia pestis KIM
MVDQEKETTHFGFRTVAKEQKEGMVAEVFHSVAAKYDLMNDLMSFGVHRIWKRFTVDCSGVRRGQRVLDLAGGTGDLTAKFSRLVGEQGEVILADINESMLRMGREKLRDKGIVGNVSYVQANAEALPFPDNYFDCITISFGLRNVTEKEKALRSMFRVLKPGGRLLVLEFSKPLLEPLSKAYDAYSFHILPKIGELVAQDAESYRYLAESIRMHPDQETLKGMMADAGFENVTYSNLTGGIVALHRGFKF

SEQ ID NO: 16568 - protein, 346 aa, Prochlorococcus marinus str. MIT 9301
MFGLIGHSTSFEDAKRKASMLGFDHIADGDLDVWCTAPPQLVENVEVKSATGISIEGSYIDSCFVPEMLSRFKTARRKVLNAMELAQKKGINITALGGFTSIIFENFNLLQHKQIRNTSLEWERFTTGNTHTAWVICKQLEINAPRIGIDLKKATVAVIGATGDIGSAVCRWLINKTGISELLMVARQQEPLALLQKELDGGTITSLDEALPQADIVVWVASMPKTIEIDTDNLKKPCLMIDGGYPKNLDEKFQGENIYVLKGGIVEFFNDIGWNMMELAEMQNPQREMFACFAEAMILEFEKCHTNFSWGRNNISLEKMEFIGAASLKHGFSAIGLDKQPKVLTV

SEQ ID NO: 16569 - protein, 503 aa, Coprinopsis cinerea okayama7#130
MTLTNAPPTATQATGSSPNAVPVEAMFSLIMDAVRESHKDISELRKECHELRLANAALERQVREGLQWNLHTSRNGTPGFMTPAPASPRLLPKSPFLSPPVPSVPSITTSGPETPYFKPSPLGDNALTAFPYGTRDIPGFYVVIPAGGAGTRLWPLSREGHPKFLLDLTLKGRSLIQATWDRLLPLSSAERTTIVAGPSHVRSIREQLPDLLPHNLFTEPGPKDSMAAIGLAAAILAKRDPQAIIGSFAADHMISGDDAFLSAVAEAVEVAKKDFLVTIGIAPSHPSTGFGYVRLGDKLGFKEAPNARLVSSFKEKPDARTAASYIATGNYRWNAGMFVTKATFLLELLKEYQPELHDGLIQIAEVWDDEVKRQTVLGEVWPGLEKIPIDNAVAEPAAAEGRVAVVPATFGWDDVGDFSSLADLLPAEANQPRVLGDSSFVLTEQVAGGIVVPGSGRLITCLGVDDLVIVDMPDTLLVTTRARSQEVKRLVKKCRDAGHKDLL

SEQ ID NO: 16570 - protein, 204 aa, Bacteroides fragilis YCH46
MLIIGIAGGTGSGKTTVVRKIIESLPAGEVVLLPQDSYYKDSSHVPVEERQNINFDHPDAFEWSLLSKHVALLKEGKCIEQPTYSYLTCTRQPETIHIEPREVVIIEGILALCDKKLRNMMDLKIFVDADPDERLIRVIQRDVVERGRTAEAVMERYTRVLKPMHLQFIEPCKRYADLIVPEGGSNQVAIDILTMYIKKHIGRP

SEQ ID NO: 16571 - protein, 810 aa, Shigella flexneri 2a str. 301
MSVIAQAGAKGRQLHKFGGSSLADVKCYLRVAGIMAEFSQPDDMMVVSAAGSTTNQLINWLKLSQTDRLSAHQVQQTLRRYQCDLISGLLPAEEADSLISAFVSDLERLAALLDSGINDAVYAEVVGHGEVWSARLMSAVLNQQGLPAAWLDAREFLRAERAAQPQVDEGLSYPLLQQLLVQHPSKRLVVTGFISRNNAGETVLLGRNGSDYSATQIGALAGVSRVTIWSDVAGVYSADPRKVKDACLLPLLRLDEASELARLAAPVLHARTLQPVSGSEIDLQLRCSYTPDQGSTRIERVLASGTGARIVTSHDDVCLIEFQVPASQDFKLAHKEIDQILKRAQVRPLAVGVHNDRQLLQFCYTSEVADSALKILDEAGLPGELRLRQGLALVAMVGAGVTRNPLHCHRFWQQLKGQPVEFTWQSDDGISLVAVLRTGPTESLIQGLHQSVFRAEKRIGLVLFGKGNIGSRWLELFAREQSTLSARTGFEFVLAGVVDSRRSLLSYDGLDASRALAFFNDEAVEQDEESLFLWMRAHPYDDLVVLDVTASQQLADQYLDFASHGFHVISANKLAGASDSNKYRQIHDAFEKTGRHWLYNATVGAGLPINHTVRDLIDSGDTILSISGIFSGTLSWLFLQFDGSVPFTELVDQAWQQGLTEPDPRDDLSGKDVMRKLVILAREAGYNIEPDQVRVESLVPAHCEGGSIDHFFENGDELNEQMVQRLEAAREMGLVLRYVARFDANGKARVGVEAVREDYPLASLLPCDNVFAIESRWYRDNPLVIRGPGAGRDVTAGAIQSDINRLAQLL

SEQ ID NO: 16572 - protein, 401 aa, Oryza sativa Japonica Group
MADRYFPNDLPDFVAEAPDGGRGLLSLPYSSLSERLLRAALRIKDKVMEETWTRARRQVTDYTLYTGALGTALLLFKSFQVTGNRADLALAGDIVKECDAASRGLPRRFLTFICGRAGVCALGAVIAKHCNDQLLLTHYLSSFDEIIVTEKVPNELLYGRAGYLWACLFLNTHLGEKTIPHEHITSVAKDIIDEGRKLAKKGNCPLMYEWHGKKYWGAAHGLAGIMHVLMHTELKLDEKDDVKNTLLYMIRNRYPTGNYPSSEGSESDRLVHWCHGAPGVALTLAKAYQVFHDEHFKQTAAEAAEVVWNRGLLKRVGICHGVSGNAYVFLSLYRLTGNVEYLYRAKAFACFLLEKADQLIADGAMHGGDHPFSLFEGRAGMAYLLLDMVSPSESKFPAYEL

SEQ ID NO: 16573 - protein, 399 aa, Oryza sativa Japonica Group
MADRYFPNDLPDFVAEAPDGGRGLLSLPYSSLSERLLRAALRIKDKVMEETWTRARRQVTDYTLYTGALGTALLLFKSFQVTGNRADLALAGDIVKECDAASRGLPFLTFICGRAGVCALGAVIAKHCNDQLLLTHYLSSFDEIIVTEKVPNELLYGRAGYLWACLFLNTHLGEKTIPHEHITSVAKDIIDEGRKLAKKGNCPLMYEWHGKKYWGAAHGLAGIMHVLMHTELKLDEKDDVKNTLLYMIRNRYPTGNYPSSEGSESDRLVHWCHGAPGVALTLAKAYQVFHDEHFKQTAAEAAEVVWNRGLLKRVGICHGVSGNAYVFLSLYRLTGNVEYLYRAKAFACFLLEKADQLIADGAMHGGDHPFSLFEGRAGMAYLLLDMVSPSESKFPAYEL

SEQ ID NO: 16574 - protein, 355 aa, Manihot esculenta
MESKMSFLVLSNFLLLSLLLPTSSAQLSKNFYSGTCPNVESIVRSEVQKKFQQTFVTVPATLRLFAHDCFVRGCDASLLLSSPSNNAEKDHPDNLSLAGDGFDTVIKAKAAVDSVSQCRNKVSCADILALATRDVVSLAGGPFYEVELGRRDGRISTKASVQHKLPSADFNLDQLNSMFASLGLTQTDMIALSGAHTLGFSHCNRFSKRIYNFSPRNKIDPTLNLQYALQLREMCPVKVDPRIAIDMDPTTPQKFDNAYYGNLIQGKGLFTADQILFSDSRSRPTVNLFASNNAAFQNAFVSAMTNLGRVGVLTGNKGEIRTDCTRYQLEESRIALFFFFGFIFRVDFFFLCMFS

SEQ ID NO: 16575 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPQAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPFPHDAAPLFDHFIELIEQYRKTAK

SEQ ID NO: 16576 - protein, 494 aa, Klebsiella aerogenes
MSEITLLAEVTAFLRQPHGQFIAGQREAGRGAPFAVINPATGRAIAEVTAADSDQADRAMESARQALSQWREMPTLARGALLLKLADTLAEHREALAQLESLCSGKTITLVRMLELDQSVALLRYFAGWAGKVTGETLDVSLPSMAGEKYTAFTRRQPLGVVVGIVPWNFSIMIAIWKLAAALVCGCTIVLKPSEYTPLTLLRVAELAKAVGIPDGVINVVNGAGGEIAQRLITHPACAKVSFTGSVATGEKVQQSASASGKRVTLELGGKYAALFLDDLTPEAMVNGIIEAGYLNQGQICAAAERFYLPQGKLDAVLALLKDKLSAFAPGSPLDERTLMGPLANRQQYDKVLRLIQTARDEGDTIVCGGEALPGEGYFLQPTAVKVRSEESTLMREETFGPVCSFIGYRSEEEALARINASPYGLAASVWSDNIRQALRYSEAIEAGIVWVNMHTFLDPAVPFGGMKGSGIGREFGSAFIDDYTELKSVMVRY

SEQ ID NO: 16577 - protein, 334 aa, Streptomyces avermitilis MA-4680
MTVRVGINGFGRIGRNVFRAAATRGADLEIVAVNDLGDVATMAHLLAYDSILGRFPEEVTAEPGAIRAGDTTVKVLAERDPAALPWGDLGVDVVIESTGIFTDAAKARAHVDGGAKKVIIAAPASNEDVTVVLGVNQDAYDPERHTIISNASCTTNCLGVLAKVLHDAVGIESGMMTTVHAYTQDQNLQDAPHKDLRRARAAGLNIVPTSSGAAKAIGLVLPELQGRLDAFALRVPVPTGSVTDLTVTASRSTTVEEVKEAYAKAAAGAYKGLLSYTEAPIVSTDIAGDPASCVFDAELTRVLGSQVKVVGWYDNEWGYSNRLIDLALLVGDTL

SEQ ID NO: 16578 - protein, 524 aa, Arabidopsis thaliana
MESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGTLIDVLKHRKKSTKRSENCRSRRTAISVAEFEELLFRYQVEKETNFLHHSEFLVLFFSSLASQTQKREVYFYFKNSYIR

SEQ ID NO: 16579 - protein, 254 aa, Bacillus clausii KSM-K16
MITLKSKREIELMHEAGKLLADCHKEIAKRIKPGVTTEEIDHFVESYLKKHGATPEQKGYNGYKYATCASINDEICHGFPRKQPLNEGDIVTIDSVFNLNGALADSAWTYAVGNVSKQASDLMKITHEALYKGIEQAHVGNRLGDIGYAIQSHVEQAGYSVVRDFTGHGIGPTLHEPPQVLHFGAQGKGLRLREGMVITIEPMVNIGKYNSTLDANGWTARTVDGTLSAQYEHTVAITKDGPLLLTDQQEERPF

SEQ ID NO: 16580 - protein, 125 aa, Zea mays
  misc_feature (78)..(78): Xaa can be any naturally occurring amino acid
MAALGSKLAQLQAKACEATRFVTRNGCAYHKTLIEKNKQFVVQPPTVEKCQELSKQLFYTRIASLPVRYEAFWKEADXVKQLWRNRKDLNVEHAGIIALFGLELYGWFCIGEIAGRGFTFTGYSV

SEQ ID NO: 16581 - protein, 502 aa, Glycine max
MHAMEFLTLSVTVAAAAFSILFFFLRHAGAGAGSLPPVPAVPGLPVIGNLLQLKEKKPYKTFTQMAHKHGPIYSIRTGASTLIVLNSPLLAKEAMVTRFSSISTRKLSNALKILTSDKCMVATSDYNEFHKTVKRHILTNFLGANAQKRHHIHREAMMENILSQFSEHVKTFSDLAVNFRKIFVTQLFGLALKQALGSNVETIYVEELGSTLSKEDIYKILVVDIMEGAIEVDWRDFFPYLKWIPNRRLEMKIQNLYVRRKAVMKALMNEQKNRMASGKEVNCYFDYLVSEAKELTEDQISMLIWETIIETSDTTLVTTEWAMYELAKDKTRQDRLYEELQYVCGHENVIEDQLSKLPYLGAVFHETLRKHSPAPIVPLRYAHEDTKLGGYHIPAGSEIAINIYGCNMDNNLWENPNEWMPERFLDEKYDHMDLYKTMAFGAGKRVCAGSLQAMLIACTAIGRLVQQFEWELGQGEEENVDTMGLTTHRLHPLLVKLKPRIK

SEQ ID NO: 16582 - protein, 587 aa, Opitutaceae bacterium TAV2
MASTIKNSLSRLSRWLPGLPDLLYYERAFWKKDLAAGLSVAAVALPVGVAYAQLAGFPPVVGLYSTILPMVVYAFFGTSRQLILGPDAATCAMISATLLPLAAAGSDRYASLAVSLTLLTGVFCMLASRFRLGFLASFLSRPILTGLLNGVAISIMAGQLTKVCGMPDGGRGFIGQVVWFARHAGDINWSTLGVAGVTLGVYVASKVFWKNGPAALVAMVGATGVVAGATAAGFYWVHGVAVIGPVNAGLPRLHWPALPLDALGILVPAAAGLALVSFCSSMLTGRSFAAKNGYDVDANREFLALGVADVASAVSQGFAISGADSRTAVNDAAGGQTRMVSLVGAGVMVLVLLCLTRPLAWLPVSALGMILLCASWGLLDLPSLWRLRGLDRGEFYIGTTTLVGVLVIGVMPGILLAVSLALLRFLSRVARPTDQRLGRIAGRDGFYEIAHHGEARSVPGLLFYRFESPLIFFNADYFRERVMRLVEGEETPVKWVVIDAVSLSEVDLTGAFAIRTLVKELEVRGMVLAIAGRTAQARAWLQRNHVELASNMRLYPTRHMALAAYFLEYPEAKAAMEGTGNGTDVSG

SEQ ID NO: 16583 - protein, 411 aa, Vitis vinifera
MGNKKVVLETRQNRRALSVISENVVRGGVSKRGLLEKQAICEKRIHAPVQRRPVTRRFAAQLASRQHSNIQEPKKPELLSIWTPGQSEDCEIEDMEEHKAAPDHPVPMLVEQTETKIDEMNQVEEVEMEDIDGEPIMDIDGPDARNPLAVAEYVEELYAYYRRMESSSCVSPDYMAQQFDINHKMRAILIDWLIEVHDKFELMEETLFLTVNLVDRFLAQQTVARKKLQLVGLVAMLLACKYEEVSVPVVADLIIISDKAYTRKEFLEMERLMLNTLQFNMSVPTPYVFMKRFLKAAQSDKKMELLSFFLMDVCLVEYEMLKFPPSLLAAASIYTAQCTLYGFKQWDKTCEHYTSYTEDQLLECSRLIVNLHQNAGSGKLTAAQRKYCTSKLGYTSKCEPAHFLLGTQQQQ

SEQ ID NO: 16584 - protein, 466 aa, Propionibacterium acnes KPA171202
MEHYDIVVIGSGSGNTILDEDFADRRAAIIDSGAFGGTCLNVGCIPTKMFVLPADFASSPSEAVRVGVDLQFRGASFASIRDRIFGRIDSISKAGLSYRQGLDNIDVYTGEAAFIDAHTLEVGGRCITADQIVLAAGSRPRVPDVPGLDDPSMAGLIHTSDTIMRLAELPQRLVILGGGLIAAEFAHIFSGLGSQVTVINRSGRMLRHEDREISQRFTEQMGRRVRLRMAEGLVGVDRDPGGHLVVLTVDGDGVDYDYPADVVLNATGRVSNGDRLNLPAAGVDVDDDGFVVVDKHQRTNVEHIWALGDVCSPWELKHVANHEARVVRHNLLHPDDLASSNHCFVPHAVFSNPQVASVGATEQGLLQSDTPYAAYLQEYADVAYGWAMEDEGHCVKLLGDPQTRTLLGAHIIGPQASTLIQTCIQGMSVGQTVDEMARGQYWIHPALSEVVESALLGLGKEMDTTR

SEQ ID NO: 16585 - protein, 358 aa, Pseudomonas fluorescens PfO-1
MRWRYLVLLLIIGVLAFLLLMPTKVKPVAWTPQPAPSLTEGQYADNQRLKGAAQVGPSDIEGPEALLLENDFLITGLHDGRLLRTSLDGQQRKVLADTGGRPLGLARHPNGLLVIADGVKGLLSLDEQGRLVALTTEANGLPFGFTDDVAIDKSGHYAYFSDASSRWGYGHDGEAIIEHGGDGRLLRYDFQTGKTSLLLDKLEFANGVTLGPEDAYVLVNETGAYRISRYWLTGPRAGTHDLFIDNLPGLPDNLAFNGRDRFWVALYTPRNPLLDSTAGHPFVRKMIVRAMTVLPKPVEKRGFVLGLDLEGKVIANLQDASAGNYSPITTAREYGQWLYFGSLKATHMARMPLEAALK

SEQ ID NO: 16586 - protein, 460 aa, Coprinopsis cinerea okayama7#130
MKSHRRGESVDPLTLAMAPPPDETPEQRKERQRREAEAVEVSKRIDAELKAAKAALKKRKEAVQVLVLGQSLSGKSTTIKNFQMAYAQKSWAEERDSWKAVVLLNLVRSVNIILDVLSETIDNAQLLSSEDSSSQQRLTPLTEHHRNAIRRLGVLRQIERDLKAFLGSGASETDENDQRVNEFSVQSNTGWKAVLAKVRNPSGGKELDAQRKGLQVITSCADDIDWLWKDPATQFVLKSREINLEDSPGFFLNDLARILHPDYQPSDSDIVRARLRTTGVQEYHFTLDRGNNHGPTDWIIYDVAGARTSRAAWVPYFKEITALIFLAPLSSFDETLAEDPTINRLEDTFMLWKTICSNKLLARVQIILFMNKVDILRKKLESGILVKNHIPEFRDKTNDFETVSNWFKKLFKRLYFANTTPGREFLAHFTSVVDTEATTQTLAAVQSAILRNDFVNTGLL

SEQ ID NO: 16587 - protein, 605 aa, Oryza sativa Japonica Group
METHIGSVDGAAAAADNGAVGCPASAVGCPMTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 16588 - protein, 673 aa, Arabidopsis thaliana
MLLHCNVSYYTSTFSFISSSLRRQDNADDSQDTVIRRRHNARSISLYIRHNRDLKLNKNPNESQETFVPPPPPPRRDLDGENRSKLLELSLVTRRTPQFPGSIYAQSASDADIASSLPSLRNFLGSDGDDDGESEREMIVKALEIRRKVTKEIIKESLVRKGRFGITYATNVTDRLGDFVDHVMIQAAALKRLPEFSESRFNLRARTVIEDSNFVPLVRWLKHHELSYNRIAKIICMSKGNLDSIRIMIEWLKSIHVKGEFIAVAFLRSGDNILQRNREELNEIVEYLESNGVRRDWMGYVVGRCPELLSFSMEEVKSRVDFFLKMGMNQNDFGTMVYDYPKIIGFFSFQVMEKKVLKALFNTPALRLSFKFIIVLLVLNQINYLKEFGLSTEEVGRLLAYKPHLMGCSIEERWKPLVKYFYYLGIPKEGMKRILVVKPILYCIDLEKTIAPKVVELRYNVRFLQEMGIPNEAIGNMLVKFPSLLTNSLYKKIRPVIFLLTRAGVTQKDIGKVIAMDPALLGCSIGTKLEPNMRYYISLGIRFYQLGEMIADFPMLLRYNVDNLRPKYRYLRRTMIRPLQDLIEFPRFFSYSLERRIIPRHTIMVENRVNFKLRYMLACTDEEFERRVRDKVERRERFEAGLDSEDSQPSDENISDQEIAFSDEAEEEEDLTE

SEQ ID NO: 16589 - protein, 175 aa, Aggregatibacter actinomycetemcomitans
ALRNRANTPVLVDGKDVMPEVNAVLAKMKSFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDNMFGFWDWVGGRYSLW

SEQ ID NO: 16590 - protein, 387 aa, Haloarcula marismortui ATCC 43049
MSMNAVVYKGPKEVAVEEVDEPEIEHPNDVLIDITTSCICGSDLHMYEGRTAAEPGIVFGHENMGIVTEVGEAVSSLEEGDRVVAPFNVACGFCENCEAGYTGFCTNVNPGFAGGAYGYVAMGPYKGGQAEKLRIPYADFNALKLPDGDEHEDAFSLLADIFPTGWHGTELANLEPGDSVAIYGAGPVGLMAAYSAKIKGAAEIYSVDRVPSRLELAEEHCDATPINFEDGNPVEQIKAQHGGGVDKGVDAVGYQAIDPDKEADDAYDPARENPAVVINNLIRTVKPTGELGIPGLYVPEDPGAPDDMAAQGRLGIDFGLLFEKGQALGTGQCNVKSYNRELRDLIVEGRADPSWVVSHRVGLEEAPEMYEAFDNREEGVTKVLLEP

SEQ ID NO: 16591 - protein, 203 aa, Physcomitrella patens subsp. patens
MTAQSAEELATELEQQKLHSDDPIIEDGKDDDDEDEDEDEDDEVADGEDGLTEGGKSKQSRGEKKSRKAMQKLGMKPVTGVTRVTIKKSKNILFVISKPDVFKSPASDTHIIFGEAKIEDLSSQLQSQAAEQFKVPEVANVESKVDPSSVVGAEDDGEVDEAGVEPKDIELVMTQAGVSRAKAVRALKATDGDIVSAIMNLTS

SEQ ID NO: 16592 - protein, 453 aa, Ashbya gossypii ATCC 10895
MAVFTSSTGKLGKGVGEHDEDASKPQDRPPSQANMLTKFFHKVTGQPASYVNKADYIFGKTLGAGAFGVVRQARNSKQNQNVAIKILLKRALKGNELQMLYDELSILQKLDHPNIVKFKDWFESREKFYIVTQLATGGELFDRILKKGKFTETDAVKIVVQMLTAVEYMHSQNVVHRDLKPENVLYLDPSDESQLVISDFGIAKQLSSESQLIHRAAGSMGYVAPEVLTTSGHGKPCDIWSLGVITYTLLCGYSPFIAESTEGFLEEVFSGSDPVTFHSPYWNNISKEAKQFILRALTLTPARRPTAAELLTDRWIVSKQSNTADLLPTIREGFNASKKFRDAMQVVILNNRIKKLKQMYGHDESDTDLEENSASTDRRKVGLEVLQNALRSLSLKGSQESPEQKQLKSQVTQQAFVQLVLAAKENKERIREYQSQQSLDSVAAHQNTTDAPQ

SEQ ID NO: 16593 - protein, 175 aa, Aggregatibacter actinomycetemcomitans
ALRNRANTPVLMDGKDVMPEVNAVLAKMKSFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDNMFGFWDWVGGRYSLW

SEQ ID NO: 16594 - protein, 1629 aa, Anabaena variabilis ATCC 29413
MKILIVEDDELNAYALTAVLTNQNYAVEVGSDGITAWELIQTYDYDLILLDVILPRLDGISLCRQIRSSGRQMPILLLTGCDSSHEKAIGLDAGADDYVVKPFDEEELVARVRALLRRGGTTAQPILEWGNLQLDPSSCEVRYNQNLLSLTPKEYALLELFLRHSRRVFSCSMILEHIWSYEDTPGEEAVRTHIKGLRMKLRNAGAPGDLVETVYGIGYRLKAQEEEQGSKDEVKHSQSTSKGKSQQQTLTAIAGIWQKFYGRVDEQVKVLEQAAMTSDRPEIVTLTQETLNPELRSQAIREAHTLAGSLGTFGLPEGSKLARKIEQLLKSGKKLTPTEIQSLQNWVKLLRQEVAAHEPQAASPETTSAAILQLQPPQAEAKVLAVDDDPQILAILQTLLHPWGLQVITLDDPRQFWETLRDVNPDLLILDVEMPYTNGIELCQVVRNDPQWSELPILFLTVHKDGEIVNQVFSVGADDFVSKPIVGPELVTRIINRLERVKLLHKVSESRGIGEKNSPPSPSFTDWRTIFNAEPECVTIVATDGTLLDINPAGVAAIEADSAGAVIGKRVYSLVVPEYQQVFRQLNESVCQGEQGTLEFEIITCRGNRRWMATHAVPVRNETDGNLVQLSITRDVTQYKQAELEIKRINRTLQTLSDCNQLVIRTQDEGELLQKVCQILVDVGNYRLAWVAFAENDAEKSIHPVAQAGYEQGYLQSLNLTWADTIRGQGPTGTAIRTGKTAIIQNILTDPRFEIWRCQASNRGYASSISLPLMNNGQAFGALNIYAAEANAFDSDEVKLLEELTADVAYGIVALRNRRDRQIAEAALRESQERLALTLEAVNLGIWDWNITTNQIIWSEGHARLFGIESEKFDGTYEAFQACIYPEDRGGLAEVINSARQQKTDYSHEFRIISPDGNIHWIEGTGKLYYNEMGEAVRMLGIVRDITSRKQIEATLQKVNNELELRVAERTAELVNVNRQLQSELDERQRVEEALRISQVRLARILDIADDAIISINGNQQITLFNQGAEKIFGYSAEAIIGQRLDTLIPQRFTQAHRQHVADFGQAPNLARRMGERREIFGRRQDGTEFPAEASISKFQLDKEVFYTVILRDITERKQIERMKDEFVSVVSHELRTPLTSIHGSLGMLASGLLPADSEQGRRLLEIATDSTERLVRLINDILDIERIESGRVKMERESCNLTDLIESAVSIMRPLANKAGVKLSVSHPSIQLWVDPDRIVQTLTNLLSNAIKFSTAEKTVWLVAQQYGDELLVTVKDNGRGIPADKLDSIFERFQQVDSSDSRNHDGTGLGLAICQSIVQQHGGRIWAESVLSEGSNFYFTLPILPISPNSELPDSLTHYPLSPEGDLPSPIPSTHSPLVLVCDDDPLIRTELQSLLEQGGYRVVTVATGKEAIASASTQHPDVIVLDLLMPGMNGWETMAMLKESTETKHIPIVICSVYKPTTNNQPSSDFVDWISKPVQESYLLHSLRQAIAKSSRRVRILIVEDDADLAELFVTLFERHDIETFSAKTGREAIHLSQEVNPDLLILDLILPETDGFAVVDWLQKHQRLCNIPVVVYSAKDLDESERKRLKLGHTEFLTKGRVTTKEFEQRVIELLQRITPTNVRD

SEQ ID NO: 16595 - protein, 449 aa, Streptomyces avermitilis MA-4680
MSQHTFVAGTAPGAVPVVGHAWQMMRRPLHFMSSLSAHGDLVKIRIGPTSAYVPCHPELLRQVLTNDRVFDKGGVFYDRARDIAGNGLVTCPYRDHRRQRRLMQSAFQRTQLERYSTAMRAEIDATAARWHDGTVIDAFPELYGMALRTVARTLYSTPVTEELAQRVEQAFDTVLNGLFRQMFLPHSLRRLPTPANLRYRNNLRFLHDTVQDLITEYRRDDTQRDDLLSALLASRDEDGGRLGDTEIHDQVITVMAAGTETVAGTLTWIFHLLSRHPEIEARLYEEIDTVLDGKPPHWDDLPSLSLTDRIITEALRMYPPAWIFTRLTASDVDLAGVRLPEGTTIVFSPSSVQRHSEAYDDASRFDPDRWLPDRTSAVARQAFTAFGTGARKCIGDLFARTEATLALATMLSQWRVTVEPDADVRPVALATVYHPRRLRLRLTARTPGQ

SEQ ID NO: 16596 - protein, 1010 aa, Ustilago maydis 521
MSVTPPLLRGSSSEDDPTGPTATNRWGTVSGGMLSPPPAPSSGAGVRRNHTIHGARHHGKPRLEKHFEQPEDLAPTPTLADRAASGPSVSQNPSDGDENRSHVIHSSPSFNDDASLDLLASPSTKSDTAGDFVASLTPLQALYSRSSVSRNLSLPSRHSTKVVSNLSSNATQGRTSLFNSLSAITGGSDLDEHDWEKLIHSSNALGDEHQQDPHALNSLSLQHDHPWSSSLFPQGQIGAPTDSSLPTSPISRPDPFLDAHHLDRSNGSVDTFDQSAQTDTQALPGSANLVRRHQSLNHHAGRSAAQRLAARSSDLLRQYNAGDTADPTMSPYSSRTDAAFSPVRHTISLSAASSPVMPSSYSKVPWHQPTQDPIGSPSRFAASFPSQNLEPSHSRVPSTMDGSSSPLTDVTAHLSCLEISGSSALAGDSTQASRALATSTSHSTPPDSSTQSESTIVTRPLEGRKLPQLVTNRDALQRGQRADGASGPFSAAAYVPPIGHAHARNPSNDPAAPLASSLDADSSQQYGPFTAAPAGNWLDKDKIVGRLDAGHASRGAGSDSQAWSHQTQVGPYAAGAMDPSVIALSMALAQEQQRNAILQAQLGARSNAGGLQEPHLFGMQPIDLTGPMQSIGQQLRGGPMPSSPPMGPVGNLASRGQPFAMQQSPPPFRAPMHALAQSPRPSPAGVFASADTEAITPPTPVDPTYLALQKGYNPAPATFNLAPVNARFFVIKSYTEDDVHKSLKYEIWASTDKGNQRLDKAFRESAHNSPIYLFYSVNASGHFCGMAQMLTPLDYATSSNVWAQDGKWKGTFKVRWIYVKDLPNNQLRHIRLTNTPECKPVTQSRDTQELTPEAGREVLRIMAEYSAKTSLLQDFNFYEMQARTGGGQLAQQGSAAVGMGGLPPRNSPKPSGSPALGFGGSSFAASADANFAHRSGVSASPNSGARRAQSSGISQRPHGSSGSGLAPGTPRSAVQPIQDLRSDKANHAAPGTCTDAESAAQVAGLAPSAL

SEQ ID NO: 16597 - protein, 377 aa, Synechococcus sp. CC9311
MPAGSTAPVGETIGLIVETEAEIADVKAKAPSSAPAAPAAAAPPAAPAPPTPVSAPAAVSAPAPVTAPVAASVSNGRLIVSPRARKLASQMGVDLAGLRGTGPNGRIQAEDVEKAAGRPVTPPRVGEGTSAAAVVGDTVSASPSAPSGNSFGAPGDTVAFNTLQAAVNRNMEASLAVPCFRVGYTITTDKLDAFYKQVKLKGVTMTALLAKAVAVTLARHPQVNAATTASGMSYPAEVNVAVAVAMEDGGLITPVLRNADRTDLYELSRQWGDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIDTRPESLAL

SEQ ID NO: 16598 - protein, 324 aa, Mycobacterium avium 104
MHAIEVSETGGPEVLRYVETPTPTAGPGQVLIKAEAIGVNYIDTYFRSGQYPRELPFIIGQELCGTVAAAGDGVDGFKVGDRVVSAAATGGYAEYATAPASLTAHVPDGVAADVAASALLKGLTAHYLLTSVYPVQAGDTVLVHAGAGGVGLILTQWAHLLGARVITTVSTPEKARRSAQAGANEVLSYPDDADEFGNRIRALTDGAGVAAVYDGVGASTFDASLASLAVRGTLALFGAASGPVPPFDPQRLNAAGSVFLTRPSLAHFIRTGQEFSWRAEELFAAIAAGDITVEVGGRYPLADAARAHRDLQGRKTTGSIVLLP

SEQ ID NO: 16599 - protein, 394 aa, Streptomyces avermitilis MA-4680
MGEFLTEAKQSPAEVLERRSPAGPAGRRGPLPAPSTGRQAPAASPPTDPQGPAAQLDGQEAAGILERARASVDPELRRAVDSLPGSMRRIALHHFGWEHADGTPAAGNAGKAIRPALVLAAVRALGGPQSSAVRAAAAVELIHNFTLLHDDVMDRDTTRRHRPTAWTVFGDADAILAGDALQALAHRLLAEDPHPASAAAAARLAACVIELCAGQHADTAMERRGPGEVTLDECLAMAEAKTGALLGCACALGALYAGAEEEDVEALDAFGREAGLAFQLIDDVIGIWGDPSRTGKPAGADLMARKKSLPVVAALAAGTPAAAELAELYAVPHQEGELERTVLAVERAGGRDWAQQQAADRMARAMHELSRAIPDPEAAGGLLALAEFVTRRSN

SEQ ID NO: 16600 - protein, 596 aa, Mycobacterium avium 104
MAFSVQMPALGESVTEGTVTRWLKQEGDTVELDEPLVEVSTDKVDTEIPSPAAGVLTKIIAQEDDTVEVGGELAVIGDAADDAAAGGGAQAPSQPSQPQAPAQPEPQAQAQPEAPAQPQAPAQPAPQESGGGAATPVLMPELGESVTEGTVTRWLKKVGDSVQVDDALVEVSTDKVDTEIPSPVAGVLISITAEEDSTVPVGGELARIGTGAQAPAPAAPQPPPAPKPEPKPEPAPQPQAQPAPQPQPQPQAQPAPEPKAQPAQAQPAQAQPAAGGEGTPYVTPLVRKLAAENNIDLSSITGTGVGGRIRKQDVLAAAEQKQRQQQAAAQPSAAPAPAAAEARKPAAPTPAPALAHLRGTTQKASRIRQITAAKTRESLLATAQLTQTHEVDMTRLVGLRARAKAAFAEREGVNLTFLPFIARAVIDALKIHPNINASYNEETKEITYYDAEHLGFAVDTEQGLLSPVVHNAGDLSLAGLARAIADIAARARSGNLKPDELSGGTFTITNIGSQGALFDTPILVPPQAAMLGTGAIVKRPRVIVDEFGNESIGVRSVCYLPLTYDHRLIDGADAGRFLTTIKHRLEEGAFEADLGL

SEQ ID NO: 16601 - protein, 125 aa, Glycine max
MSEEVKENQSDKLQRTAPRLNERILSSLSRKSVAAHPWHDLEIGPGAPSIFNVVIEISKGSKVKYELDKKTGLIKVDRILYSSVVYPHNYGFIPRTLCEDNDPLDVLVIMQEPVLPGCFLRARAI

SEQ ID NO: 16602 - protein, 486 aa, Pholiota nameko
MSTKLSLKERIKSVSLIFACGTALFSDGYANGVIGNVNTLLTRVYGADKLDQHNYSRTLSSFGFAGTVVGMLVFGYLSDKIGRKFGMMTAAGIVTLFSGLSAASSGAHGSVGGLLSMLSAMRFLLGIGVGAEYPCGSVSASEQSEEPGISKGAQNRWFALATNSMIDFGFVVSSFVPLVLFWIFGNDHLRAVWRLSLGLGVVPAAAVFIWRINMKEPIRYQKDSMKHARIPYMLVLRRYGGRLAAISATWFLYDIIVYPFGIYSSIIVDRITGGKSDLAVVFGWNVIINLFYMPGTLGGAFVVDRLGPKNTMITGLLLQAVIGFIMSGAYVRLTNSIAAFAVVYGIFLSFGELGPGNCLGLLASKSSPTAIRGQFYGTAAAIGKIGAFIGTWIFPPIIDAFGGPKSNKGNTGPFWIGSGLAVLSAIITFMWIKPLTTDGMIEEDRKFREYLEANGYDTSVMGLPETQSEVETESVSVDEKHEKVDV

SEQ ID NO: 16603 - protein, 205 aa, Caulobacter crescentus CB15
MKALPNILTSSRLVMALFMFIALAAAAGAVPYVSEQLTAETQFRLERWAFYAFVVAAVTDFVDGWLARKLDAVSVWGAILDPIGDKILVCGALLGLMALGPNPMVVLPAGLILFREFTVSALREVGAGKGVKLPVTLLAKWKTTLQLVAIGAEMILASWSAFGLPPEPALVGGFTLIAHGLLWLATVVTLVTGAQYWEAARKALV

SEQ ID NO: 16604 - protein, 717 aa, Vitis vinifera
  misc_feature (43)..(44): Xaa can be any naturally occurring amino acid
  misc_feature (87)..(87): Xaa can be any naturally occurring amino acid
  misc_feature (163)..(163): Xaa can be any naturally occurring amino acid
  misc_feature (441)..(441): Xaa can be any naturally occurring amino acid
  misc_feature (475)..(475): Xaa can be any naturally occurring amino acid
  misc_feature (678)..(678): Xaa can be any naturally occurring amino acid
MGSLSEEEDQFFDTREDITSVSDSGSDCQENLDSEWRNTDFVXXSFGCEVWIKNPESIRERRTKFLKWMGLGVDHVVREVPEELVSXELKGEIDRITENSGAVLGMSSSDDGFSSSQSSMCWPSDAQDFLEFERTLGLSPLVQKMMRKEAEKACNPVEAAKRXRRGWWRRLGAVACIANCPIEVGKFKPNGPYPILGTKSQTVKVRPYRRRSKELSALYMGQDFVAHEGSILTMKFSPDGQYLGSAGEDRVVRVWLVTESERSDGFDAPDVDCSYAYFTVNHLSELVPIHADKEKKGKLKTLRKSLDAACVIFPQKVFQILEKPLHEFHGHCGEVLDISWSKNKYLLSSSVDKTVRLWQVGCNQCLKVFSHNNYVTCVQFNPVDDNYFISGSIDGKVRIWEIPGGQVVDWTDITEIVTAVCYRPDGKVGVFLCCLFVEMGXIVGSMTGNCRFYDASDBRLQLHALICLQGKKKSXFKRITGFQFSPSDPSKLMVTSADSQVRILDGVDVICKYRGLRNAGSQISASFTSDGMHIVSASEDSNVYVWNCISQDVPVHSQAKNNWSCERFFSNNASVAIPWCGATCGNSIFSNISGAFPSPKLSVNLPRSDPENKPHQCHLGESSSTILPFSSPDHFSVGHGFFSESLPKGSATWPEEKLLTPSSLVVSSAMCKSQYKFXKTSCQSMFGSPHAWGLVIVTAGWDGRIRSFQNYGLPIRK

SEQ ID NO: 16605 - protein, 234 aa, Vitis vinifera
MSPVPSVTAVQVENVLFPPSVKPPGSTNDLFLGGAGVRGLEIQGKFVKFTAIGVYLESSAVPTLAVKWKGKTVEELADSVDFFRDVVTGPFEKFTKVTTILPLTGRQYSDKVSENCVAFWKSVGIYTDAEAKAIEKFNEVLKDETFPPGNSILFTHSPLGALTMSFSKDGSLPEVGNAVIENKLLTEAVLESIIGKHGVSPEAKKSLAARLSELFCKEAGDEKIEAEKVAPVAC

SEQ ID NO: 16606 - protein, 134 aa, Thermosynechococcus elongatus BP-1
MKRFWAMVCALFLSVSLLLTSCANVPTGLTGNFREDTLALISSLREAIALPENDPNKKAAQAEARKKLNDFFALYRRDDSLRSLSSFMTMQTALNSLAGHYSSYPNRPLPEKLKARLEQEFKQVELALDREAKS

SEQ ID NO: 16607 - protein, 470 aa, Shigella flexneri 2a str. 2457T
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEKGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 16608 - protein, 493 aa, Nostoc sp. PCC 7120
MQLNHNGVHSEGHSFVLPQICPSQSSVESDFPSNRVRSVPGAASSHYLERQQARESNARSYPRRIRIAISEAQGIYLKDADGNVYIDCLAGAGTLALGHNHPVAIEAMRRVLDTGLPLHTLDLTTPVKDQFVEEIFASLPAEFAQNAKIQFCGPSGADAVEAAIKLVKTATGHRSVLSFHGGYHGMTHGALSLTGNLNPKQAVTGLMPDVHFLPYPYHYRCPFGLGGEAGQITSSRYIESILDDPESGIVTPAAMILEVVQGEGGVIPAPDDWLREMRRITRDRHIPLIVDEIQTGLGRTGKLYAFEHSGIVPDVLLLSKAIGGSLPLSVVLYNKALDKWSPGAHAGTFRGNQMAMAAGTATLQYILENSLTEHAAAMGDRLLKHLHQIQGETYCIGEVRGRGLMVGVEIINPQASADRRGKYPVHPQLASCIQAECLRRGLIVELGGRFGSVVRFLPPLIVTPAQIDSISEIFSSAVQAAEKQVLSVLSQVS

SEQ ID NO: 16609 - protein, 323 aa, Coprinopsis cinerea okayama7#130
MSDEDSNSGWQLTESDPGVFTELLKSLGVPLIVDDLYSLDAESLAALKPIHALIFLFKWVPTKDSDGGPAGTYDPDFPGFFAHQVVNNACATLAVVNALGNIPSLPTGPQLAELLSFTTGMDPQTRGLVLTSADWLREAHNALSPPNAISLDGLELPRQAEEAYHFVVYLPYMGAVYELDGLKPHAVRHGAYEESGEGWLKTAREVIEARINTYPMGALEFSLLALHDDPLPTLQSQLQEAQTAGNSAVEADLLARISNENAKRENWAFENSLRRHNHVSLVHGLLLALAKIGKLEPATTKAKETMKEKIKKKKESGEAMDED

SEQ ID NO: 16610 - protein, 97 aa, Glycine max
  misc_feature (72)..(72): Xaa can be any naturally occurring amino acid
  misc_feature (86)..(86): Xaa can be any naturally occurring amino acid
MASSMISSPAVTTVIRAGAGMVARFTGLKSMAGFRSSKTINDITSIATNGGRVHCMQVWSPVGNKLFETLSXLPFLDDVQLAHELXYLLMNGWIPCL

SEQ ID NO: 16611 - protein, 1091 aa, Arabidopsis thaliana
MMMSNLPKDLVEEILSRVPFKYLRAIRSTCKNWYDLSKNRSFANKNIDKAAVSGEKEFLMITQFNVFWVGVNLHRSQNNSFDLSIQLKAKIVSRDKKDDLFQKSQVIHCNGVFLCVREKMLVVLNPYWGQTKRIMPRPPFGCFDRYALGYDKSSGSHKILRLFGVNQNNLNIYDLSSSSWMIPDGTLERDMEYMKQGVSLNGDTYWYAKDKESIDWYLLCFDFTRERFGTPLPLPFSNEGYTLHKGYKSLSALKEEKLAVLLWDTMVIWVTNKIEPDAVSWSIFLKLDMEPSIYCRYGNFFIDEEKKVAVVFEKDSSSWSWMYNPNYNKAYIAGENENSFTLHFTKKRVDKGRASYTSILDSVQSSTCLSRRFLKLDLTYRCDVVSSLKLETTIIMMMMSNLPNDLVEEILSRVTVTFMRTVRSICKKWNALTKDRSFTNKYIRNIAALGEREFLMIKEFSIYLVGVNLHGIQNNNFDLSIELKGKLISMDNTIRRFCISQIFHCNGLFLCVSQKDMDNRLVVWNPYCSKPRWIKPSYNYRTVDRERFGPRLPLPFMNLDDVSLSVVKEEKLAMLLKRWDTCEVEIWVTDKIEPDVSWSKFLKVGIKPRFDFANFVVIDVVKKVALVFDKNKAEKFQYSYNIAYIIGEKASPEELSSHRERKKRVESCLKHEKASPQGFVIGFLPKRPHTSCRDCIQSQPYGQASKAHACGNLRSCQDRLYPTISPSNQRPRTWASFLRHILISNLPDELVEEILCRAPVTSLKAMRSTCKKWYVLTKDQRFAKKRGKEFLMIMNRRVYLIGVNLHNNIDLSIKCRGRLISRDETAQGFYVSQVFHCNGLLLSVSGKTIDDTRLVVCNPYGVKPKWINPKDNYGRLDIFSLGFDKLCGSYKILRIYDFDNKLQIYDLSSNSWMIPRDTLGRDIEYMQNGVSSKENTYWCARDKQSQYCFLFCFDFTRERFGPRLPLPFNGAYVSLSAVKEEQLAVLFQPSDKSEIEIWVTNKIEPEEVSWSVFLKVEMKLRVLSWNFLIDKEKKFAVVFDKDKAKGFKTNYDIAYVIGENGYYRRVDLRESPNKPLCRIVSCYVPSCVQIE

SEQ ID NO: 16612 - protein, 560 aa, Coprinopsis cinerea okayama7#130
MPNSTIIPLRFSPVWLVRDMSVYNSILAALGSSVVYLFYKLYRRVTRISIAHVPGPEPESFWLGNLRELFQSQAGVPDFKYQREFGDVVRVKGALGEDRLFISDPKALQYIIHTSGYAYPKWPERTEISRVLMGRGLLWADGEIHKRQRKVMLPGFGVPESKSYVPIFRRVGAELTAQWSDILASSADQSAVLNVANWLSRTTMDSIGEAAFDYHFGALANQENEFMEAYLGLMSDTLGSPSTSAIFMQTVMPLWYLQLMSRFSRKRNLVHARHTAKLANAVAKELVNSKAEALLQGKGNKDILSLLVKANASENAETRLTEEEIYAQMRTILLAGHETSATTLCWVLLELARHPEVQEKLRKEIRDTERAIRARGGSDFTATDLDNMTYLHAVIKESMRFHPALYQNYRQAARDDVLPLSKPIVGPDGELTNKLPIPKGTKIILSIAAYNRNQEVFGEDAHEYNPERWLSDREKKGPTLGVYGNLLTFAGGIRTCIGWRFALYEVLSLTVEIISNFELAPSPDIQRLRREACLVMLPTLEGEELKGEQLPLKITLAARD

SEQ ID NO: 16613 - protein, 406 aa, Shigella flexneri 2a str. 2457T
MTFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNSIAEYEQNLMHYALSQLESVPDLTLYGQQNRLGVIAFNLGKHHAYDVGSFLDNYGIAVRTGHHCAMPLMAYYNVPAMCRASLAMYNTHEEVERLVTGLQRIHRLLG

SEQ ID NO: 16614 - protein, 898 aa, Oryza sativa Japonica Group
MSIGFLNVDCGLTNRSTYNDTDTTLTYVSDREFVESGKSYDIMAQYMADATNEQEKTLRSFPDGQRNCYTLPTNSSKKYLIRATFTYGNYDGLNSSEKGSLFIFGLHIGVNFWTTVNLTKWDPSSTVWKEVITVAPDKSVSVCLINMGSGTPFISTLDLRPLQDTMYPFVNASTSVSYFSRIRFGSVDEYITRFPTDQYDRFWEGWVFTMHTFPWVNKSSNGKVAELPNIDTFGLPPAILGSASTINGNFSWLNISVSASNSLATDLELLPVFHFVELGNNGSKRIFDIYNVDEPQALFSNFSPPSFLSSMFHNWFLRKGRRAYFQLRKTPDSQLPPLINAYEVYSRVQVENFTTASSDVDSMKTIKEKYMVIKNWNGDPCSPREYIWNGLTCTYPNGGQNPRIVEINLSGSGLQGELEISFMKMSSLKKLDLSHNNLTGTIPDYQVNSLTVIDLSNNQLNGSIPDSILQRYKAGLLELRLEGNPICSKVRASYCGNKKNTRTRILLISVLVPVTSLLVVLFIFWRLCWKGKSRKSEEEDYDMYEEETPLHIDIRRFTYAELKLITNNFQSIIGKGGFGTVYHGILENNDEVAVKVLVETSIAESKDFLPEVQTLSKVHHKNLVALVGYCQNKKCLALVYDFMPRGNLQQLLRGGYDSLNWEERLHIALDAAQGLEYLHESCTPSIVHRDVKTPNILLDKNLVAKISDFGLSRAFNAAHTHISTVAAGTLGYLDPEYHATFQLTVKTDVYSFGIVLLEIVTGQPPVFMDPQTVHLPNWVRQKIANGSVHDVVDKKLLDQYDATHLQTVIDLAMNCLENASIDRPSMTEVVSVLKVCLPISSERQSATSTPRKKNVMDAEIPRQFQLMISGASTTSYEGSSFQSGYTGGVSEISHISGR

SEQ ID NO: 16615 - protein, 532 aa, Oryza sativa Japonica Group
MWRHAARRSSAQIRRSGVMSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGSPSFRCSAYYRWHAPISS

SEQ ID NO: 16616 - protein, 242 aa, Candidatus Kuenenia stuttgartiensis
MVSQSELLTKKSEHIQRMFGSIAGVYDLLNTILSFNFDKSWRKFAVRVSNVTPDAQILDVCTGTGDLAIEYSLKLNDRGKVTGSDFCREMLEIANRKLKKKHVSDKINILCADTLHLPFHDNYFQVSSVAFGIRNVSDLKAGISEMARITAPGGRVVILEFSQPTNTFFREMYYLYFKKILPFIGKIISKSTCNAYAYLPSSVLNFPDRYGLKVQMEACGLVDVKIYARTLGIVTIHVGKKP

SEQ ID NO: 16617 - protein, 579 aa, Haemophilus somnus 129PT
MLKKWFLTKNIFLAVRPFSALQDSFKIGYGKSHLIKDIIAGLTVGVIAIPLSMALAIASGVPPQHGLYTAIVAGIVIALSGGSRFNISGPTAAFVVILYPVTQQFGLSGLLMATLLSGIILILMAFFRLGRLIEYIPLSVTLGFTCGIGIVIATLQIKDFLGLNVATMPVHYLGKLQAIFTALPTINWADAAVGTVTLILLTKWHKFRLPIPGHLPAVIIGTLLSITLIHFGFDVATIGSSFSYSLSDGSTGYGIPNVIPEIILPWNFPNADGEVINWDFNTLQALLPAAFSMAVLGAIESLLCAVILDNMTSTKHHSNNELLAQGLGNIVAPFLGGITATAAIARSAANVKSGAVSPISSVIHALLVLFSLLFFAKALSYLPLASMSALLLVVAWNMANVGQIVQLIRRSGLNEIAVLLTCLTLTVIFDMVIAITVGVLLASLLFIRTIAEMTRSFEIAHPEDLCDTVVFRISGPLFFAAADNLFADLHEKTTHTGKEIKHIVLQCDAVTVLDAGGIHALTRFIQHMLPSQELHMCNMQFQPLRTIVKSKTVKEIHKIHFSTNLDVVYRKIRDLTKTE

SEQ ID NO: 16618 - protein, 570 aa, Physcomitrella patens subsp. patens
LIRRVKLLIPLFEEVRDLKLTISEEDLACFNALEAALNNAKILLLLCNTGSKLYLVLEQQEVAKQFLLLAAAFRQALNKPLSLDISDEVREQVDLVRNQFQRSKSLEDPLDAHLNSELLSVLSETHDCSKDKLKGLADMFKFDTARALMKELQALDGMNEELEQDGPELKKLQIAQRAGVEKASMQPASPDAGIDKGVLNIPDDFKCPISLDLMRDPVIIATGQTFERLCIQKWLDSGKKTCPKTGLSLPHTHLTPNHVLRSVIAEWCTLYGVEMPKKRAKGSQCSPEDKAAIDELVKKLSSPLSEVQRNAAYDLRLRAKKNVDHRSFIAEQGAIPLLVRLLHSPDQKTQEHSVTALLNLSINESNKGRIMTAGAIEPIVEVLKSGCMDARENAAATLFSLSLVDANKVTIGGSGAIPALVALLYDGTSRGKKDAATALFNLSIFQGNKSRAVQAGVVPPLMKLLEEQPVTMLDEALAILAILATHPDGRSVISAVGPTPIWLKIIQSESPRNKENAASILLALCSYDPEYAKQARETNAAELLTALATSREATNRAKRKATALLDLLKK

SEQ ID NO: 16619 - protein, 175 aa, Aggregatibacter actinomycetemcomitans
ALRNRANTPVLVDGKDVMPEVNAVLSKMKSFCERVISGEWKGYTGKAITDVINIGIGGSDLGPYMVTEALRPYKNHLTMHFVSNVDGTHIAETLQKVNPETTLVLVASKTFTTQETMTNANSARDWFLATAKEEKHVAKHFAALSTNAKEVEKFGIDTDNMFGFWDWVGGRYSLW

SEQ ID NO: 16620 - protein, 527 aa, Burkholderia xenovorans LB400
MHDKILILDFGSQVTQLIARRVREANVYSEIHPYDVDASFIRDFAPKGVILSGGPSSVTETDTPRVPQAVFELGVPVLGICYGMQAMAEQLGGKVDIGHLREFGYAEVRARNHTSLLEGISDFTTPEGHGMLKVWMSHGDKVLEMPPGFALMASTESCPIAAMADETRHFYGLQWHPEVTHTVQGRAMLERFVLKICGAQPDWEMGHYIDEAVAKIREQVGQEHVILGLSGGVDSSVAAALLHRAIGDQLTCVFVDHGLLRLNEAEQVMATFADHLGVKVIHVDASEVFLRKLAGVTDPEAKRKIIGAEFVEVFQTEAGKLTDAKWLAQGTIYPDVIESAGKGKKATQTIKSHHNVGGLPETLNLKLLEPLRELFKDEVRELGVKLGLPPAMVYRHPFPGPGLGVRILGEVKRDFADLLRRADAIFIETLRTFIDKETGKSWYDLTSQAFAVFLPVKSVGVMGDGRTYEYVVALRAVQTLDFMTAHWAHLPHELLGHVSNRIINEVRGINRVVYDISGKPPATIEWE

SEQ ID NO: 16621 - protein, 250 aa, Physcomitrella patens subsp. patens
MKVAFGEADEVSSPDALKGALAEFISLFLFVFIGVGSVMSYEKIHVGDLEAGGLLIIAIAHGLAIAILVAATANISGGHVNPAVSLGLALAGKITIIRLVLYWIAQLLGAVAGAWVLKIVTTGEDLARHAIGAGMTTWSATLMEIVLTFTLVFVVFATAVDPKKGTVGVIAPLAIGFTVLAQIFVGAPFSGASMNPGRSFGPAVVAWDFTNHWVYWVGPFIGAALAALIYDGVFMSPAAPEGHQPVPTEF

SEQ ID NO: 16622 - protein, 287 aa, Haloarcula marismortui ATCC 43049
MDYCYTGDTHEKLFAAYRADEEPFPTQTQMEFPRREHRRPEIDILKRLFFPTCWNAAELVRDELAVLDRLDTLGGLFFAGIRPYSGSDPAETVDAVIDQLPAVRTRLKKDVEAAFKGDPAAKTYMEIIRSYPGFMAILVQRVAHTLYEAGASEYARELTEYAKTETGIDIHPGAEIGDHFFIDHGTGVVIGETTTVGEWVRLYQDVTLGALHFEADESDEHRLKKGYKRHPDIGDHVVIGAGTKVLGAISVGDHVSIGANSWVTDDIPDDTKVYVTDHPTQERKRTN

SEQ ID NO: 16623 - protein, 311 aa, Streptomyces avermitilis MA-4680
MSDNGGVTGPDVPEALDLAALRPRLPSPVQAVDDERFARHGVRLLLKRDDLIHPDLIGNKWRKLAPNLRAAAGRPLVTFGGAYSNHLRATAAAGRLLGLATIGVVRGQELADRPLNPSLTRCAADGMRLHFVDRSTYRRKTEPGTLAAILRAVAAEDAYVVPEGGSNSPAVRGCRALGEELRGHADVVALACGTGGTLAGLAAGLGPGQRALGVPVLKGDFLTAEVTALQERAFGGRQGAWSLDDRFHFGGYARTSPGLHAFAADFERRHGLPVERLYVAKMLYGLVALAEEGGFARGTTVAAVITGRPLG

SEQ ID NO: 16624 - protein, 533 aa, Streptomyces avermitilis MA-4680
MDVLPLLLLVAGSAAVAGAARRTPVPAPLLLVAAGLIASYIPGVPEYTLDPEVVLPLVLPPLLYTAASDSSYLDLRAQLRPVALLSIGYVLFATLVVGWAAYLLVPGLPLPAALVLGAVVAPPDAVAATAVARRVGLPSRITTILQGESLVNDATAITAYKVALAAAVGEGATWAHGVGEFLLAAVGGVAVGLLLMVPLHWLRTHLKEALLQNTLSLLIPFVAYGLAEWAHASGVLAVVVVALYLGHRNYEVDFATRLQEEAVWKMVAFVLESAVFALIGLQLQVVLKGLGEYRGVDAAWYAVAVFLVVVLARFVWVYPATFLPRLLSARIREREENPTWKAPFIIGWAGMRGVVSLAIAFSIPLTVHGQGKGPFPGRNLILFLTFTTVIGTLVVQGLTLPPLIRLLRLPGRDAQAETLAEANAQAQASRVAELRLNDLLDDERNALPPPLADRLRDVLERRRNAVWERLGAVNPVTGESVDDTYRRLSREMIAAERSVFVRLRNGRYIDDEMLRTLLRRLDLEEAAAFREAT

SEQ ID NO: 16625 - protein, 322 aa, Ashbya gossypii ATCC 10895
MSGMGESRTELLGWLNDLLRLDYTKVEQCGTGAAYCQIMDSIYGDLPMHRVKFDARAEYESLTNFKILQSCFTKHKIEKTVFVDRLIKCRFQDNLEFLQWMRRFWIQNKDESPYDPESRRKSVRPVSMRAPAQAPPSHAPKRRSLATFAATGTAAAPRPLQKARAAAGGAGGAVATRVPSGGAPARGTATAGAGEQVAALQGELSAAEHKINKLTQEMVQYQDAMSLMERERDFYFGKLRDIEILVQSTQDLFKEGVYNDDPQELNRLLGKVSQILYSTEEGFEVANGADGNEEYDVEAGTRMENCVEGQVLHNLITDDETF

SEQ ID NO: 16626 - protein, 341 aa, Ralstonia metallidurans CH34
MVCNSIIESIGNTPLVQLRRLFGRADAEVFAKLELLNPAGSVKDRPARYIVEKGLTEGAIGPHSHVIESSSGNLAIALAMICGLKGLRFTAVVDPKISPTNLKILRCYGAGIEQVTAKDSQGGYLETRIERVRQMLREQRDAIWINQYANPLNWESHYYGEAAEILAQLAQPADVLVLGVSTSGTVHGIARRLRKAWPSMRVVGVDAVGSVLFGQPSQARELPGIGASRVPELLCRDEIDEVIHIDDYTAATACRRLLAREGIFAGGSSGAVVAAIEQVLHATPVSHRPLRILTLFPDRGERYLDTVYDDAWLARIAARRAVPNLAALPTVASLIPAGVSA

SEQ ID NO: 16627 - protein, 359 aa, Dehalococcoides sp. VS
MSHNVTLIPGDGIGPEISEATRRVLEATGVKFNWEIVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSSEALKLIEFIKDNKKVEIRADSGISIKPISVFGTERIFRWAFKYAKENNRKMVTAVHKANIMKYSDGLFLAIGRKVAEEYPEIEFEDRIVDNMTMQLVKNPSQFDILVCPNLYGDILSDLCAGLVGGLGVAPGANIGDEYALFEPTHGSAPKYKGMNKVNPMAMMLSGVLMLRYLKEEKAADKLENAIAAVIAEGKSVTYDMLSPDKQAAAVGTSQVADAIIAKMK

SEQ ID NO: 16628 - protein, 470 aa, Oryza sativa Japonica Group
MVVTYWQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKALSLSRDLPIPGRELAGIHFAMEFLHANTKSLLDSNLEDGNYISAQGRKVVVIGGGDTGTDCIGTSIRHGCTNLVNLELLPEPPRKRAPDNPWPQNWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 16629 - protein, 307 aa, Anabaena variabilis ATCC 29413
MSIIVFGSINIDLVATAPKLPIAGETLLGEDFFKVPGGKGANQAVAVAKLGVPTQMVGRVGAHGFGAELMENLQDAGVQTDNIFVDETASSGVAMITVAHDGENQIVVIPGANGRVNQADVERLSYILPTATALLLQLEIPITAVIAAAQAARSNNITVILDPAPAPSDLPAELYPLIDIITPNEVEAGQIVGFPVDGEEAARKAAGVLLQRGVKSAIVKLGAKGVVCATDKETFFVPAFFVDTVDTVAAGDAFNGGLATALYSGLSLHQAVIWGAAAGALAATKLGAQTSLPDKLTFEAFLKERGL

SEQ ID NO: 16630 - protein, 202 aa, Triticum aestivum
ATLLFVYVTILTVMGYSGATSKCATVGIQGIAWSFGGMIFALVYCTAGISGGHINPAVTFGLFLARKLSLTRAVFYIVMQCLGAICGAGVVKGFQQGLYMGNGGGANVVAPGYTKGSGLGAEIIGTFVLVYTVFSATDAKRNARDSHVPILAPLPIRFAVFLVHLATIPITGTGINPARSLGAAIIYNREHAWSDHWIFWVG

SEQ ID NO: 16631 - protein, 463 aa, Bacillus clausii KSM-K16
MFSKPYNEVYIFLGVVPLEKEQQLKRTLTLVPLLVIGLAYMDPLVVFDTYGVVAQLTQGHVATSYLFTIAALLLTAYSYGRMVQAFPKAGSAYTYAQQSIHPNVGFAAGWSLLLDYLFLPMVNFAIGMAYLNAAFPEVPAFIWVVILAAAITTVNILGIQLTANITGLFVAFQVLVAAVFVVFMIRGLMNGLGTGELLSPVPFFSDTFAFQTAFTGASILCFSFLGFDAISTLSEETKNPKKTVPLAIVLVVLIGGALFVAVSYLLQLVYPNYDAFISAEAASLEIAQYVGGAFMHAFFLAGTMVAVVSSSMSSHASASRLLFAMGRDNTLPKRFFGYVHPRFKTPTFNIVLIGLLSLTAIFGELEIIYSFISFGALIGFISVNASVVFHYYIREKRRSLKGTVANLLLPALGAAFCIWLLYSIDRHALTIGVIWTILGLIYFLVRRKNSPHFTADAANRHKE

SEQ ID NO: 16632 - protein, 516 aa, Dehalococcoides sp. VS
MAVQDQLDNLNRLKKQAEMGGGEAKIDAQHKRGKLTARERIELLFDKGTFNELGAFAAHRCRDFGLEKQRNAGDAVVTGSGLVNGRLVFTYSQDFTVLGGSISEVVGQKVAQVIDMAIRAGAPLIAINDSGGARIQEGVASLSGVGDILLRNTIASGVIPQISVVVGPSAGGAVYAPALTDFIFAVKGISQMYITGPDVIKAVTGEDISHEALGGAEIHAKKSGVAHFLCENEKECFEQIRELMGFLPQSNRNKPPRGKNKDNEERKTRDLRDIIPDNPKRAYDMKKVITEVADEKEFFEVHKHFAQNIIVGFVRMGGQPAGIVAQQPSHMAGVIDINASLKAARFIRFCDAFEIPLVSFVDVPGFMPGTDQEHSGIIKHGAKLIYAYAEATVPKITVITRKAYGGAYIVMSSKHLRGDINYAWPASEVAVMGAEGAVNIISRKAIAEAANPEETRQKLLDEYREHFANPYQAAQLGYIDDVIDPADTRSKIIKALRSLENKVLANPPKKHGNIPL

SEQ ID NO: 16633 - protein, 202 aa, Triticum aestivum
  misc_feature (40)..(40): Xaa can be any naturally occurring amino acid
ATLLFLYVTILTVMGYSGAASKCATVGIQGIAWSFGGMIXALVYCTAGISGGHINPAVTFGLFLARKLSLTRAVFYIIMQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSDHWIFWVG

SEQ ID NO: 16634 - protein, 202 aa, Triticum aestivum
ATLLFVYVTILTVMGYSGATSKCASVGIQGIAWSFGGMIFALVYCTAGISGGHINPAVTFGLFLARKLSLTRAVFYIIMQCLGAICGAGVVKGFQQGLYMGNGGGANVVAPGYTKGSGLGAEIIGTFVLVYTVFSATDAKRNARDSHVPILAPLPIGFAVFLVHLATIPIAGTGINPARSLGAAIIYNREHAWSDHWILWVG

SEQ ID NO: 16635 - protein, 187 aa, Caulobacter crescentus CB15
MSLINTEIKPFTAQAYKDGKFVTVSEADVKGKWSVFFFYPADFTFVCPTELEDLADNYDVFTRLGVEIYAVSTDTHFSHKAWHDSSPAIGKIKYTMVGDPSGQVTNNFEIMRPGVGLADRGTFLVDPQGVIQFMEVTAEGIGRNAIELLRKIKAAQYVAAHPGEVCPAKWEEGEKTLAPSLDLVGKI

SEQ ID NO: 16636 - protein, 284 aa, Oryza sativa
MLTLHGTALFIRPSAYQEVKSSPKHAIVPHNNLLGCSAFYNPVEGHHVQKPHIVPSCKVNFTRASHYLYRSLSERTTRHWLHRFHVNASSDEDFRSSRNIAISLFKRYKNVIDRGGGDNLKEFVSAGVNAYALGCTEEGLRKELMDIEDSGLEIEALRSNGGGTSLTFKVHSFEMKYEALCKVRGCILWLSIVFMTILCTPQPTIIRWSTTPPVSADVLHQWKGFCALIANAYYTKGMAWLPVKTLQLEQMAVTGSSEEPSVVASRMQLVFSTLEVVSPQWPRV

SEQ ID NO: 16637 - protein, 1619 aa, Magnaporthe grisea
MSQPVEDPSHDQARNDNAQTTTDTGNASMPKTNGHDQESSATGISSSPADTLMDKEKQAAPTPEPSTEKAAVPDPAASVASDTAEDEFFDDNDSEQRRRNEMVQQLARTYTSRSNASAAADEYGNANPFLIASEDPDSPLNPSGNNFKAYAWAKAIAGMVAAEGGSFRTIGICFQNMNVFGFGAATDFQKTVSNVWLEAANMLRTAVGMGKTTRIDILRGFNGVVRNGEMLVVLGPPGSGCSTFLKTIAGETNGLNVDQSAYFNYQGLSAEEMHKRHRGEAIYTAEVDVHFPQLSVGDTLTFAANARAPRRAPPGVSKTLFANHIRDVVMAIFGISHTINTRVGNEYIRGVSGGERKRVTIAEAALSGAPLQCWDNSTRGLDSANAIEFCKTLRVCTRLFQTTACVSIYQAPQSAYDMFDKAVVLYEGYQIYFGPADEAKQYFVNLGFECPARTTPDFLTSMTAPHERIVRPGFEGKAPRTPEEFAIAWENSAEYTALQADIEEYKSSHPINGPDAEAFRKSRAAQQGRGQRPNSPYTLSFYQQTKLCLWRGWKRLLGDPTLTVGALFANTLMALVISSIFFNLQMTTSSFFQRGALLFFACLLNGFAAALEILILFAQRPIVEKHDRYALYHPSAEAVASMLCDMPYKVFNAIVFNLVLYFMANLRREPGAFFFYLLISFATVLAMSMMFRTIASMSRSLSQAMVPAAAIILILIIFTGFVIPLDYMLPWCRWLNYIDILAYSFESLLINEFAGQRYTCTEFVPRAEFPGYGDLSGTNRVCQAVGSVAGQPFVKGEDYLYSSFRYESANKWRNFGILIAFMIFFCSRTWLRPRMCERKKSKGEVLVFRRGQRPAAIKDAKTDPEAGPPKVGGAVVAANMTGENAGFIQRQTSTFGWRDVCYEVQIKKETRRILDHVDGWVKPGTLTALMGVSGAGKTTLLDCLADRTSMGVITGEMLVDGHQRDASFQRKTGYVQQQDLHLQTTTVREALNFSALLRQPAHVPRAEKLAYVDEVIRLLDMQEYADAVVGVPGEGLNVEQRKRLTIGVELAAKPPLLLFVDEPTSGLDSQTSWAILDLLEKLTKSGQAILCTIHQPSAMLFQRFDRLLFLAKGGKTVYFGDIGENSKIMTDYFERNGGFPCPHDANPAEWMLEVIGASPGTTSDIDWHQAWRESPECADVHAELDRLKEQVPNTPPPTEDKASYREFAAPFHQQIYAVTHRVFQQYWRTPSYIYAKAALCAVTALFIGFVFYDAPNTQQGLQNQMFAIFNILTVFGQLVQQTMPHFVIQRDLYEVRERPSKVYSWKVFMLSQIIVEIPWNSLMAVIMFFCWYYPVGLERNAILADQVTERGALAFLYLWGFLIFTSTFTDLMIAGFETAEAGGNIANLFFSLCLIFCGVLANPDTMPRFWIFMYRVSPFTYIVSGLLSVAVANSEVRCASNEFLHFDPLNGTCAEFMRNYINGTTIPGLGRIPGAGGYLRPDTESSRSNCAFCPIKDTNIFLQGAHANYNDRWRNFGLIFVYIIFNIIAALFVYWAVRVPKKKLGGKDAAAGVGAGAGAARASASNEKGKMQREKGEVEGLTTAVLGTSVAGSDAPMTTTTEGEGERAKRRTSGDEVVR

SEQ ID NO: 16638 - protein, 204 aa, Triticum aestivum
ATLLFVYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVG

SEQ ID NO: 16639 - protein, 385 aa, Photorhabdus luminescens subsp. laumondii TTO1
MDQNNLLKIREKVSELDLKLLILLAERRQLAFDIAQTKLQDNRPIRDKDRERELLDVLIKKGKSYGLDGFYISRLFQMIIEDSVLTQQALLQQHLNQTPQDSARIAFLGPRGSYSHIAARQYAARHFNQLIECSCHKFQDIFSLVETGQADYGMLPIENTSSGSINDVYDLLQHTNLSIVGEITIPINHCLLVATDTTLSEIKTVYSHPQPFQQCSQYINQFPHWKIKYCESTAAAMQKVAEQNSPEIAALGSEAGGALYQLQVLEQNLANQSHNITRFIIVARQPIEVAEQVPAKTTFIMATGQQAGALVDALMVLKKHNIIMSKLESRPINGNPWEEMFYIDVQANIRSINMQHVLKALAKITHSLKVLGCYPTESVVPVNPS

SEQ ID NO: 16640 - protein, 650 aa, Oryza sativa
  misc_feature (251)..(251): Xaa can be any naturally occurring amino acid
MDFTNLLITVLLLLAPLKYKSDVATASDDEDFFKTCSSHRCSKHGPEIRYPFRLSTQPPSCGAPGMQLSCSGQDTILDHPVLGSCKVTMIYYRHVIMNAIPLVDSSPHCLLHKFISVNQSTAVYRPHTLKAASLVGCSRDSIDTNQYNSIVGPTSCLSLANNASQFWYLAYPYEYMSILPLGCTIVSKDIPMPYSYDKNGPNFDISIFTETAKRVISTGETVFTWYSSNVTSICQQCEHEGRRCGFSSQRXSSILPASYINKVETRTYPSYTTLIRKLCTCIFPAMLCKIIELVTSSVGTFIVLSLIVATALYISLKSRYNEEIHLKVEMFLKTYGTSKPTRYTFSEVKKIARRFKDKLGHGAFGTVYKGELLNGVPVAVKMLENSVGEGQEFINEVATIGRIHHANIVRLLGFCSEGTRQALIYEFMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTEPTVENQNEFYFPEWIYERVMNGQDLVLTMETTQGEKEMVRQLAIVALWCIQWNPKNRPSMTKVVNMLTGRLQNLQVPPKPFTSSQNQLVI

SEQ ID NO: 16641 - protein, 572 aa, Propionibacterium acnes KPA171202
MPSLRTCKPTRRPDPMRTLSGLGVSAGVGQAHALVVSPAPGLPASDPSRGAEADLAKVEAALGKVADRLDERSLHADPSALAVLQATAMMARDPGLLTSIKSHLSDGHGPAHALWAAFEDFCAQLSAAGGYLAERVTDLRNVRDRAVAVMQGLPEPGVPSFDSPVILVAEDLAPADTATLNPELVRGLITAAGGPTSHTAILASQIGIPAVVRCSEARDIEDGTPLALDGVTGTVLVEPDEASVSELTERANRRAEVLASAPDGDATLSDGERILVLANIGNPSDAPTAKKKGAEGVGLFRTEFLFLDRQDAPTIDEQTEAYATVLKTFDEGAKVVFRTLDVGADKPLAFADLGAEENPALGRRGLRLSQVRTDLIDAQLEALAKAAEQTGRDPYVMAPMVATKAEAEWFSSRARAAGIKTVGIMVEVPSTALRSSQVLESVDFASIGTNDLTQYAMAADRLQGELAELLTPWQPAVIQLVKATCDGAGERLIGVCGEAAGDPLLALVLVGVGVRSLSMAAGKITAVKAALSRHNLEQCRRIADAALAACSPEEARTAALKLADPSVEVLVS

SEQ ID NO: 16642 - protein, 684 aa, Thermosynechococcus elongatus BP-1
MNIHSPVFIFMVLLAVILVIPPLFERLQLPGLVGLLLAGVLLGPNGLQFLEHDSDTIKLLSGIGKVYLMFVAGLEIDLSHFHRTRDRSLLFGTLTFMIPLATGFTIGRWFGFDWNGSLLIGSLLASHTLLAYPIVRQLGVVHNEAVIITVGATIFTDTAALMVLAICVSINRGEFTVLSLFSQFIALGLYCFLLLWGFDRIGKELFRRSGDAQGNQFLFILLTLLIASISAQIIGIEQIVGAFLAGLAVNDVLEDSPVKEKVEFIGGVLFIPCFFVDMGLLIDIPAFVKTLASIGITVAIVMGLIGSKFIAAWLAARWYRYTSMEMLTMWSLSLPQVAATLAATLVGFQEGILTHDILNSVLVLMVVTSILGPMITARTASRLPIPQPEQEEIEELATWWNGHEDPQPHTFTVVVPIHNPQTQRPLLELAALLAHHEAGRVVAVAVIPCQVHMNDPHLDTKLRRSGKLLRRAAELAAPYNVETTTAIRIDEDIALGISRFSREQEASLIVLGWSESSSWRTQLFGSIIDRVLWSSPCPVAITRLLDDPENIRSILVPTRDLSPRTLRIISFAQALGSASEAKVMLLHVALPNTPYEQMAQFEENLRQILQETKGASPLNLHIKTVASSDIPTAILEEAALYDLVLMRSIRRGTAGGLAVSDITTQVIQRLQTSIILFGEPPRLS

SEQ ID NO: 16643 - protein, 258 aa, Thermosynechococcus elongatus BP-1
MEWQEVRGNWLCIPQRPLGWIHFLGGAFVAAAPQLTYRRLLEHLAEANYGIIATPFVNSFDHGAIALDALNKLDYALDWLVHRQGYPPALPIYGLGHSMGCKLHLLINSLYDGDRAGNMFMAFNNYPASQSIPWMDNLGPASVEFTPSPTETEHFIQKRYPVRRNLLIRFQDDDIDQTARLRSLLRAKFGDMVTALKLPGNHLTPLSQDLKWQVGAEFSPLDALGQWIKQSLFPEMPVLEACLLEWLNPLGAARRCRP

SEQ ID NO: 16644 - protein, 153 aa, Glycine max
MLATLVLICCLFTAFLFLSLPVMSQEVEDESEFSYDEKSENGPSNWGDIHPEWSLCNNGSMQSPIDLLNERVQIVSHLGRLQMNYQPSNATIKNRGHDIKLEWVAGAGYLQINETEYVLKQCHWHSPSEHTIDGKRLDLEVHMVHDTSSGQSA

SEQ ID NO: 16645 - protein, 382 aa, Ruegeria sp. PR1b
MPQWIMICFMKGRFRVVMPLGHRLLALLLHQCLRHASGRPVSPGPGQDGLLRMRQIEAGLEHEEGSQDVRALVIGGCGFIGSHVVDVLHQAGMGLRVLDRRPEAFRAPVPGVEYVYCDMQDRAQLFEAVSGVDAVVHLASTTVPATSNLDPVADVSGNLVTTLSLLEVMRAAGVRRMVYLSSGGTVYGVPQQDLVSEDHPLNPISSYGIVKVAVEKYLFMEHQLHGLEYVVLRASNPYGPRQGHRGIQGLIGTHLWRLSRQEEIEVWGDGSIVRDFLHVRDLAQLCLLAMTSGKSGIFNAGRGQGASVAEVVEQICATVAASGGRSVAPIYKPGRNFDVPRVVLDTTRARAELGWQAEITLQDGIAETWDWVQAQARQQGQG

SEQ ID NO: 16646 - protein, 280 aa, Haloarcula marismortui ATCC 43049
MVELSLADRPAIVTGASRGIGREIAARFAEAGGDVVVCSRTYEDVEAVATELTQTHDGRVVPVECDVTDREAVRDLVDTTIQEFGDIRVLVNNAGGADESANLLHRCDEETFESMVDLNLKSQFLLSKEVLPAMVAAGGGSIIHMGSVNGLFGIGLSGYSEAKSGLLALSRNIAAHYGQHGVRSNVISAATIETANRRAEMENTEERTGETSARERWLDQYPLGRFGTPREVADTTLFLASEMSSFLTGENLVLDGGLTTSLPTSFINEVYDADEKPTPN

SEQ ID NO: 16647 - protein, 385 aa, Sinorhizobium meliloti 1021
MAQMSKRSAVEPFHAMDVLAEATRRRDSGHPVISMAVGQPAHPAPKAALDAARRALDHGRLGYTDALGTHSLKRAIAAHYHSRHGITLDPQRIAVTTGSSAGFNLAFLALFDPGDRVAIARPGYPAYRNIMAALGLEVVEIEANAEAGFTLTPDSLEGAAARAGKPLKGVLLASPANPTGTVTGKAQLKALADYCRDHSIAFISDEIYHGLTFAGEETTALEVADDAVVINSFSKYYCMTGWRIGWMVLPEARVRAFERIAQSLYISPPELSQIAAEAALGAHEELDGYKRAYAANRALLLERLPQIGFSIASPMDGAFYAYADVSRFTNDSMAFARRMLAEIDVAATPGFDFDPLEGHRTMRFSYAGAATEMEEAMNRIARWLA

SEQ ID NO: 16648 - protein, 82 aa, Physcomitrella patens subsp. patens
RYKGVRKRQWGKWVSEIREPRKRSRIWLGSFPTAEMAARAYDAAVVCLRGPSAALNFPDSPPLSLPECHTPREIQVVAAAAA

SEQ ID NO: 16649 - protein, 286 aa, Listeria monocytogenes str. 1/2a F6854
MEKIGFVGIGVMGSSMAGHLLEAGYEVLVYTRTKTKAEDLLDKGALWVETPGELANKVDILISMVGYPKDVEELYLGENSFLENLAVGTVAIDMTTSSPALAKKMAEFGHEKGIGVLDAPVSGGDIGAKNGTLSIMVGGSEDVFLKVKPIFDILGSSVILQGDAGAGQHTKMVNQIAIASNMIGVTEAIIYAEAAGLNPSRVLDSISGGAAGSWSLANLIPRVLKDDFSPGFFIKHFIKDMGIAISEAKQMGLELPGLTLAEKMYQTLAEQGLSEEGTQALIKYYR

SEQ ID NO: 16650 - protein, 410 aa, Candida glabrata CBS 138
MSAPIKTKPKSSMKIDNAPTPHNTPASVLNNSYLKNGNPVGKSKPPPTISEEDIQTALSSQQPLLLGAIQEKLGSLVGQDSGYVDSLPQVVRNRIFALKKLQSDLFGIEKDFQVELFELEHKYLQKYAPLHARRSEIISGKQEPTSEEVAAGKEIQEKEEGEEEEGEKPTDIQLTEEDIKGIPSFWLTALENLPIVSDTITDRDAEVLEYLQDVSIEYLTEGKPGFLLKFKFSEENPYFKTPELTKTYYYQSELGYSGDFIYDHADGCSIDWVDNDSNVTIAVEMRKQRNKTTKQVRTIEKITPIESFFNFFDPPKMAGDEEDEEDLEDLEERLALDYSIGEQIKDKLIPRAVDWFTGAALEFEFNDAPEDEFDEFEDEDEDEDEDEEEDEDERDDFANKKEEPPECKQS

SEQ ID NO: 16651 - protein, 204 aa, Triticum aestivum
ATLLFVYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVG

SEQ ID NO: 16652 - protein, 175 aa, Microcystis aeruginosa PCC 7806
MIKEAPKIAKEVGEKIEEYQRHREREKQHKISEIRRKIEEECREREDYLRIFDAFKEERNKKNEENVSNSRASTNNSRPGYYNVTLITPDGKETIEVPADEYILDVAEEYGLDITSDCRAGACSSCAGKIVSGSVDQSDQSFLDDDQIDDGYVLLCVAYPTSNCVIETDKEEYLY

SEQ ID NO: 16653 - protein, 477 aa, Arabidopsis thaliana
MDKSSLVSDFLSFLNASPTAFHAVDESKRRLLKAGYEQISERDDWKLEAGKKYFFTRNYSTIVAFAIGHKYVAGNGFHIIGAHTDSPCLKLKPVSKITKGGCLEVGVQTYGGGLWYTWFDRDLTVAGRVILKEEKAGSVSYSHRLVRIEDPIMRIPTLAIHLDRNVNTEGFKPNTQTHLVPVLATAIKAELNKTPAESGEHDEGKKCAETSSKSKHHPLLMEIIANALGCKPEEICDFELQACDTQPSILAGAAKEFIFSGRLDNLCMSFCSLKALIDATSSGSDLEDESGIRMVALFDHEEVGSNSAQGAGSPVMIDAMSHITSCFSSDTKVLKKAIQKSLLVSADMAHALHPNFMDKHEENHQPKMHGGLVIKHNANQRYATNAVTSFVFREIAEKHNLPVQDFVVRNDMGCGSTIGPILASSVGIRTVDVGAPQLSMHSIREMCAADDVKHSYEHFKAFFQEFTHLDAKLTIDV

SEQ ID NO: 16654 - protein, 168 aa, Propionibacterium acnes KPA171202
MIEIRTGIGTDVHQLSAGVPMHVAGLSFPDETVGLVGHSDGDVACHAICDALLSATGLGDIGSIFGTADPQWAGAAGVALLGHVVALVTGEGWTIQNVAVQVVGQRPRMAARRAEAEAALAQTVGAPVSVSATTTDHLGFTGRGEGVAAIASALVTRGLKGEDSSLIR

SEQ ID NO: 16655 - protein, 324 aa, Dehalococcoides sp. VS
MLVNGNLTEELKIFTGNANPDLAKAVADYLKVQMGKCEVFQFSNENIFVRIQESVRQKDVYVIQPTCSPVNQSIMELLIMMDALKRASSERITAVLPYYGYGRTDKKDQPRVPITARLIADLLTTAGASRILTVDLHAPQIQGFFDMPVDELTAENLLANYFKKKKIEDLVVVATDVGISKKARDFAAKLDAPLAIIEKRRMGNNDITRTINIIGDVEGKNALTFDDEIDTAGSLVGNVNILISKGVKEVYSCATHPVLSGPAIQRIAASPIKELVVTDSIPLTPPKKIDKITILSIAPLIGEAIYRIHTGNSIGEMYDQMQME

SEQ ID NO: 16656 - protein, 416 aa, Escherichia coli O157:H7 EDL933
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIKNM

SEQ ID NO: 16657 - protein, 204 aa, Triticum aestivum
ATLLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVG

SEQ ID NO: 16658 - protein, 150 aa, Opitutaceae bacterium TAV2
MPNTPGAIGAGITGWCSLHPLADADRTLVTNILNSLGKHVELAETQLDAVTGLSGSGPAYVFEFAAALREAGIAAGLPRDTAQLLAIETLLGSARLMSQTGTEPETLRNQVTSPNGTTYAGLQRMAARDFRGLIQETVLAAKTRSEELSR

SEQ ID NO: 16659 - protein, 173 aa, Ureaplasma parvum serovar 3 str. ATCC 700970
MINIDYIKSKIRDVPDFPKKGIVFKDITPLFLEPKIIEKIVDDFADFAKSLNIDAIIGAESRGFLFAAPLSIKLNKPFILVRKPNKLPNDVYSAEYTLEYGSSRVEMHKDALKPNQRVLIVDDLLATGGTVAAIENLVRQAKGIVAGSVYLIRLGFLKGEEKLSGKVHALINY

SEQ ID NO: 16660 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVANFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 16661 - protein, 375 aa, Staphylococcus epidermidis RP62A
MKTRAAVLYEMGAKKPYKESKPLKIEYLELDNPSEHEVLIKIHAAGLCHSDLSVINGNRPRPLPMALGHEASGEVIKVGKAVTRVSEGDHVVCTFIPSCGKCIPCKEGRPALCENGAISNEKGEMLEGGMRLSNDEGKVYHHLGISGFAEYSVVSENSIVKIDKKIPFERAAAFGCAIITGIGAVVNTAQIRSGSNVAVVGLGGIGLNAIIGAKLAGANEIIALDINEDKFELAKQFGATATFNSSDKDIDEQIKEYIPGGVEYAFETAGVVPAMKVAYQITKRGGTTVTTGLPNPKDNFSFPQVTLAAEERTIKGSYVGSCVPDRDIPRFVNLYNQGRLNIDSLISEVITLDEINEGFDRLSNGEVGRIIMKMH

SEQ ID NO: 16662 - protein, 483 aa, Rickettsia felis
MAEFTPITIAYGDGIGPEIMEAVLYILRKAEARIRLETIEVGEKLYKKHYTSGISEESWESIQRTGIILKAPITTPQGGGYKSLNVTIRKTLQLFANIRPSVSFHPFTMTLHPHLNLTIIRENEEDLYAGIEYRQTHNMYESIKLISHTGCEKIIRYAFEYAVKNNRKKVTCLSKDNIMKFSDGVFHKIFNEIAKEYPQINNEHYIIDIGTARLATKPEIFDVIVTSNLYGDIISDVAAEISGSVGLAGSANIGQHYAMFEAVHGSAPDIAGKDIANPSGLLNAAIMMLVHIGQGDIASLIENAWKKTIEDGVHTADIYNEQNSSKKVGTKEFAEEVTKRLGQIPTKLPKADYPLIAEKQESNIDYKIDTNEVKKLVGTDIFVNMNISSAHDIADKINKLDLGNIELKTISSKGLKLWPRDTRFETISDHWCCRFMNKDGTEIKHLDITRLLEALSKANIDFIKVENLFEFDGVAGYSLAQGE

SEQ ID NO: 16663 - protein, 338 aa, Streptomyces hygroscopicus subsp. yingchengensis
MVEVVLPGKVEPEGLQVRQGPVPAAGPGQVVVRMEATGVSFAEQQMRRGRYYDQPPFPFVPGYDLVGTVIETGDGVAPGLAGTRVAALLKVGGWATHVVVDAADVVPVPDGISAAQAETVVINGITAWQMLHRKARVRAGQTVLVHGANGGVGSVLVQLAHAAGVQVIGTASARHHAALREAGVMPIDYRTENIPARVREHAPGGVDAVFDHVGGRSVVDSWQLLAPGGTLVSYGSASTRDDEGSKQWPVLKLLARVWLWNALPNRRRAYFFNVWAGRALTPSRFRARLRNDLTEVFTALHRGDITPAIAAQLRLDRVAEALRLAESGTVSGKVVLVP

SEQ ID NO: 16664 - protein, 358 aa, Dehalococcoides sp. CBDB1
MNLSDLRKQIDNLDTELVKLMAKRLEVSDQIGKIKEETNSPVQDLSRESEVLNRVQSLAQSLGLDPQDIESLYQEILFISKKQQRFTVSFQGAAGAYSEETALKIFGPNTLTLPCEQLDATFEAVEKGMARFAVVPVENSLEGSISRTYDLLLDSNLMVAAEHELRVSHCLIANPETNLEAVKTIYSHPQALGQCQSFLKHLRAELIPTYDTAGSVKMIKEKGLLNGAAIASERAAVIYNMKVLEREIEDNINNYTRFFVLAKQDSAPTGSDKTSVVFAVKHQAGALYDFIKELASRGINMTKLESRPTRLKPWEYNFYLDIEGHRQDENVKQALAKADDHVIFMKVLGSYPKMKKRI

SEQ ID NO: 16665 - protein, 249 aa, Propionibacterium acnes KPA171202
MTAKLILLRHGESEWNSKNLFTGWVDVDLNEKGEGEARHAADLLKQENLLPDIVHTSLLRRAIHTAYLALDGCDRHWIPVHRSWRLNERHYGALQGLNKAETKEKYGNDQFMAWRRSYDVRPPDLDRDSEFSQFHDPRYADIPASERPVAECLKDVVARMVPYFTSDIAADLKDGKTVLVAAHGNSLRALVKHLDEISDEDIAGLNIPTGIPLFYELDDNLKPVTRGGRYLDPEAAAAGAKAVANQGNK

SEQ ID NO: 16666 - protein, 287 aa, Vitis vinifera
MEGKEEDVKLGANKFTERQPLGTAAQTDKDYKDLPPAPLFEPGELKSWSFYRAGIAEFMATFLFLYITILTVMGVKKSPTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNVRDSHVPILAPLPIGFAVFLVHLATIPITGTGINPARSLGAAIIFNREHAWDDMWIFWVGPFIGAALAAMYQQIVIRAIPFKSRA

SEQ ID NO: 16667 - protein, 319 aa, Ruegeria sp. PR1b
MMLEISKRNARMWSRMGIRAFYGQALSAIASENPNVLALSADLGRSSGLDRFSKEYPAQFLNTGIAEQNMVGVAAGLARTGFDVFASTFAPFASMRAAEQVRMNMGYMHEPVKLVALGSGLAMGFLGNSHYGLEDLAVMRAIPGLTVVSPADCAEIYKVLLACVDYAHPVYIRLTGAINCPVFEVNLFGPLLFTQSVVKKMLRAKQGSVVNIASTAGLLADAGTLSYGGSKAALIHATKVMARELGSFGIRVNAIAPSVVETEMATQMDASARAALDARSALPGAIEPGDVADLAAFLISEQSARITGQVMRIDRGLPF

SEQ ID NO: 16668 - protein, 326 aa, Zea mays
MASPIPREWVGLQQFPAATQTKLHELLGKLKEEDVSTLTILVMGKGGVGKSSTVNSIVGERVASVSAFQSEGLRPMMCSRTRAGFTLNIIDTPGLIEGGYINEQAVDIIKRFLLGKTIDVLLYVDRLDAYRMDTLDEQVIRAITNSFGKDIWRRSLVVLTHAQLSPPDGIDYNDFFTRRSEALLRYIHSGAGINKREYGDFPLPIALVENSGRCKTNEHGEKILPDGTLWVPNLMKEITVVISNGSSPIHVDQKLIDGPNPNNRRKLFIPLILAVEYFLVVKGIRRAIHADIANGKVDDWEQRYRDLVGSRDLVEQKGSTSRNRKA

SEQ ID NO: 16669 - protein, 573 aa, Vibrio sp. Ex25
MRILQPYIRHPMNNDKRPLYIPYAGPALLATPLLNKGSAFSAEERSSFNLEGLLPESTETIQEQVERAYQQYKSFESDMDKHIYLRNIQDTNETLYYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGAEYDAFVEEFIQAVQRRWPDALIQFEDFAQKNAMPLLERYKDRVCCFNDDIQGTAAVTVGSLLAACKAAGTQLSKQRITFLGAGSAGCGIAEAIIAQMVSEGISDEQARSQVYMVDRWGLLQEGMPNLLDFQQRLVQKHTNTKEWENEGNGFSLLDVMRNAKPTVLIGVSGAPGLFSQEVIEEMHKHCKRPIVFPLSNPTSRVEATPNDIIRWTNGEALVATGSPFEPVVHEGRTYPIAQCNNSYIFPGIGLGVLAVNAKRVTDEMLMESSRALATCSPLAINGRGALLPPLEEIHSVSKKIAFAVGKKAIEQGVALEITDEALNVAIEQSFWQPVYRRYKRTAF

SEQ ID NO: 16670 - protein, 295 aa, Zea mays
MPLGQRPGDKSDARYCGAEVLDFPAGEDLPAVLNHSLASAFDFILVPLVDPNYRPAPGSVLPVSASDLILGPAQWSNHVVGKISEWIDLDSEDERLRLDSELTLKQEIAWASHSLAAGFKKQLYNEDTTFLILPGAGNWLLLWLKLPLEKSEPMDDDLDKIKNNSHTLQSEIVDSWELWNSFRLLCDHSSQLCVALDILSTLPSINSLARWFGEPVRAAILQTEAFLTNAKGYPCLSKRHQSLLTGFFKHSVQVIISGRSNHNVFPVSEGVLSGDESYAEEWFILEPPNIGLPRL

SEQ ID NO: 16671 - protein, 331 aa, Vibrio harveyi
MTIKVGINGFGRIGRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALTDNFVKVVSWYDNEIGYSNKVLDLIAHISK

SEQ ID NO: 16672 - protein, 171 aa, Oryza sativa Japonica Group
MQQRRPASGRPSGTDGSDFSYRMVVDSRYQRVADGKSRLGRLILVQALHQVAGGALLLLALSKGAEMNKFAVMSVAAGLLAIVLGEIGRRRTMAVLLRMYTSLSSIAVAFSVACIIRSELFFKITKQNTESITSHELLEVVRVALGVLLQLVVIATTTRLLQNMSPPRRAS

SEQ ID NO: 16673 - protein, 151 aa, Ralstonia metallidurans CH34
MKVSDILQLKGNTLFTVTPDTPLMQAVQAMAEHDIGSLVVMEYGDLVGMLTFREIIETMAANNGTLGTHSIRKVMDDAPLTCTPETDVNEVRRMMLERHTRYLPVLDNRTLMGVISFYDVAKSVVEEQSFENKMLKAYIRDWPEEKEERAS

SEQ ID NO: 16674 - protein, 925 aa, Medicago sativa
  misc_feature (635)..(635): Xaa can be any naturally occurring amino acid
MELQVIRIFRLVVACVLCLCIFIRSASSATKGFESISCCADSNYTDPKTTLTYTTDHIWFSDKRSCRPIPEILFSHRSNKNVRIFEIDEGKRCYTLPTIKDQVYLIRGVFPFDSLNSSFYVYIGVTELGELRSSRLEDLEIEGVFRATKDYIDFCLLKEDVNPFISQIELRPLPEEYLHGFATSVLKLISRNNLGDTNDDIRFPDDQNDRIWKRKATSTPSSALPLSSNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLELIQKMREELLLHNRENEALESWSGDPCMIFPWKGITCDDSTGSSIITMLDLSSNNLKGAIPYFVTKMTNLQILNLSHNQFDSLFPSFPPSSLLISLDLSYNDLDGRLPESIISLPHLKSLYFGCNPYMKDEDTTKLNSSLINTDYGRCKGKKPKFGQVFVIGAITRGSLLITLAVGILFFCRYRHKSITLEGFGGKTYPMATNIIFSLPSKDDFFIKSVSVKPFTLEYIEQATEQYKTLIGEGGFGSVYRGTLDDGQEVAVKVRSSTSTQGTXEFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLTHPQPR

SEQ ID NO: 16675 - protein, 802 aa, Oryza sativa Japonica Group
MPLALTLLGLLLLSLHISASCAAMDTMTPAQALFGNGKLISSNGKFALGFFQTGSKSSHNTLNWYLGIWYNKIPKLTPVWVANGDNPVTDPNNSELTISGDGGLVILDRSNRSIVWSTRINITTNDTVAMLLNSGNLVLQNFLNSSDALWQSFDYPTHTFLPGAKLGWSKISGLNSRLVSRKNSIDLAPGKYSVELDPSGANQYIFTLLNSSTPYLTSGVWNGQYFPSIPEMAGPFIVNFTFVDNDQEKYFTYSLLDETVVFHHFLDVSGRTKTFVWLEGSQDWVMTYAQPKVQCDVFAVCGPFTICNDNELGFCKCMKGFSIKSPKDWELDDRTDGCMRNTPLDCASNKTASSLTDKFHSMPCVRLPQNGYSIEAATNADKCALVCLSNCSCTAYSYGNGGCLVWHAELFDVKQQQCDGITDTNGGTLYIRLASREEQSQKKNRRGLIIAIALGLSFAALFMLAIALVIWWNKSKRYNCTSNNVEGESGIVAFRYIDLQHATKNFSEKLGEGGFGSVFKGFLHDSRTIAVKKLAGAHQGEKQFRAEVSSIGLIQHINLIKLIGFCCDNDSKLLVYEHMPNRSLDVHLFPTDIKILNWDTRHQIAIGVARGLSYLHDSCRDCIIHCDVKPQNILLSESFTPKIADFGMAKFLGRDFSRVLTTMRGTIGYLAPEWISGVPITPKVDVYSYGMVLLEIVSGRRNSNGGCITGGDKDVYFPVKVAHKLLEGDVESLIDPNLHGDANLTEVERVCKVACWCIQDNEFDRPTMGEVVQILEGIFELDTPPMPRLLQAIAGSSCSIAE

SEQ ID NO: 16676 - protein, 232 aa, Candidatus Protochlamydia amoebophila UWE25
MTQTNDSPSIKAKKAAALKAVEFVQDQMIIGLGTGSTIAYFIEALGKRCQAGLKITAIASSERSMRQARLVGIPIVDSDTILELDLTIDGADEIDPLKQMIKGGGGALLREKLIASASKEMIVVIDETKLVNKLGKFPVATEISIFTFRHIVKKLKDHGYCGSLRVNQDQSLYRTDNGNYIFDICFPEPIDNPIFEHNRLKSFAGVLETGLFFNLAGRVIIGYQNGMTKIVA

SEQ ID NO: 16677 - protein, 206 aa, Triticum aestivum
  misc_feature (5)..(5): Xaa can be any naturally occurring amino acid
  misc_feature (55)..(55): Xaa can be any naturally occurring amino acid
MRKAXMESLTSPAAFVEGGVQDACDDACSICLEAFCESDPSALTGCKHEFHLQCXPTSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSTQGEGADDLRILVPRVGDLPPHANPIEEAGNQSPGVLTYDAEQMLV

SEQ ID NO: 16678 - protein, 924 aa, Medicago truncatula
MELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILNLSHNQFDMLFPSFPPSSLLISLDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 16679 - protein, 283 aa, Caulobacter crescentus CB15
MSLLKKIAFQGEPGANSHEACRTYFPDYEAYPCKTFEEAFEAIKSGVAQLGMIPIENSIAGRVADVHHLLPASGLKIIGERFKPIRFQLMANKGVKLEDIKVVSSMPIALSQCRNSLKRLGVETEAAGDTAGAAKALALKPNPTHAAVAPALAAEIYGLDILARDIEDERHNTTRFLVMTADKAPAAPDFTHRCVTSFVFRVRNLPAALYKALGGFATNGVNMTKLESYMEGGNFTATFFYAEVDGRPEDRNLALALDELKFFSERFEILGVYPADPFRDRGA

SEQ ID NO: 16680 - protein, 350 aa, Triticum aestivum
MERRGLLKTALLACLLVVCSGRVPMVIQQPSTTIYNSTLAKTLVEYAAAIYTADLTQLFTWTCDRCGDLIEGFEMMDIIVDVENCLEAYVGFASDINAVIVVFRGTQENSIQNWIEDLLWKQLDLDYPGMPEAMVHRGFYSAYHNTTIRDGIVSGIQKTRKLHGDVPIMVTGHSMGAAMASFCALDLVVNYGLDDVKLMTFGQPRVGNAAFASYFKRYLPHAIRVTNANDIVPHLPPYFSFFPQKAYHHFPREVWVHDVGLGSLVYTVEQICDDSGEDPACSRSVSGNSIQDHITYLGVSMHAEAWSSCRIVMDYAELRYKMDLHGNVVLSKQQQQQPGLSDQRRRHSAQ

SEQ ID NO: 16681 - protein, 211 aa, Triticum aestivum
  misc_feature (10)..(10): Xaa can be any naturally occurring amino acid
DSRSSSSTSXVSTVIGYKHQTDASASGPDAACGGVGILGIAWAFGGMIFVLVYCTAGISGGHINPAVTFGLFLARRVSLVRALLYMAAQCLGAVCGVGLVKGFQSGLYARHGGGANEVGAGYSVGTGLAAEIVGTFVLVYTVFSATDSKRNARDSHVPVLAPLPIGFAVFMVHLATIPITGTGINPARSLGAAVIYNGDKAWSDQWIFWVG

SEQ ID NO: 16682 - protein, 210 aa, Triticum aestivum
ATLLFVYITVSTVIGYKHQTDASASGPDAACGGVGILGIAWAFGGMIFVLVYCTAGISGGHINPAVTFGLFLARRVSLVRALLYMAAQCLGAVCGVGLVKGFQSGLYARHGGGANEVGAGYSVGAGLAAEIVGTFVLVYTVFSATDSKRNARDSHVPVLAPLPIGFAVFMVHLATIPITGTGINPARSLGAAVIYNGDKAWSDQWIFWVG

SEQ ID NO: 16683 - protein, 901 aa, Medicago truncatula
MELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 16684 - protein, 482 aa, Propionibacterium acnes KPA171202
MQEGDSVTPHTSTTVDKGDAGYDKALKNRHLQMIAIGGSIGTGLFLGTGGRLAQGGPGLAISYAVCGIFAFLMVRALGEMAIRRPSSGAFVSYAREFMGEKGAYATGWFFFLDWSVTVMADITAVALYLHYWTPLRAIPQWVLALIALGVVFTLNMLSVKMFGEAEFWFAAIKVAAIILFMIAAIWAIVTGARVGNYTAGLHNIAQHGGFFPAGLAPVFALTLGVIFAFGGTEMVGVAAGETKDASKILPKAINSMILRIFVFYVGSIILMALVLPYTAYSSNESPFVTFFTGIGIPYAGDIIQVIVLTAALSSLNAGLYSTGRTLRSLAVAGEAPKAAAKLNRHHVPSGGIAMTAALGLLGVALNAFLPDSAFEIVMNLAGIGIAGTWAMVLLAHTRFVSAVRRGKDNRPEYRMPGAPVTNYISLAFLLIVVLSNVTSESGRWTLALFALVAIAMVAGWYAVRNSIKPDLLDNVVPSDEGM

SEQ ID NO: 16685 - protein, 391 aa, Xanthomonas axonopodis pv. citri str. 306
MTQPAILVLEDGTVFEGESVGANGLSVGEVVFNTAMTGYQEVLTDPSYARQMVTLTYPHIGNTGFTDQDDEARKIWAAGLIVRDVPRRPSNWRSQVALPEWLQARGVVAISGIDTRKLTRLLRQKGAQNGALMAGDIDVEKALEAARKFPGLKGMDLAKVVSTESTYNWKEGSLDLNSDSFLGLGALNIGKSAHASAGSGEELAFKVVAYDYGVKLNILRMLAERGCDVTVVPARTPVAEVLALQPDGVFLSNGPGDPEPCDYAIDAIKELIAQKVPTFGICLGHQLLALAAGAKTLKMTTGHHGANHPVQDLDGGRVMITSQNHGFAVDESTLPANVRVTHRSLFDGTNQGIALTDAPAFSFQGHPEASPGPRDVGPLFDRFVDLMAARA

SEQ ID NO: 16686 - protein, 187 aa, Triticum aestivum
ATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFFRGTALGAEIVGTFVLVYTVLAPLPIGFAVFMVHLATIPITGTGINPARSLGAAVIYNKKAAWDNHWIFWVG

SEQ ID NO: 16687 - protein, 211 aa, Triticum aestivum
  misc_feature (207)..(207): Xaa can be any naturally occurring amino acid
MSANQIKSIKARQIYDSRGNPTVEVDLYTADGQLFRAAVPSGASTGVHEALELRDKDKANWHGKGVLKAVGHVNDTLGPAVLAKNFDVVNQTEVDKFMLELDGTENKSKFGANAILGISLAVCKAGAHAKKVPLYKHIADLAGVKELVLPTPAFNVINGGSHAGNALAMQEFMILPTGASSFTEAMKMGSEVYHHLRNVIKEQYGLXATCV

SEQ ID NO: 16688 - protein, 180 aa, Zea mays
MIRVIPGGFGLGRLISRLSLTILLPLTTTRKEEFLCRGECSSVCIEGTLIQTNSLSHCWKTKGLKSLNKLEKHKSSYGSISRDSNPEQEVEASDEASGPTCCVRCFTDLPAVLVYEVLARLDAKDLGIVSCVSTLLHTLATDHQGWKKLYCERWGLPYLPTTLNGPFLPGGGALDGKSWK

SEQ ID NO: 16689 - protein, 146 aa, Triticum aestivum
MGRKLALLVGINYPGTKAELKGCHNDVDRMHKCLVDRFGFDEENITVLLDRGSSGPQPTGANIRHALAKLVGDARRGDFLFFHYSGHGTRLPAETGQDDDTGYDECIVPSDMNLITDQDFRDLVQKVPDGCIFTIVSDSCHSGGLL

SEQ ID NO: 16690 - protein, 215 aa, Coprinopsis cinerea okayama7#130
MTGNAVYSSGAPLQYRNTSSFMGKAKKTRKFATVKRLMHPNDIRLKENQLKQQRKEEEEKAKAVRRVQQSASSLFLQHNTALVPPYRVLIDTNFINFSLQNKLELVSGMMDCLYAKCIPCVTDCVMAELEKLGHKYRVALRVARDPRFERLRCSHTGTYADDCLVQRVTSHKCYIVATCDRDLRRRIRQIPGVPLMYIVSRRYAIERLPDQGAPV

SEQ ID NO: 16691 - protein, 325 aa, Pseudomonas aeruginosa
MAKRIQFAACGGPEVLEYRDYQPAEPGPREVRVRNRAIGLNFIDTYYRSGLYPAPGLPSGLGSEGAGEVEAVGSEVTRFKVGDRVAYATGPLGAYSELHVLAEEKLVHLPDGIDFEQAAAVMLKGLTTQYLLRQTYELRGGETILFHAAAGGVGLFACQWAKALGVQLIGTVSSPEKARLARQHGAWETIDYSHENVARRVLELTDGKKCPVVYDSVGKDTWETSLDCVAPRGLLVSFGNASGPVTGVNLGILSQKGSLYVTRPTLGSYADTPEKLQAMADELFGLIERGDIRIEINQRFALAEAARAHTELAARRTTGSTVLLP

SEQ ID NO: 16692 - protein, 161 aa, Zea mays
AKPKRPFPFALFDPSKKAAAEMVYYALLVGAELDGLTNLQPSGGCDDPSFPYYLKCKLCGRDGTIVMIPGQGTPLTIEQSQKEEKTCLMVFDCRGYEPVEFSFGAGWKAESVHGTPFEIDCSEDEFSEYDEKGECPVELSKLQSTFKVVKKHEKGGKIRFV

SEQ ID NO: 16693 - protein, 338 aa, Frankia sp. CcI3
MTMTVPDAIERGRTLTVPALRATVDRLHPRLRHVVAYHRGWVDAEGAPLSGGGGKLVRPALALLSAQAAGAPAETGLPAAVAVELVHDFSLLHDDLMDGDTERRHRPTAWTIFGADGAILAGDALLGLATQVLLEVEGEPGRRAALILGAGVQDLVRGQAEDLMFEKRSDVSVAETLHMEDGKTGALLACSASLGAVLAGAGDDMVNALAEYGSRLGTAFQLIDDLLGIWGDPSVTGKPVLSDLRSRKKSVPVVVALEAGGAAAEELRAFLTGTGESTEAELTHIADLIERAGGRDWTTAEADGQLKACENVLRSLSMPAEIEAELLALARFVTERDR

SEQ ID NO: 16694 - protein, 295 aa, Microcystis aeruginosa PCC 7806
MNRLARLRVEDIQAWIGEVHLLDRKGQTPYYIPVLNRVNPDVFALQIHCLEGEILSWGDETVTFPLMSVIKPFLLLYLLNHLGEDAVFRRVGKQASSYPFNSLTQLQEDSGFPRNPLINSGAITLADLLGGETPESRCENLLLWLNKMGNCQLFLDRSVLESVHSYPNVHNQALSLELEKNGYISHRYLALETYNRICCLSGKIADLANLGKLILAAPFSEIILEIMTNCGLYEASEKFAIEVGFPTKSGVSGALLSILSDEGVIACYSPLLNEQGNSVLGLDLLTKLSNFFKEI

SEQ ID NO: 16695 - protein, 444 aa, Agrobacterium tumefaciens str. C58
MDNPSRSNSTSLDSYWMPFTANRQFKANPRLLTSAEGMYYTSNDGRQVLDGTAGLWCVNAGHGRQQIASAVKHQLSTLDYAPSFQMGHPVAFEFAERLAEIAPGPEGGKLDRVFYTGSGSESVDTALKIAIAYQRAIGQGTRSRLIGRERGYHGVGFGGISVGGLVNNRRVFPQIPADHLRHTHDLARNSFVKGQPEHGAELADDLERLVALHGAETIAACIVEPVAGSTGVLVPPKGYLERLRAICDKHGILLIFDEVITGFGRMGSSFASNYFGVTPDIVTTAKGLTNGAIPMGAVFTSRKVHDALMHGPENQIELFHGYTYSGHPVACAAGIATLDIYRDEGLFTRAAELQDAWHDAIHSLKSAANVIDIRTIGFIAGIELQSREGAVGARAYDVFVDCFERGLLIRVTGDIIALSPPLIAEKSHFDDIVSILGDALNRAV

SEQ ID NO: 16696 - protein, 684 aa, Oryza sativa
  misc_feature (676)..(676): Xaa can be any naturally occurring amino acid
MVIPGPFFRRSTALQVFSVLCVLRFVVPDPDIEWPLIHGIPACPPFTCGHLSKVASPFHRRGYECGVASYELTCTDDKATIQIDNGTYFVTGIDYSDSTFWVVDANISDSRNNCPLPRWKRIPYYYDDVSSDDEESSPYNIQVELDPASRWWSFFVNCSKEINNNVMYSPVACMGTSSSFVYVLTGRLSCYIENLEPSCGYLAMTPLDGMGRVAPAVDSLSYEDVVKFMRKGFRVQFPFRHHRNRSFKDCLMESIPKSTGIGKLSDWFSLSVTENFMDCATAKIPSPYNILLGIILYALMFWTMLAPPCRYLLAPLVVLIFLAQKYLKRMITIDAVEKFLRMQQMLGPTRYAYTDIIAITGHFREKLGQGGYGSVYKGVLLPGDLHVAIKILNGYSNCNGEEFISEVATIGRIHHVNVVRLVGFCSEEMRRALVYEYMPRGSLDKHIFSSERRFSWDKLNEIALGIARGINYLHQGCDMQILHFDIKPHNILLDDNFVPKVADFGLAKLYPRDKSFVSDRALRGTVGYMAPEMVSRSFGIISGKSDVYSFGMLLLEMVGGRRNADPNADSSASKAYYPSWVYDKLIADQQVDEISNFANMHELERKLCLVGLWCIQMKSHDRPTMSEAIEMLEGGVDALQVPLRPFFCDGDGMPPPQVMDSYFHSSDLSAISEEDXGIAELASS

SEQ ID NO: 16697 - protein, 542 aa, Prochlorococcus marinus str. NATL2A
MSGSNPAVSINKKKVAPVVLAILDGWGYREEIEHNAVRQASTPVIDALWHAYPHTLIEASGADVGLPDEQMGNSEVGHLTIGAGRIIQQELVRISNTVKENKLIANPALNQFSQSLKKGGGTLHIMGLCSDGGVHSHIKHLCGLIEWAASKGLKNVSLHLFTDGRDTSAKSATKYINTIEAKIKATGVGEISSLCGRYWAMDRDNRWERTSKAYELLTDPRFAISKLSAAESINKSYQEGITDEFIEPVRLSSSFLKDGDGVVFFNFRPDRARQLVKALKLKDFDGFERKNKTDIDVLTFTQYESGLPVSVAFPPEPLNDLLGQVIADHGLNQYRTAETEKYPHVTYFLNGGIEKPLKGEVRHLVPSPRVATYDLQPEMSADELTESCIQAIDTGIYSLVVINFANPDMVGHSGIMKAAIKANEKVDSCIGKLLNSIGKLGGSLLITADHGNSEMMIGPDGQPWTAHTTNPVPVILIEGEKRKLSGYGNDIKLRESGGGLADLAPTLLHLLNLPKPKAMTGKTLIEPINLPKKPNLIPQPAY

SEQ ID NO: 16698 - protein, 488 aa, Prochlorococcus marinus str. NATL2A
MAASATATVGTKGVVRQVIGPVLDVEFPAGKLPSILNALRIEGKNPAGQDVALTAEVQQLLGDHRVRAVAMSGTDGLVRGMEALDTGAPISVPVGEATLGRIFNVLGEPVDEQGDLKNVTTSPIHRSAPSLTDLETKPKVFETGIKVIDLLAPYRQGGKVGLFGGAGVGKTVLIQELINNIAKEHGGVSVFGGVGERTREGNDLYEEFKESGVINSEDLTKSKLALCFGQMNEPPGARMRVGLSALTMAEHFRDVNKQDVLLFIDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPSVVGDEHYRTARAVQSTLQRYKELQDIIAILGLDELSEEDRKTVDRARKIEKFLSQPFFVAEIFTGMSGKYVKLEDTIKGFNMILSGELDQLPEQAFYLVGSIDEVKAKAEKIASEAKA

SEQ ID NO: 16699 - protein, 992 aa, Oryza sativa Indica Group
MTQRDNRREQGKQDSFTRKGKGKRPRTPAAIPIHPIEVPPTAVPGGPREPGPHVIEVLRIKGRSNMKYSINFTIWDFKRLCEYQTGKRSNPCPRSLPPNAVMGLALTRDCRGSGLLKRCYALENCGQDWLLGRRGGGIPSANVVMDRPQDPFNSRGIAVPPAVKMRNMAGNNSPWIDPLPPPMNARNGLANASLFSTSLPVLPHEKINFLDSARGTPLMDDASAKLKELDDDPEGKDYKFDFDLRQIDDLLPNEDDLFAGITNEIEPAGQTNSMEELEEFDVFGSGGGMELDTDPVESITAGLGNTSIADGLRGNGVNHFGPSNSASTVAGEHPYGEHPSRTLFVRNINSNVDDTELRSLFEQYGDIRTLYTATKHRGFVMISYFDIRAARGAMRGLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRNLMQQLGHDIDQDEPRSYRIPHVGSPIASSPPGAWAQYSSPTDNNLLQAFNASPTGNGMSPIGMPPSLISNAVKIAPIGKDSNWSKYDKVFSNNNQPHGAAFQHSHSYQDHKSEHMSSSPGTLTGPEFLWGSPKPYSEHAQSPIWRPPAIGHAIPSNTRSQGQGLLYGGRQASLFGSQDQLHHHHVGSAPSGAPFESHFGFLPESPETSYMNQVRFGNIGNIGSGRNGTGLMLNMAARASVNPVSALSGNMSDNNSSSFRPILSPRLGQSFYGNPTYQGPGSFGLDNSIERGRNRRVDSSVFQADSKKQYQLDLEKIRKGDDTRTTLMIKNIPNKYTSKMLLAAIDEFHKGTYDFFYLPIDFKNKCNVGYAFINMISPVHIVSFYQAFNGKKWEKFNSEKVASLAYARIQGRTALISHFQNSSLMNEDKRCRPILFHSNGPDAGNQEPFPINGICIHMPLEDGAIATGDPFGNEEDNNQNERTAGEEL

SEQ ID NO: 16700 - protein, 174 aa, Arabidopsis thaliana
MAPRIRTIGSYATQEKYSVNFFGEELTVTVTPDPSVIGQWIHDVLSNNRFSSHPLVVGVGVQWTPPAYPDYTFVGVWNSQDARKLERSRHQLEIDDLLDLRKYVEDSSGRRSMRGCSFEVIVEECLGYRGVRLDREISMSDWSAYELCDDQILQASIDAHVCFKLGVKYRLWKV

SEQ ID NO: 16701 - protein, 925 aa, Medicago truncatula
MMELQVIRIFRLVVAFVLCLCIFIRSASSATKGFESIACCADSNYTDPKTTLTYTTDHIWFSDKRSCRQIPEILFSHRSNKNVRKFEIYEGKRCYNLPTVKDQVYLIRGIFPFDSLNSSFYVSIGVTELGELRSSRLEDLEIEGVFRATKDYIDFCLLKEDVNPFISQIELRPLPEEYLHGFGTSVLKLISRNNLGDTNDDIRFPDDQNDRIWKRKETSTPTSALPLSFNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLEVIQKMREELLLHNQENEALESWSGDPCMIFPWKGITCDDSTGSSIITKLDLSSNNLKGAIPSIVTKMTNLQILNLSHNQFDMLFPSFPPSSLLISLDLSYNDLSGWLPESIISLPHLKSLYFGCNPSMSDEDTTKLNSSLINTDYGRCKAKKPKFGQVFVIGAITSGSLLITLAVGILFFCRYRHKSITLEGFGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSEREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLSHPQPR

SEQ ID NO: 16702 - protein, 205 aa, Pseudomonas fluorescens
QQIVTLTYPHIGNTGTTPEDAESDRVWSAGLVIRDLPLVASNWRNKLSLSDYLKANNVVAIAGIDTRRLTRILREKGAQNGCIMAGDNISEEAAIAAAQGFPGLKGMDLAKVVSTKEQYEWRSTVWDLKTDSHATIDASELPYHVVAYDYGVKLNILRMLVARGCRVTVVPAQTPAADVLALNPDGVFLSNGPGDPEPCDYAIQA

SEQ ID NO: 16703 - protein, 296 aa, Oryza sativa Indica Group
MRKRERENPCEICGHYHNSEEGERCGVCGHRSGPVAGEPPATLDPAFPTEVLKDFLFLGSYNNASRSEVLKTLSITHILNTVPDCQNLYRNSFTYHCIQDERSLDFDGANRFLEQCERETSRVLVHCMSGKNRCDSSVVSIHVVSIVVNDRLILLWYKISRSAAIVIGYLMKSRGWRLPQSYQWVKDRRPQVQLTDASQHQLVEYEQKLFGPNVGAPAQSSVPTESFRPLGFGFPKPAGDIQAPVFNQQPVPSIFERVNPSNIPSNFTFGAMEANTPMDDNGAPAPTSGDNPMDSS

SEQ ID NO: 16704 - protein, 193 aa, Zea mays
MDVDGPAPADASARPATNGEAPSGAREVDVGEEDTLAGVLRSFVDGVWYPDEPLLRRLRAASCDAAPRLRGASRNSARDLLEWTRRGSGLRAILVISVGARLLDPSHEHGFSCPVGTITLIALTGLLTFMFFLLVATANAIIVSVLMSLAAAGGFLAIFFACLVAVYIGAVSVAIFVISATVISAVVGILVAT

SEQ ID NO: 16705 - protein, 209 aa, Dehalococcoides sp. VS
MKSTKALILATLFPVTLFAGSCSGGDAVPEVTPMSWTTAPAMQIDPAKQYYATVETTLGTFKIELFASESPKTVNNFVFLAKENYYNGVIFHRIIKEFMIQTGDQTGTGRGGPGYRFADELPVKHSYDPGIVAMANAGPNTNGSQFFICTGAQAKNLNYQPNYTQFGRVIEGMDVITKLASVTVIGNSYGEVSTPSNPPKIIKITITEG

SEQ ID NO: 16706 - protein, 158 aa, Oryza sativa
MAQREKKVEEPTELRAPEMTLCANSCQNCFLAASASSSGGSAAASPSTTSLPVFPVVEKPRQAVQSSAAAAVALVVERPTAGPVESSSKASRSSSVNRCHSCRRRVGLTGFRCRCGELYCGAHRYSDRHDCSFDYKSAARDAIARENPVVRAAKIVRF

SEQ ID NO: 16707 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 16708 - protein, 124 aa, Dehalococcoides sp. VS
MEYNKLSPEEEAVIVRKGTESAFSGEYENLFKDGKYVCRRCNAPLYSSKDKFHSGCGWPSFDDELPGAVKRQPDPDGRRTEILCAACGGHLGHVFKGESFTPKNTRHCVNSLSIKFVPENGGSK

SEQ ID NO: 16709 - protein, 75 aa, Triticum aestivum
VLVYTVFSATDPKRTARDAFVPLVAALPIGLAVFVVHLATIPITGTGINPARSLGAAVLYNQHKTWKQHWIFWVG

SEQ ID NO: 16710 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEEGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 16711 - protein, 205 aa, Pseudomonas fluorescens
QQIVTLTYPHIGNTGTTPQDVESNRVWSAGLVIRDLPLVASNWRSTMSLSDYLKANNVVAIAGIDTRRLTRILREKGSQNGCIMVGENISEAAAIAAAQGFPGLKGMDLAKVVSTQEQYDWRSTVWDLKTDSNATIDAADLPYHVVAYDYGIKYNILRMLVERGCRVTVVPAQTPASDVLALQPDGVFLSNGPGDPEPCDYAIKA

SEQ ID NO: 16712 - protein, 409 aa, Methylophilus methylotrophus
MALIVQKYGGTSVANPERIRNVARRVARYKALGHQVVVVVSAMSGETNRLISLAKEIMQDPDPRELDVMVSTGEQVTIGMTALALMELGIKAKSYTGTQVKILTDDAFTKARILDIDEHNLKKDLDDGYVCVVAGFQGVDANGNITTLGRGGSDTTGVALAAALKADECQIYTDVDGVYTTDPRVVPEARRLDKITFEEMLELASQGSKVLQIRSVEFAGKYKVKLRVLSSFEEEGDGTLITFEENEENMEEPIISGIAFNRDEAKITVTGVPDKPGIAYQILGPVADANIDVDMIIQNVGADGTTDFTFTVHKNEMNKALSILRDKVQGHIQAREISGDDKIAKVSVVGVGMRSHVGIASQMFRTLAEEGINIQMISTSEIKIAVVIEEKYMELAVRVLHKAFGLENA

SEQ ID NO: 16713 - protein, 286 aa, Vitis vinifera
MEGKEEDVRLGANKFTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYSKGDGLGAEIVGTFVLVYTVFSATDAKRNARDSHVPILAPLPIGFAVFLVHLATIPITGTGINPARSLGAAIIYNREHAWDDMWIFWVGPFIGAALAALYHQIVIRAIPFKTRA

SEQ ID NO: 16714 - protein, 507 aa, Arabidopsis thaliana
MESDEAAAVSPQATTPSGGTGASGPKKRGRKPKTKEDSQTPSSQQQSDVKMKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKP

SEQ ID NO: 16715 - protein, 287 aa, Vitis vinifera
MAKDIEVAGHGDLTLKDYHDPPPAPLVDPEELGSWSFYRAIIAEFVATLLFLYVTVLTVIGYKNQTDPYHHGNECNGVGILGIAWAFGGMIFILVYCTAGISGGHINPAVTFGLFLARKVSLVRAVMYMVAQCGGAICGCGLVKLFQDIYYIRYGGGANELASGYSIGTGLAAEIIGTFVLVYTVFSATDPKRNARDSHVPVLAPLPIGFAVFMVHLATIPITGTGINPARSLGAAVIYNQPKAWSDHWVFWAGPFIGAAIAAFYHQFILRAGAVKALGSFKSSSHM

SEQ ID NO: 16716 - protein, 504 aa, Zea mays
MVLTHVHDLDEASAASAVVFASRYVQDPLPRYELGEKSVSKDAAYQIIHDELLLDSSPRLNLASFVTTWMEPECDKLILEGINKNYADMDEYPVTTELQNRCVNIIARLFHAPVGASEKAVGVGTVGSSEAIMLAGLAFKRRWQNRRRAAGQPCDRPNIVTGANVQVCWEKFARYFEVELKEVRLREGCYVMDPDEAVRMVDDNTICVAAILGSTLTGEFEDVRRLNDLLAANNRRTGWDTPIHVDAASGGFIAPFLYPDLEWDFRLPLVKSINVSGHKYGLVYAGVGWVVWRSKEDLPDELIFHINYLGADQPTFTLNFSKGSSQIIAQYYQFLRLGFEGYRNVMENCMESARTLREGLERTGRFTIISKEQGVPLVAFTFKAKDETPLAFKLSAELRRFGWIVPAYTMPANLEHMAVLRVVVREDFGRPLAERFLSHVRMALEELDHAAKGGPVPRMRLTIELGPPARGSGEEASARVVNREAVVPVHRSVSLAGGKTKGVC

SEQ ID NO: 16717 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKKSARDSHVPVLAPLPIGFAVFMVHLATIPITGTGINPARSLGAAVIYNNEKAWDDQWIFWVGPFIGAAIAAFYHQFILRAGAVKALGSFRSTAHV

SEQ ID NO: 16718 - protein, 199 aa, Microcystis aeruginosa PCC 7806
MIPTVIETTGRGERAFDIYSRLLRERIVFLGQEVTSDLANLIVAQLLFLEAEDPEKDIYLYINSPGGSVSAGLGIFDTMNQIRPDVSTICIGLAASMGAFLLSAGKPGKRMSLPNSRIMIHQPLGGAQGQATDIEIQAKEILYLKQLLNQHLASHTGKPLDLIAEDTERDFFMSAEEALDYGLIDQVIDRSPSASNPPQ

SEQ ID NO: 16719 - protein, 276 aa, Chlamydomonas reinhardtii
MDEQEEGEDGEEEEGDSDGFLLVADEDAGEEGGADDVEGEDEEEGEMFPEIQLNLPPPTKVKVKAAEYMQSCVTVADCPPPRYPEFAVIGRSNVGKSSLINMITGRKDLALVSKEPGKTKCINHFIINENWYLVDLPGYGFAKVGFQGRQQFDTFTKEYFNTRPNLAMVLLLVDASIKPQRIDLEYANWLTDNEVPFTIVFTKADKRRKGLTAAVRDSHVTAFKRALLQDLAYLPPSLLTSAAKGLGRGELLSFIAGLRVAYERSGRLEAIRQGMI

SEQ ID NO: 16720 - protein, 398 aa, Aspergillus oryzae
MTERLSSLVSQKSSDSGLHIQLHPLILLTISDHITRHAARSQQGPILGALLGQQNGREITLEHAFECIVKEGPNGEPQLPNEWFNERVKQCVTVKDVHKVPALDIVGWWSTAPPSGPDVTHLPIHRQILQDYNESAVFLAFHPSQVKGASANGGKLPLTVYESVYEGENAAESEKTMQVDGEEQSLSIRFRELPYFVETGEAEMIGIDTVARTARNAAVEGPSALSSAKEVLKKKTDNKEQSADTAVLSPEDEELIASLNTRLNAIRTLESRISLIKSYVASISPESEGGNQKNTTPSTATLSHPILRNINSLLSHLSLLSPQEQSAFSAEVLAQSNDVHLVALLGQLSSSINSMRELGKRTAILTNVRRSNTSRKTQMSLQNRFEEELFSRDGTTHG

SEQ ID NO: 16721 - protein, 205 aa, Pseudomonas fluorescens
QQIVTLTYPHIGNTGTTPEDVESDRVWSAGLVIRDLPLVASNWRNTMSLSDYLKANNVVAIAGIDTRRLTRILREKGSQNGCIMAGDNISEEAAIAAAQGFPGLKGMDLAKVVSTKEKYEWRSTVWDLKTDSHATIEAAELPYHVVAYDYGIKYNILRMLVERGCRVTVVPAQTPASDVLALQPDGVFLSNGPGDPEPCDYAIKA

SEQ ID NO: 16722 - protein, 220 aa, Ashbya gossypii ATCC 10895
MNVWVAASDGLTAQVEELLQQTGADANVKDPNGYTPMHAAAAYGHIDLLRLLIANYRGDVNVRDNDGDTPLHHAEDLQTVRVLVEELGADPSLLNADGNTPLAVYEDDAENAELIEYMRARLGGSACGPAAADAAADAAADLELPDIDSGKLAEFRESIRYTLENVPADETDPESVQRRQRLEEIMRSDCPDEQLEAYIRDMVRNQFFPSTDDTNAKRRR

SEQ ID NO: 16723 - protein, 267 aa, Ashbya gossypii ATCC 10895
MSRPEDLAPPEVFYNDGESQKYTSSTRVQHIQAKMTLRALELLNVPPCSFILDVGCGSGLSGEILTEEGHMWCGMDIAPSMLATALTREVEGDLVLQDIGVGVPFRAGTFDAAISISAIQWLCNADTSYNDPRRRLMRFFNTLFAALKKGGKFVAQFYPKTDEQVEQILGAAKVAGFSGGLVIDDPESKKNKKYYLVLSAGAARDEEQVNLQGVTMNADLLQQRARKRKEAESRKEYIMRKKDVMKKRGRKVAKDSKFTGRKRRPRF

SEQ ID NO: 16724 - protein, 205 aa, Pseudomonas fluorescens
QQIVTLTYPHIGNTGTTPEDVESDRVWSAGLVIRDLPLVASNWRNTMSLSDYLKANNVVAIAGIDTRRLTRILREKGSQNGCIMAGDNISEEAAIAAAQGFPGLKGMDLAKVVSTKEKYEWRSTVWDLKTDSHANIEAAELPYHVVAYDYGIKYNILRMLVERGCRVTVVPAQTPASDVLALQPDGVFLSNGPGDPEPCDYAIKA

SEQ ID NO: 16725 - protein, 317 aa, x Doritaenopsis sp.
MELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 16726 - protein, 250 aa, Vitis vinifera
PLFEPGELKSWSFYRAGIAEFMATFLFLYITILTVMGVKKSPTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYQQIVIRAIPFKSRA

SEQ ID NO: 16727 - protein, 251 aa, Dehalococcoides sp. CBDB1
MAIILKTEKEIAIMRRAGHILAVALEEVKKNVRPGITTRELDEIAERELLRRGTTPSFKGYQGFPASLCASVNEEIVHGIPGGRVLKEGDIISLDIGNILEGFQADMAVTVGVGEISPAAQRLISATQAALTVGIAQARAGGHLGDIGAAVEEYAQSRGYGVVREYTGHGIGRNMHEDPQIPNFGRRGKGPELKKGMTLAIEPMLNIGTEKTKVAPDCWTVYTADGSLSAHFEHTVAITDGEPEILTLIEE

SEQ ID NO: 16728 - protein, 764 aa, Pseudomonas stutzeri
  misc_feature (490)..(490): Xaa can be any naturally occurring amino acid
MLSQPRRIAERVVEGVNALKDEGAELVGLGGFTSIVGNRGLQTLDRTQIPVTTGNSLTAYAAYMNLLGVLSALEIPPEKAEVAVLGYPGSIALAIVCLLAPLGCRLRLVHRGGKQQVDTLLEYLPSQFHGQVTLHAGLEDCYAQVRLFVAATSTGGVIDPRRLACGSVVVDAALPKDMQPGWEKRDDILVIDGGLVSATDAVDFGAMALGLGPKRNINGCLAETMILALQGRAEAFSIGRELPAEKVLEIGRIAEGHGFLPYPMASGGESVDGARFDELRRFHGARPPAVVHDLNTGSQELRSEVLRCFGTHINPILREFYEFNHVERVFSNGQGCWLTDLDGRRYLDFVAGYGCLNTGHNHPEIAARLQEYLTQQHPTFVQYLSAPLHASLLAKRLAELAPAGLERVFLSNSGTEAVEAALKLALAASDKSTLLYCTNGYHGKTLGALSVTGREKHRKAFEPLLPRCEEIPFADVSALRNRLLKGDVAXFIMEPIQGEGGVTMAPDGYLRVVRDLCSEHECLWILDEIQTGLGRTGKMFACEWEDVSPDIIVLSKSLSGGLVPIGATLSSKEVWQRAYGNIDRFALHTSTFGGGNFAAAAAMAALDVIEHEDLPGNAALVGAHLRQGLEALARKHYFIKEVRGRGLMIAIEFQNDVSNGIEAFVRDMTSRMPANAAATYRMMPAKAREHLEAAMRELESTLADMFVLRIMTKLSQEHGILTFVTANNNRVMRIQPPLVLSLAEADRFIKALGEVCEDLSTFES

SEQ ID NO: 16729 - protein, 547 aa, Debaryomyces hansenii CBS767
MSTMASSTSTSKSGGDKEKGSNEGSLNNNDYHSLFKKLDINRSGEITLQDFKKALKDLKHPLSESPEMIKKIFDSFDSNQDKVIDFNDFKLYLTTTDDQILKGFNKIDQDNDGRLNKADFVHYLKKTLNLSPSDSKIDLIFKQIDYKNDGYVTYDEFRDFLLLIPRLNGSRIKTAFHFIVEELDISSDGDVTLINQFLSGFGFFLAGGLSGVVSRTCTAPFDRIKVFLIARTDLTSTVLHSKSEIARQIANGASSHVIEEARQKVIAAEAAAAKQAAEHPKKIRSPLIQAARTLWKQGGFRTFYVGNGLNVLKVFPESAMKFGSFEATKRFLSRVEGVQDTSQLSKVSTYLAGGIGGVCGQFTVYPIDTLKFRLQCSDLESSVRGNDLLFQTAKDLFKQGGLRIFYRGIFVGVSGIFPYAALDLGTFTTIKNWLVIRESKKKGIKEEDVKLPNYMVLSLGALSGTFGATVVYPINLLRTRLQAQGTYAHPYTYNGFSDVLSKTIAREGYPGLFKGLLPNLAKVAPAVSISYFMYENLKYFLRLDNSI

SEQ ID NO: 16730 - protein, 273 aa, Triticum aestivum
MAAQLFNRIGQLGLGLAVAGSVANTALYNVDGGHRAVIFDRFTGIKNTVVGEGTHFLIPWVQKPIIFDVRSRPRNVPVITGSKDLQNVNITLRILFRPLPEQLPKIYTILGVDYDERVLPSITTEVLKAVVAQFDAGELITQRENVSRKVSETLIERAGQFGVVLDDISITHLTFGKEFTQAVELKQVAQQDAERARFLVEKAEQQKQASIISAQGDSEAASMLAKSFGDAGEGLVELRRIEAAEDIAYQLSRSRQVSYFPPGQNILLNLPTQ

SEQ ID NO: 16731 - protein, 248 aa, Kluyveromyces lactis
MARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 16732 - protein, 402 aa, Synechococcus sp. WH 7805
MAKRSLASLSGTDLSGKRVLVRVDFNVPLDDAGAITDDTRIRAALPTINDLIGKGAKVILSAHFGRPKGQVNDAMRLTPVAARLSELLGKPVAKTDSCIGPDAEAKVGAMANGDVVLLENVRFFAEEEKNEAGFAEKLAGLAEVYVNDAFGAAHRAHASTEGVTKYLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQAALADCQTVIWNGPMGVFEFEKFANGTNAIATTLAELSGKGCCTIIGGGDSVAAVEKAGLAEKMSHISTGGGASLELLEGKVLPGVAALNDAA

SEQ ID NO: 16733 - protein, 242 aa, Arabidopsis thaliana
MVNYSSISCIFFVALFSIFTIVSISSAASSHGEVEDEREFNYKKNDEKGPERWGELKPEWEMCGKGEMQSPIDLMNERVNIVSHLGRLNRDYNPSNATLKNRGHDIMLKFEDGAGTIKINGFEYELQQLHWHSPSEHTINGRRSLEKELEGIAEMEEAEKNVGMIDPTKIKIGSRKYYRYTGSLTTPPCTQNVTWSVVRKVRTVTRKQVKLLRVAVHDDANSNARPVQPTNKRIVHLYRPIV

SEQ ID NO: 16734 - protein, 496 aa, Pseudomonas sp. VLB120
MNSSLSAIDGLRLPHQMLIGGQWVSAQSGKTLNVYNPATGDILTEVPDGDVEDVNAAVESAAATLRSDTWRPCLPVLASVFCCAWRISSEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 16735 - protein, 213 aa, Populus euphratica
MGCYPSKRTKETPGYEEPTVLAAETPFTVSEVEALYELFKKLSRSVIDDGLIHKEELQLALSRNKNRRNLFADRIFDLFDVKRNGVIEFGEFVRSLGVFHPNAPVEDKIHFTFRLYDLRQTGFIEREELKEMVVALLHESDLLLSDDVVETIVDKTFCDADLKGDGKIDPEEWMEFVSKNPSLIKNMTLPYLMDITLAFPSFVLSTEVEDSEV

SEQ ID NO: 16736 - protein, 540 aa, Physcomitrella patens subsp. patens
MVEYSQSWTALAVVELSVVAITAVFVPLWNVCSTFLLEPLRLRRVMGKQDVRLAPFNLVFGNAFEIGAHAQSFPETLPLKFDDLEPTATPQFDLYFSKYGKRFLYHVGSETRLVVRDPEMAKEVLFNRMGWYERSPLDLHIFSQVIGKGMFVVKGEEWEMQRRMLNPCFSNESLKPMVERMVKSAAQEMRNWEEMAAQAGGRVEHDVEHDIHIIAYNIISYTAFNEGFDKGKQIYLMQDEIMGHLFAAIGNPSFWIPGLRLLPTKHATAIAQLNGRTEKLIMELVKDRREAVQKGERDSYGDDLLGRMLTATERTDGSSHKFILDAVINNCKNFFFAGSDSAANLTTFSLLMLANYPEWQDRARKEVLEVFGDNDPCEMNDISRLKIVGMISQEIARIFAVSPSIARLAVKDCQLGDLFIPKGLVIEIATLAMHRDPELWGKDVAEFRPERFANGASAACTHHQAFLPFGAGPRSCIAEKMAWLEVKVVLCMILRRFLILPSPKYKHHPHFAMVNRPKYGLPLILEILPQSRSDSIMAEI

SEQ ID NO: 16737 - protein, 248 aa, Kluyveromyces marxianus
MARTFFIGGNFKMNGTKASIKEIVERLNSASIPSNVEVVIAPPAAYLDHAVSLNKKAQVSVAAQNAYLKASGAFTGENSVEQIKDVGAEWVILGHSERRTYFHETDEFIADKTKFALDSGVKVILCIGETLEEKQKGITLEVVQRQLQAVLDKVQDWTNVVVAYEPVWAIGTGLAATSDDAQAIHHSIREFLAKKLSKDTAEKIRILYGGSANGKNAVTFKDKADVDGFLVGGASLKPEFVDIINSRV

SEQ ID NO: 16738 - protein, 393 aa, Listeria monocytogenes str. 1/2a F6854
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQTCVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 16739 - protein, 110 aa, Brassica napus
MATATRRLLPALLRTLAPAGARGLSTEKAVGAAAVVGSHTAKWMQDTSKKSPMELINEVPPIKVDGRIAVCEGASEGVGLGHPIEYICLDLEAPNVCKYCGLRYVQVHHH

SEQ ID NO: 16740 - protein, 279 aa, Stictis radiata
SIEHGAVNVVAVNDPFIEAHYAAYMLKYDSTHGQFKGEIKVDGNDLIVNGQKVKFYQEKDPANIPWSETGAYYVVESTGVFTTTDKAKAHLKGGAKKVVISAPSADAPMFVMGVNEKSYKSDIEVISNASCTTNCLAPLAKVVHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKEAIKKASDGELKGIMAYTEDEIVSTDLIGDNNSSIFDAKAG

SEQ ID NO: 16741 - protein, 205 aa, Pseudomonas fluorescens
QQIVTLTYPHIGNTGTTPQDVESNRVWSAGLVVRDLPLVASNWRSTMSLSDYLKANNVVAIAGIDTRRLTRILREKGSQNGCIMVGENISEAAAIAAAQGFPGLKGMDLAKVVSTQEQYDWRSTVWDLKTDSHATIDAADLPYHVVAYDYGIKYNILRMLVERGCRVTVVPAQTPASDVLALQPDGVFLSNGPGDPEPCDYAIKA

SEQ ID NO: 16742 - protein, 269 aa, Stictis sp. 2-MW-2004
AVNDPFIEAEYAAYMLKYDSTHGQFKGEIKVDGNDLVVNGQKVKFYQKKDPADIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 16743 - protein, 479 aa, Rubrobacter xylanophilus DSM 9941
METGVKSLKNFIGGRFVEPASGELYDVVNPSTGEVFARAPMSGEEDVDRAFGAAAKAFEEWRESTPSERQRALLRIADRIEERAEELVRAECENTGKPYALTLEDEIPPMADQIRFFAGAARCLEGKSAGEYMRGMTSYIRREPVGVCAQVTPWNYPMMMAVWKFAPAVAAGNTVVLKPSDTTPVSTLLLAEIAAEFLPEGVFNVVCGDRDTGRLLVRHEVPQMVAITGSVRAGMEVAEAAAKDLKRVHLELGGKAPVIVFDDADPEAAAEAIAEAGYFNAGQDCTAATRVLAAPGVHDDFVAALTERARSTRTGPPDDEEAYYGPLNNENQLRRVSGIIERLPDHAEVVAGGGRVGERGYFYAPTVVSGLRQDDEASQTEIFGPVITVQPFSDEDEAVRWANGVRYGLASSVWTRDHGRAMRVSRRLDFGCVWINTHIPLVAEMPHGGFKHSGYGKDLSMYGLEDYTRIKHVMSNIEA

SEQ ID NO: 16744 - protein, 205 aa, Pseudomonas putida
QQIVTLTYPHIGNTGTTPEDAESDRVWSAGLVIRDLPLVASNWRNTMSLSDYLKANNVVAIAGIDTRRLTRILREKGAQNGCIMAGDNISEEAAIAAAQGFPGLKGMDLAKVVSTKETYEWRSTVWDLKTDSHATIDASELPYHVVAYDYGVKLNILRMLVARGCRVTVVPAQTPAADVLAMKPDGVFLSNGPGDPEPCDYAIQA

SEQ ID NO: 16745 - protein, 257 aa, Stictis sp. 2-MW-2004
  misc_feature (40)..(40): Xaa can be any naturally occurring amino acid
AYMLKYDSTHGQFKGEIKVDGNDLVVNGQKVKFYQKKDPXDIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 16746 - protein, 272 aa, Conotrema populorum
  misc_feature (243)..(243): Xaa can be any naturally occurring amino acid
  misc_feature (249)..(249): Xaa can be any naturally occurring amino acid
  misc_feature (265)..(265): Xaa can be any naturally occurring amino acid
SIEHGAVNVVAVNDPFIEAEYAAYMLKYDSTHGQFKGEIKVDGNDLVVNGQKVKFYQKKDPAEIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKXASEGEXKGILAYTEDDIVSSDXNGDNNSS

SEQ ID NO: 16747 - protein, 344 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAALILTNIFTGSEAEGSLKGILGYVEEDLVSTDFQGDSRSSIFDAKAGIALNGNFVKLVSWYDNEWGYSTRVVDLIRHMNSTN

SEQ ID NO: 16748 - protein, 552 aa, Aspergillus nidulans FGSC A4
MGVEETKKGLDVEATSAAPPPYVQDGHILSYEEEDFWTRNGLNFKSFQRRPAHVVELNRSMKTRHMHMIAIGGSIGLSLEYSSCWCADRSVYALGELAVMYPISGGFYTYSTRFIDPSWGFAMGWNYVFQWAIIVPLELTVAGLTIDYWQVDVSVAVWITVFLIAIIIVNIFGALGYAEEEFLSSCLKLGAIIVFMIIALVLVCGGGPSDGMYNEYWGARLWYDPGAFRNGFKGFCSVFVTAAFSFSGTELVGLAAAESKTPTKSLPGAIKQVFWRITLFYIVGLFFVGLLVRSDNERLLGSGLIDTKASPFVILAYDAGLKGYDHFMNVIILISVLSIGVSGVYGSSRTLTALAEQGYAPKFFAYVDRSGRPLWSVLITILFGVLGYVNVSSSGEEVFAWLQALSGLAALFTWGSICLAHIRFRRAWAYNGRSLDEIPFKAVGGIYGSYLGLFLIFIVLVAQFFVAVAPPGGGPDGGTYNDAKGFFKSYLALPVVLFFWICGYLWKRQGWLRTSQIDIDSGRREVDWDSINAERARVAAMPAWKRLLNIII

SEQ ID NO: 16749 - protein, 460 aa, Methylobacillus flagellatus KT
MNAQPEDNVNTDTISFASLNLAPELLKALDESGYTTPTPIQAQAIPVVLEGSDLMAGAQTGTGKTAAFTLPLLQKLLPLASSSASPARHPVRALILTPTRELAIQVEESVKTYAKHTPLRSLVVFGGVDIKSQTPTLMKGVEILVATPGRLLDHVEQRTVQLGQVQMLVLDEADRMLDMGFMPDLKRILALLPKQRQNLMFSATFSPEIKKLSEEFLTKPVLIEVARSNATSENVTQKILLVESEHKQHVLADLLRKEATQVIVFTKTKLSASRLARHLEREGIAAGAIHGDKSQLERIQALDAFKQGKITALVATDVAARGLDIDQLPMVVNYELPSAAEDYVHRIGRTGRAGASGIAISLVSSEEEKFLKEIEKLIKRELPKEQANAPQPVRRGQDTQRQKAPASIAPRQRHAGRNKEDEWFFKPYEPSTDAPAPKPMHSREKSKKEIPALLGGLNRK

SEQ ID NO: 16750 - protein, 157 aa, Candida albicans
LLSLDGTPNKSKLGANAILGVSLAAANAAAAAQGIPLYKHIANISNAKKGKFVLPVPFQNVLNGGSHAGGALAFQEFMIAPTGVSTFSEALRIGSEVYHNLKSLTKKKYGQSAGKLGDEGGVAPDIKTPKEALDLIMDAIDKAGYKGKVGIAMDVAL

SEQ ID NO: 16751 - protein, 450 aa, Agrobacterium tumefaciens str. C58
MTILPNSVEARDIAYQMHPNVNLRKFEKTGGLVIESGEGIYVTDSSGKRYIEAMAGLWSVALGFGEQRLVDAATKQMQKLPYYHTFSYKTHGPSVDLAELLIELSPVPMSKVHFTSSGSEANDLVAKMVWYRSNALGKKDKKKIIGRIKGYHGVTIASASITGLPRNHESFDLPLDRMLHTACPSYVHFGKDGESEAEFTARILGELEELILREGPETVAAFWGEPVMGAGGVLLPPEGYWEGVQAILKKYDILLVVDEVICGFGRTGKMFACETYDIKPDVLVVSKQISSSYMPLSAIIMNDSFYQPIADESDRIGSFGHGYTASGHPVATAVGLENLKIIQERDLVGNVARLEGKFLDHLKALADHPLIHSSRGIGLLGALEVKPWDGTKPGDTTLALAAAIESEGVITRPIGESICFCPPLIITAEQLDELFAGVKRGLDNALAARG

SEQ ID NO: 16752 - protein, 290 aa, Zea mays
  misc_feature (135)..(135): Xaa can be any naturally occurring amino acid
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRXALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 16753 - protein, 396 aa, Oryza sativa Indica Group
MPPPPSATAGRRSPFSALLLYVTFALVILLLLTSYSPSIPHRGRSLHRRLKLHPRNPSLSGAGAGAPTGGNGAPQQQQNHHHAAPFDPEIAELERRLEDKEWEREHYRILHGDGGGGEADEHMREWEEFLREDEDFINDDERFNLGDRIRALFPKFDLAPRDGFASLDELTRWNLEQSGADQLHRSAREMELYDKNGNGVVSYGDFRAQHNESSGEVNSLGFPWWKEEHFNASDADGDGFLNKTEFNDFLNPSDSENPQIINLLCKQEIRQRDKDGDGKLNFEEYFHGLHDHIHGYDDENADISHIGNNTVAKERFSKLDKDSDGFISEHELEPVLDKLHLSERYYARQQAAHAISEADKDHDGRLTLDEMIENPYAFYGSVFLSDDEDYFHDEFR

SEQ ID NO: 16754 - protein, 519 aa, Ipomoea purpurea
MATLTLIFCTLVFAIFLYFLILRVKQRYPLPLPPGPKPWPVLGNLPHLGEKPHQSIAAMAERHGPLMHLRMGFVDVVVAASAAVAAQFLKVHDANFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPILGWFDLQGIVGKMKKLHARFDAFLNSILEEHKFVNNQHTTLSKDVDFLTTLIRLKDNGADTDSEEGKLTDTEIKALLLNLFTAGTDTSSSTVEWAFAELLRNPKILNQAQQELDSVVGQNRLVTESDLTHLPFLQAIVKETFRLHPSTPLSLPRMGAQGCEINGYFIPKGATLLVNVWAIARDPNVWTNPLEFKPHRFLPGGEKPNVDIKGNDFEVIPFGAGRRICSGMSLGIRMVHLLVATLVHAFDWDLMNGQSVETLNMEEAYGLTLQRAVPLMLHPKPRLQPHLYTLN

SEQ ID NO: 16755 - protein, 213 aa, Populus euphratica
MGCCQSKGTKTTAWCKELTVLASGTPFTVSEVEALHELFKKLSSAVIGDGFISKEDLQFALFRNNNKKNLFVNRMFDLFDVKCNGVIEFGEFVQSLGVFHPNAPVEEKIYFAFRLYDLRQTGFIEQEELKEMVVALLQESDLELSDDVVQTVVDKTFSDADSKDDGKIDPEEWKEFVSKNPSIIKNMTLPYLKDVSMAFPSFALISELGESEM

SEQ ID NO: 16756 - protein, 330 aa, Glycine max
MVTEEEISEAVQSLLRESNPSRFTTLNQVVEELQAKLGHDLTHKIDFITAQINLLFGSRQPPQNPHRQLQQPKDHFAPPPNPNFHSAPVSVGFQLQNFSSSNAVVAAATAADASRIEAPSAPVVVEGNQVPKESTQTKVKRRGGPGGLTKICGVSPELQVIVGQPALSRTEIVKQLWAYIRKNNLQDPSNKRKIICNDELRVVFETDCTDMFKMNKLLSKHIIPLEPTKKPVPKKQKVDVESGTRSAEPTPSVIISDALANFFGITGREMLQSEVLRRIWEYIKVNQLEDPANPMAIVCDGKLQEIFGCESISALGIPEVLGRHHIFRSS

SEQ ID NO: 16757 - protein, 117 aa, Flammulina velutipes
HPFHLHGARIASTILRDEQLYKLWESEVKHMADRIIQMRDRLYDNLVGQNTPGEWSHIKKQIGMFSFTGLTQPQTKALAEKAHIYMTADGRISMAGLNGNNIDYFSESVSKAVKGDL

SEQ ID NO: 16758 - protein, 205 aa, Pseudomonas putida
QQIVTLTYPHIGNTGTTPEDAESDRVWSAGLVIRDLPLVASNWRNTMSLSDYLKANNVVAIAGIDTRRLTRILREKGAQNGCIMAGDNICEEAAIAAAQGFPGLKGMDLAKVVSTKEQYEWRSTVWDLKTDSHATIDASELPYHVVAYDYGVKLNILRMLVERGCRVTVVPAQTPAADVLAMKPDGVFLSNGPGDPEPCDYAIQA

SEQ ID NO: 16759 - protein, 222 aa, Zea mays
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKCGSK

SEQ ID NO: 16760 - protein, 312 aa, Zea mays
  misc_feature (286)..(286): Xaa can be any naturally occurring amino acid
MSHSPLPPPVFQNISLRFSESFSLQGTETTGAFTPPAFPSPPRTTGLLAIIRASMAKLVNKLVDSFDHDEAPAPDVGCVRAVLAELVLTFLFVFTGVSASMAAGSGGKPGEAMPMATLAAVAIAHALAAGVLVTAGFHVSGGHLNPAVTVGILVRGHITKLRALLYVAAQLLASSLACILLRYLSGGMVTPVHALGAGINPMQGLVMEVILTFSLLFVTYAMILDPRSQVRTIGPLLTGLIVGANSLAGGNFTGASMNPARSFGPAMATGVWTNHWVYWIGPLLGXGSLAGFVYESLFMVNKTHEPLLNGDI

SEQ ID NO: 16761 - protein, 248 aa, Mycoplasma mycoides subsp. mycoides SC str. PG1
MKKKVIFGNWKMNGTNESLTDFLNQVDNKIDSSKIIAGLAVPYVMLQTGLKLAKNVKIAAQNVHYKDKGAYTGEISTTMLKEVGVEYVIIGHSERREMFNETDLDVNKKAKVLLENNITPIICCGETLQTKESGKTIEFVNNQINIMFEGIKKEDAIKAIIAYEPIWAIGTGKTATSSDAEEVCKQIRNNLSKIYDKNTAEQIIIQYGGSVKPSNIQEYLKMPNIDGALVGGASLLASDYLGLVNYNE

SEQ ID NO: 16762 - protein, 531 aa, Mycoplasma mycoides subsp. mycoides SC str. PG1
MKVKRPVLLAILDGWGISEPDKGNAVDNANMVFVEYLKKTYPWLKAHASGKWVGLPENQMGNSEVGHIHLGAGRINLESLAKLNHETKTNNIAKNDEIVKTFEYVKKNNSALHLMGLFSNGGVHSHFDHMIAIYKAAIDYGITNIKFDLITDGRDTKPKLAYDFIKDLLELIKQNNNIGIISSISGRYYAMDRDKRFDRSRIAYNAIVNRNNVRSFTNILDYIQQEYMINHDDEMIIPAFNQDDLNGNLKANDAIIMTNFRPDRAIQISSILTNKNYIAWQNEAFSDAEFIGDKIRFVSMMKYSDSVTSPHIAYPPKPLTNTLGQYLSQLGLKQLRIAETEKIAHVTFFFDGGNDYFKNGLAKNDEITLANAYIDLIPSAKVATYDLKPQMSAVEITDKLLEEIKKDEFDFIVLNFANCDMVGHTGNNKATEIACKTLDEQLKRIHEEFVLRHNGIMVITADHGNAEIMIDKDGQVNKKHTTSLVPIIITDLNIKLKQNDPEIAKVAPTILDLMNIEIPKEMELESMIDHN

SEQ ID NO: 16763 - protein, 472 aa, Methylobacillus flagellatus KT
MLLPVIMSGGAGSRLWPVSRETLTKPFIELPDGRTLLQKTLQRTACLDGVSEVLTVTNKEYYFLTRDVYEATDTNVSHSYLLETIGRNTAPAIAVAALHAAAKHGEDVVLLVMPADHLIGNQKVFSKAVTVATDMAVNGWIVTFGVEPSTPETGYGYIEGGESIGDSGARRVVRFVEKPDLETAEKYIALGRFTWNAGIFCFTAKTIIAALAEYVPEVLEIAKKTLASSDSKTEPVVLGEEHFASSPDISIDYAVMERASKVAVVAADFDWSDIGSWSAMAELVQSDERGNRVNGEALLVDANNCYIQSDSRLVAGIGIDNLLVVDTPDALLVAHHSRAQDVKTVVKQLKLESHSAANYHRKVHRPWGTYTVLEEGANFKIKCIKVKPGASLSLQMHHHRSEHWVVVSGIAKVVNGERELLINANESTYIPAGHKHRLENPGLLDLVIIEVQSGEYLGEDDIVRFQDIYGRT

SEQ ID NO: 16764 - protein, 565 aa, Salmonella typhimurium LT2
METTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIAWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 16765 - protein, 385 aa, Glycine max
DAWGAAGAAAGVVVLLIVFVFVMLRRRRRHVGTGTSVEGSLMAFSYRDLQNATKNFSDKLGGGGFGSVFKGTLADSSIIAVKKLESISQGEKQFRTEVSTIGTVQHVNLVRLRGFCSEGTKKLLVYDYMPNGSLESKMFYEDSSKVLDWKVRYQIALGTARGLNYLHEKCRDCIIHCDVKPGNILLDADFVPKVADFGLAKLVGRDFSRVLTTMRGTRGYLAPEWISGVAITAKADVYSYGMMLFEFVSGRRNSEASEDGQVRFFPTIAANMMHQGGNVLSLLDPRLEENADIEEVTRVIKVASWCVQDDESHRPSMGQVVQILEGFLDLTLPPIPRTLQAFVDNHENIVFFDDSSSTQSSQVKSNASSASSQAKSNISSSKSST

SEQ ID NO: 16766 - protein, 441 aa, Prochlorococcus marinus str. NATL2A
MKQEEKLNLMNEKENSNQTIQNPHIWPPFTQLTSSKPQLLVEKAKGALLLPKNRAPIIDGISSWWVTLHGHANEYIAKAIATQAEQLEQIIFADFTHPQAELLANRLSKLTGLEKLFFSDNGSTAVEVALKMARQWWKNKGDNRSQIIAFEGAYHGDTFGAMAVGERNIFSEPFDQMLFPVSRVPWPETWWGDEDFERREKEVLETLDHLLKTPTIAVIIEPLVQGAGGMRMVRSEFLVEVEKRIRHANSLLITDEVLTGFGRCGELFAFQRAGLKPDLISLSKGLTGGFLPMGVTMSSKKISEGFLGEDPKQTFWHGHSFTANPLGCAAANASLDLLERSPQKYLDFESRHLPHLQKIVKDPRIECPRITGTIAAFNIKVKANKGYLNSVGKIMKASALSVGVFIRPLGDVVYLMPPLCITDQELEKCYFGIQEGLNALS

SEQ ID NO: 16767 - protein, 291 aa, Triticum aestivum
  misc_feature (5)..(5): Xaa can be any naturally occurring amino acid
PEAWXRYQRVEKPRNETPIRENEIRITALGRMRNYIGYGMSLLEENGHDEITIKAMGRAINKTVMVAELIKRRVAGLHQNTSIESVGITYTWEPLEEGLVPLETTRHVSMITLTLSKEPLDTSSPGYQPPIPAEEVKPAFDYEHEEWEEDGDYYYNGRGRGRGRLRGRGRARGYHGGGRRGGYGYDYGYGGRGGYYEERGGYFDGEADEYQPPPGRGRGRGRRMEQSEYYNGEPDEYRPPPGRGRGRGRWMEQNEYFDEPYEYPPPGRGRGMGRRGGPWRARGRGRGPMLD

SEQ ID NO: 16768 - protein, 121 aa, Fusarium culmorum
MVHHITSNDELQKLLSSTTYVVVDFFADWCPPCKAIAPVYEQLSTKHSVPDVLAFAKVNVDHVQDAAQQYGITAMPTFMFFKEGKQVAVNGQAVIKGADPRTLGAAAEKLGGLAQKRVAGA

SEQ ID NO: 16769 - protein, 588 aa, Oryza sativa Indica Group
MATTASKIIPQTLPEIPTTPEPQQYTKTAPDIPKSNNSRSSVPKLLQESDRGKLNHKLEPKEQKPNHHLKESVDVSSAKCPTEVSEEMVSEGIASQEKKVVEYESVNGSSTSFHTCEGSGPGKASGSARMTDRSETGERGSSSRCRPSTSSDISDESSCSSMSSTTKPHKSNDSRWEAIQTIRVRDGIIGLSHFRLLKKLGCGDIGSVYLSELSGAKSYFAMKVMDKASLASRKKLLRAQTEKEILQCLDHPFLPTLYTHFETDKFSCLVMEFCPGGDLHTLRQRQPGKYFPEQAVKFYVAEILLALEYLHMLGIIYRDLKPENVLVREDGHIMLSDFDLSLRCAVSPTLIKSSNPDAEALRKNSQGYCVQPACVEPSCVIQPSCAAPTTCFGPRFFSKSKKDRKPKPEIATQISPWPELIAEPSDARSMSFVGTHEYLAPEIIKGEGHGSAVDWWTFGIFLYELLFGKTPFKGSGNRATLFNVIGQPLRFPEYPIVSFSARDLIRGLLVKEPQHRLAYKRGATEIKQHPFFEGVNWALIRCASPPEVPKPVEIERPPKLPPSTSGTTDVSSGAPQKGSDGYLEFDFF

SEQ ID NO: 16770 - protein, 249 aa, Paracoccidioides brasiliensis
MPRKFFVGGNFKMNGTAKSITHIITNLNSAKLDPSTEIVIAPPAIYLVLARQLANGQVAVSAQNVFDKPNGAFTGELSVEQLRDEKITWTLAGHSERRVLLREDDEFVARKTKAAINGGLNVILCIGESLEEREAGKTIDVVTRQLDAVAEEVSPAEWNKVVIAYEPIWAIGTGKVATTEQAQEVHASIRKWLNEKISPEAAENTRVIYGGSVTESNCRDLAAQPDVDGFLVGGASLKPAFVDIINARL

SEQ ID NO: 16771 - protein, 147 aa, Oryza sativa Indica Group
MQRPMQSIPIPLLLFLFPPSLLSPRPGKKFCPQNNFLHGRSKKGQNFSAPPVEGSRDPCRNVDWDFFPLFSNRDETGQTDETGRTIPKFGAWDVNNPASADGFTVIFSKARDEKKGPVNVDASTRRSGFAVCRPAPPNLEEAKEYQI

SEQ ID NO: 16772 - protein, 578 aa, Oryza sativa Japonica Group
MPLATLLGHLAAGRFGLVQALTGAATAAAAHRLLHLLLRTAPPPPLPDLVSLARWSRAHFRAPLPLRLHGLLLARLASKGLYPLLRSELHVLAAARLHSPASILRALPSPSASASASTPLIADMLVLALARASQPLRAYDAFLLAGESHPRHRPSTSSVNALLAGLVGAKRVDLAEKAFRSALRRRVSPDIYTFNTVISGLCRIGQLRKAGDVAKDIKAWGLAPSVATYNSLIDGYCKKGGAGNMYHVDMLLKEMVEAGISPTAVTFGVLINGYCKNSNTAAAVRVFEEMKQQGIAASVVTYNSLISGLCSEGKVEEGVKLMEEMEDLGLSPNEITFGCVLKGFCKKGMMADANDWIDGMTERNVEPDVVIYNILIDVYRRLGKMEDAMAVKEAMAKKGISPNVTTYNCLITGFSRSGDWRSASGLLDEMKEKGIEADVVTYNVLIGALCCKGEVRKAVKLLDEMSEVGLEPNHLTYNTIIQGFCDKGNIKSAYEIRTRMEKCRKRANVVTYNVFIKYFCQIGKMDEANDLLNEMLDKCLVPNGITYETIKEGMMEKGYTPDIRGCTVSQASENPASS

SEQ ID NO: 16773 - protein, 342 aa, Gibberella zeae PH-1
MPSAAELRPSFFILFILFPLGESLKPLQVYLVPCIGSSGFDTTSRQLLAPIGAALPLTMVNFIEVVEAIMTPSLTTIIIGALIVLGAPIILHLLLASSRTYTVPPSVLLVGPANSGKTSLLTLFERGATGTETHTSQVSHDVELNASTDSEHKHSYRNHDVHDGTYTKFLLIDTPGHGKLRNVAEAKLNRTEKLKAVVFVVDAAAIGEPEVLAPTAAYLYDVLLFLQKRATNTKTKTSIPILIAANKMDLFTALPSTLVKTNLEAELTRIRASRSKGLLDSGVGSDDIGSEEQDSWLGEYGSSKFTFSQLQEFDIDVDVLPGNVTGDGPGADKWWWWIAQRI

SEQ ID NO: 16774 - protein, 517 aa, Gibberella zeae PH-1
MASQVPHVLPRAATVHSATELIGNTPLVRLNKIPQSLGIECDVYVKPELFSAGGSVKDRIALRMIEEAEKSGRIKPGDTLIEPTSGNTGIGLALVGAIKGYKTIITLPEKMSAEKVSVLRALGATIIRTPTQAAWDAPESHIGVARRLEKELPNAHILDQYSNKDNPNAHEFGTAQEIWEQTGGKITALVAGAGTGGTITGIARGLKKHNQDIKVIAADPHGSILALPELLNQEHINEGYKVEGIGYDFIPDVLDQHIVDKWYKTDDRESFHLARRLISEEGLLVGGSSGSAMAAMLLAVKEYGFKKGDVVVVVLPDSIRSYLSKFADDDWLAANNLLPVNGVESTVNGNGDKKNSDPYEGATIAALRLKPVTSVGATSTCSEAIETMRDKGFDQLPVLSASGTKLVGLVTLGNLLSYISSGRATGQSSVSDVMFDFARLDEIVTDPREFASPINPGKRRQFVEITKDTPLTTLSKFFEWNSAAVVTEKSGDSKSLSKPIAVVTKVDLLTWMINKKL

SEQ ID NO: 16775 - protein, 468 aa, Pinus sylvestris
MMLQKALRVLSSRGRPNGQGIGLMSRSISGNAVSSQELIEYESDYSAHNYHPIPMVFSKAKDVHVWDPEGRKYLDFLSAYSAVNQGHCHEKILNALSQQAQQLTLSSRAFHNDIFPIFAQHLTSMFGYEMILPMNTGAEGVETALKLARKWGYEKKHIPKNEAIIISCCGCFHGRTTAVISMSCDNEATRGFGPFLPGLLKVDFGDADSLKSMFEAHGDKVAGFLFEPIQGEAGVIVPPKGYLQSVRELCSKYNVLMIADEIQTGIGRTGKLLACEWESVRPDVVILGKALGGGVLPVSAVLADKDIMLCFKPGEHGSTFGGNPLASAVAIAALEIVEEEKLAERAAEMGQVFRSQFLDIQKAYPHIIKEVRGQGLLNAVELNAKGLSTVSAFDICQRLKERGVLAKPTHGTIIRFSPPLTIRLKELTEASKAFKDVLEHDLPNMQRQSEGNAPHSPPEPCDRCGRIK

SEQ ID NO: 16776 - protein, 293 aa, Nostoc punctiforme PCC 73102
MWTQIDTHISQVTGEKFQSQQRRSVGGGCINQGYAVSNGEITYFVKLNLASQVAMFEAEALGLKEMLATASIRIPQPICWGVAENSSYIVLEWLELGNGNSNTSLRDAPRWEEMGRKLAAMHQASSSQGFGWKINNTIGSTPQINTWTADWTEFYIKHRLGYQFQLARRRGGSFPQQEKLLAAIRELLTHQVQPSLVHGDLWGGNAGCTASGEPVIFDPATYFGDREVDIAMTELFGGFPAAFYKGYNEVFPLDAGYEQRKTLYNLYHILNHFNLFGGGYASQANRMIDQILR

SEQ ID NO: 16777 - protein, 199 aa, Zea mays
  misc_feature (29)..(29): Xaa can be any naturally occurring amino acid
  misc_feature (61)..(61): Xaa can be any naturally occurring amino acid
  misc_feature (92)..(92): Xaa can be any naturally occurring amino acid
LVVDVGANVGMASFVAAVMGFRVLAFDDXEPVFENLQRIFDGVYLNRVQHRIVVYHAAWLXASDRVGTITMHRVIGRLDNSAISADGAKLAXKSNAEIAVEVSTIPLDELVPDTERVLLIKVDVQGWEYHVLGGASNLLSRRKGGAPYPYLIYEEDEHLLQAGNSSAQDIRTFLTSVGYNHCKRHGNGAHGKRNRQICF

SEQ ID NO: 16778 - protein, 315 aa, Frankia sp. CcI3
MRFSSLADSVGRTPLVGLPRLSPSPDARLWAKLEQDNPTGSIKDRAALWMIADGEKRGLLTPGATVLEPTSGNTGISLAMACRQRGYRLICVMPENTSIERRQLLQMWGAEIRFSPAAGGSNEAVAVAKRLAAENPDWVMLYQYGNPANAQAHYETTGPEILEDLPEITHFVAGLGTTGTLMGTGRYLKERVPDISIVAAEPRYGELVYGLRNIDEGFVPELYDPSVLTSRYSVGPREALRRTRELVQEEGIFAGISTGAILHAALAQAERAVKEGKSADIVLIVCDGGWKYLSTGAYAGTLEEAEAALEGQLWA

SEQ ID NO: 16779 - protein, 158 aa, Vibrio angustum S14
MIEKGQTLPAAVLSELTHDGMVKHDTAELFANKRVVLFAVPGAFTPTCSEAHLPGYVVLADEIKATGVDIIACVSVNDAFVMQAWGEAQNASEIMMLGDGDGSFTKALGLEMDTENFGGIRSQRYAMVVDNGVVTQLNVEEPKQFEASKAETILASLK

SEQ ID NO: 16780 - protein, 153 aa, Brassica napus
MEEEKAAAYYDELTRKGEGAARFKQGLGFSAGNDAVPERSSAIASSSSFLNQFVKASSNPKLTEDDSDIRSIKDKLKKKNKPEDQHHSRVSEKSYRESSDRRRYRSRERDERDRRRSRSADRRRGYGDRERRRRRSRSRSSSPRMERRRSKKH

SEQ ID NO: 16781 - protein, 291 aa, Methylobacillus flagellatus KT
MAKKITKAVFPVAGLGTRFLPATKASPKEMLPIVDKPLIQYAAEEAVAAGATELIFIIGRNKRTIPDHFDKSFELEATLEASKKTKVLEEIRNILPKNVSCIYIRQAEALGLGHAVLLAKSVVGSEPFSVILADDLIDADKPAMQQMTELFDQEGVSILGVEDVEPSETASYGIVDATEVSGPNVLQLNGIVEKPQPEEAPSNLAVVGRYILTPEIFECLENVKPGKGGEIQLTDGIAALMEKQKILAYRFDGKRYDCGSKLGYVKANVEYSLKHEEFGKEFAQYLRDLTK

SEQ ID NO: 16782 - protein, 95 aa, Oryza sativa Japonica Group
MASGQQQQGRSELDRMAREGQTVVPGGTGGKSLEAQENLAEGRSRGGQTRKEQMGEEGYREMGRKGGLSTGDESGGERAAREGIDIDESKYKTKS

SEQ ID NO: 16783 - protein, 286 aa, Lactobacillus acidophilus NCFM
MVETFKLNDGNNIPAIGFGTFQIPDDGSTYKDVLNALKLGYRHIDTAVAYFNEDEVGKAIRDSGIPRDQIWVTSKLWLQDYAYEDAKKAINLSLKNLGLDYIDLYLIHQPYGKVDEAWKAMVEAKKAGKIRSIGISNVTPKIWHKWEDIFKENKPAVNQVEFNPYFQQKELRKIMAENQITLEAWAPLGQGNHNLFKEPVLNRLAKKYDKNVGQIMLRFEHQEGIIVFPKSVHEARIKSNKDIFDFELTSDEMDAIRALDKGKGMHDPDAPGVEEMLSKYDVHAND

SEQ ID NO: 16784 - protein, 65 aa, Brassica napus
MAAIYSLYIINKSGGLIFYKDCGTKGRMDTNDSLRVASLWHLGMLSWAKKPGPARTQTKPAQKIP

SEQ ID NO: 16785 - protein, 289 aa, Lactobacillus acidophilus NCFM
MTDIPKIKLNDGNEIPQLGFGVFQISNHDEAVKAVESAISNGYRLIDTAEAYNNQTAVGEAIKNSDVNRDDIFLTTKLWVSNFTYEKASKAIDEDLKELGTDYIDMMLLHQAYGDVAGAWRALEDAQKAGKTKSIGVSNFWPDQLMNLQLMSNVKPVVNQIEVNPWFQREPEVKWNQKDDVAVEAWAPFAEGKDGIFTNPVLTEIGKKYGKSNGQVILRWLIQRGIIVIPKSVHDARQKENIDIFDFELNNDDMQKIAALDKNVSQFFDHHDPTTIEQIFGSSLNQLRR

SEQ ID NO: 16786 - protein, 285 aa, Lactobacillus acidophilus NCFM
MNFNSLQDTYTLNNGVKIPIIGFGTWQTPDGEVAEESVLAALNCGYRHIDTASAYGNEDSVGRAIQKSGINRHELFITTKLWNSDHGYEKTKKAIDQSLLDLKLDYLDMYLIHWPNPSSMRDHWAEINAESWRAMEEAVRAGKIRAIGVSNFRKHHLDALMETAEIKPVVNQIFLNPSDLQSEVVTENKKLDLLSEAYSPLGTGGLLGNEVVKEVAANYGKSTAQVLIRWSLQHGFLPLPKSVHPEYIKANADVFDFEISPEDMAKLDNLHGVAGVANDPDKVDF

SEQ ID NO: 16787 - protein, 214 aa, Coprinopsis cinerea okayama7#130
MANRTKERLKKFANSGLRSPVSRVTKTVVMASRCSGALRLFSRSTTFSQRPRTLYALRYASTEAAPASTSTPPPPPTADPKISRIVDDISGLTLLQAADLVTQLKTRLNIQEIAMPAAAPAAAPAGGAAAASDEPAAEKPKEKTVFNVKLESFDAGSKPKIIREVKALVPNLTLIDAKKFVESLPKMLKENLSKEDAEKLKKAFEDLGAVVKLE

SEQ ID NO: 16788 - protein, 248 aa, Zygosaccharomyces bailii
MARTFFVGGNFKLNGTKSSIKEIVERLNNAKLDPKVEVVLCPPAPYLDYTVSLVKKSQVSVGAQNAYLKASGAFTGENSVDQIKDVGAKWVILGHSERRQYFREDDQLIAEKTAFALSQGVGVILCIGETLDQKKAGTTLQVVERQLQAVIDKVKDWSNVVIAYEPVWAIGTGLAATPEDAQEIHHSIREFLAKKLGEKTAQETRILYGGSANGKNAVTFKDKPDVDGFLVGGASLKPEFVDIINSRS

SEQ ID NO: 16789 - protein, 297 aa, Salmonella typhimurium LT2
MKPQIYHVDAFTGDPFRGNSAGVVLHADTLSDAQMQLIARELRHSETAFLLKSEESDVRIRYFTPTVEVPICGHATVAAHYVRATVLGLGNTTVWQTSLAGRHRVEIHAEHNDYRITLEQGQPSFEPPLVGEIRAAIITALNLTEDDIVPGAPIQVASTGHAKVMILLKPDVDIDALSPNLAALTAISQQIGCNGFFPFQIRPGKNETDGRMFSPAIGIVEDPVTGNANGPMGAWLVHHGLMAHDGKTLQIQGHQGRALGKEGTVDVTVTIRDNQPENVTISGQAVILFHAEWAITF

SEQ ID NO: 16790 - protein, 66 aa, Oryza sativa
MAAAAKTAVQPAVVVGGGRVGQALLSMGPPGADVLIRLGEKEPDDAPRPILVCTRNDDLYAVLGRR

SEQ ID NO: 16791 - protein, 447 aa, Methylobacillus flagellatus KT
MKYQSAHDFLAVVAQKNPGQPEFLQAVTEVVESLWPFISANPRYAEHGILDRLVEPERAILFRVSWVDDKGEVQVNRGYRIQHNGAIGPYKGGLRFHPSVNLSILKFLAFEQTFKNALTTLPMGGGKGGADFDPKGKSNGEVMRFCQAFISELFRHVGSDTDVPAGDIGVGAREIGFMTGMIKKLTNRADCVLTGKGLSYGGSLIRPEATGYGTVYFAEEMLRHSGRTIAGMRVAVSGSGNVAQYAIEKALALGAKVITASDSSGTVIDEAGFTAEKLQILMQVKNVEYGRIKDYAERVGALYVPGGSPWSVKAEVALPCATQNELTKADAATLIANGVLCVAEGANMPCTAEAMKLFDEHHILYAPGKATNAGGVATSGLEMTQNAMRLSWTREEVDARLFDIMKGIHDACVQYGTREDGSVNYVDGANIAGFVKVAEAMLAQGVV

SEQ ID NO: 16792 - protein, 251 aa, Aspergillus oryzae
MPRQFFVGGNFKMNGTAESITAIIKNLNEAKLDETTEVVVSPPALYLTLAQQVADEKKKVAVSSQNVFDKPNGAFTGEISVSQLQDAKIPWTIIGHSERRVILKETDEFIARKVKAAIDGGISVIFCIGETLEEREADKTIEVVTKQLNAAAKELTKEQWSKVVIAYEPVWAIGTGKVATTQQAQEVHAAIRKWLADAISPEASENTRIIYGGSVSEKNCRELAQERDVDGFLVGGASLKPAFVDIINARL

SEQ ID NO: 16793 - protein, 497 aa, Salmonella typhimurium LT2
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQKMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 16794 - protein, 236 aa, Prochlorococcus marinus str. NATL2A
MDLQNQMKKAVAQAAVDQIQNGMILGLGSGSTAALMIEALAIKIKSGEIKDVVGVTTSFQGEVLASELGIPLKSLSSVSEIDLAIDGADEVNPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDKPELLESQINNIPGVLENGLFVNLTDEVLVGKVESDVVGVESLKKI

SEQ ID NO: 16795 - protein, 377 aa, Oryza sativa Indica Group
MEPDTDKLQSLQINPNKETNLVAVFKNDYVDDEDDEDMDPQVTLGFIEEPEGPEDWHLLLPQHFPNKAGGVPAWLDPVNLPSGKSRCCDFCGEPLRFVLQVVFHLYDKLQVYAPIQCKETAYHRTLFVFMCPSMACLLLDQHEQGKDRAVFSPNSFWVYSVNLFWKELHWRAKHKNECHQIYGSHNASAIMPDAGKVFAGNIWPEYMVVNETEKVSCFASCENRSELLMEQGQSEEDDMTASLMDQFEVDDDNRCWASFLERISIEQDQVLRYCRESTAKPLWAVYSGSLTNAAMPSCIYCNGPLCYEFQVGQIMPQLLHYFHVENEPDSLDWATIIVYTCKGSCDQNVSYVEEFVWVQLSPATTRTNQSTCPPAGL

SEQ ID NO: 16796 - protein, 331 aa, Synechococcus sp. WH 7805
MTGPSIPRLLLLGTGGTIAGTAPESTQLNRYAAGVIGAEALLTTLPQLNRLAEIQVEQITNVDSADLGFNHWRDLVSRLRQILAEDPGLVGVVITHGTNTLEETAWLLQLLIDDPRPVVLVGAMRPASALSADGPLNLYQAVQVACSADSRGRGVMVVMDGQIHSARDVAKRATQGVGAFHSATRGPLGWVDDFGVHLSGVERSASVPFAGLSLPTIWPQVVILHGCVQPSEALIPALLSAGVEGLVFTGTGAGQLSAVERNALAQWQGPRPLMLRANRCGMGPVHRCEDHARLGLLPAGDLSPQKARVLLLLALINGDDRNTLASRLMVV

SEQ ID NO: 16797 - protein, 354 aa, Lentinula edodes
MGCAQSSGIDDEAKARNDEIENQLRRDRMMAKNEIKMLLLGAGESGKSTVLKQMKLIHHGGYNDSERDSYKEIIFSNTIQSMRAILDAMPSLDLFLNPSNDARRATILSLPVQLEVDVMPRDVGDSIRGLWSDPAVKEAVKRSREFQLNGSAVYYFNSIDRMSGPGYMPSDQDILRSRVKTTGITETTFQVGELTYKLFDVGGQRSERKKWIHCFENVTALVFLVSLSEYDQMLYEDESVNRMQEALTLFDSICNSRWFVKTSIILFLNKIDLFAEKLPRSPLGDYFPDYTGGNNYDAACEYLLRRFVSLNQSAATKQVYAHYTCATDTQQIKFVLSAIQDILLQLHLREAGLL

SEQ ID NO: 16798 - protein, 144 aa, Oryza sativa Indica Group
MELHWRAKHKNECHQISGSHNASAIMPDAGKVFAGNIWPEYMVVDETEKVSCFASCENRSELLMEQGQSEEDDMTASLMDQFEVDDDNRCWASFLERISREQDQVLRLKLSVPLGPFNVVWEILQGINCKTTLGSIFWVSNQCS

SEQ ID NO: 16799 - protein, 447 aa, Oryza sativa Japonica Group
MGQLKRRRFNLKPILYPKPLSKGFELKLPDSGPSAQYIETCLTRIEYFSFRNSVLIYQTNRELSVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 16800 - protein, 352 aa, Bacillus cereus G9241
MTIDRICTIGPASNNKETLAQLINNGMKIVRLNLSHGTHESHKDIIRLVKSLDDSIKILGDVQGPKIRLGEIKGEQITLQAGDSFILHTQPVTGSSTEASVDYEGIAHDVKVESRILMNDGEVELIVEKVSTDKIETKVKTGGNISSHKGVNLPGTIVSLPAITEKDKKDIQFLLEEGVDFIACSFVRKPRHIKEIRDFIKEHKETVPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPIESVKTLRLVSEFAEHVKKDGPFAMKDVLELLHKSLNE

SEQ ID NO: 16801 - protein, 288 aa, Triticum aestivum
  misc_feature (173)..(173): Xaa can be any naturally occurring amino acid
  misc_feature (180)..(180): Xaa can be any naturally occurring amino acid
  misc_feature (212)..(212): Xaa can be any naturally occurring amino acid
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELTQSIKAKGMRPGVSLKPGTPVEDVFPLVEAETPVELVLVMTVEPGFGGQKFMPEMMDKVRTLRKKYPSLXDIEVDGXLGPSTIDAAASAAHWWAGPTASSPGSSVFGAXNPGKVISALRKTLWGVADQELIICSSARSDGRVCFCCKLEPLCTTDARVSSFAIPNKMCPLLSRSLGLVEMLVTVT

SEQ ID NO: 16802 - protein, 620 aa, Candida albicans
MSEQAQPQASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYAGPEVDVWSAGVILYVMLCGRLPFDDEFIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHALVKDLKKSKSENIESFLSQSPPPSPFPNRGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 16803 - protein, 569 aa, Vitis vinifera
MDAGGELLALVNDVVGVSVGFGGVFKRDCTDLVRRIALLTHLFEEIRDFGAGLRPLDVSTSSASPLTCLSEVANALQAAKRLLSAAGNFSSDAFSDGAAKKITFQFQCVTWKLEKTLGNLPYDHFEISEEVREQVELVRAQLRRATERYGPLNSKVVSCALSLPLDREIHPRQSGNRAKMDSVPKLTHLHQLRPIYRMTLMQKKKPDSVVIPNDFLCPISLELMRDPVIVATGQTYERSYIQRWIDCGNLTCPKTQLELQNLTLTPNYALRSLITQCQWEDKKDGDIAAIEALVRKLSSWSIEERRAAATEIRSLSKRSTDNRILIAEAGAIPALVNLLTTDDVVTQENAVTSILNLSIYENNKGLIMLAGAIPSIVLVLRSGSMEARENAAATLFSLSVADENKIIIGASGAMPALVELLQNGSTRGKKDAATALFNLCIYQGNKSRAVKAGIITALSKMLTDLNNCMVDEALTILSVLSSHQEAKISIVKASIIPVLIDLLRTGLPRNKENAAAILLSLCKRDNENLACISRLGAVIPLAELAKSGTERAKRKATSLLEHLQRLQQL

SEQ ID NO: 16804 - protein, 188 aa, Triticum aestivum
MLAIASPPSNARAMAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDSTHVLSEVEEVNKEYPDAYVRVIGFDNMRQVQCVSFIAFRPPGCEESGKA

SEQ ID NO: 16805 - protein, 276 aa, Allium cepa [sequence omitted]

SEQ ID NO: 16806 - protein, 681 aa, Staphylococcus epidermidis RP62A
MTNNNRIKRFSIRKYAVGVVSIITGATIFIGGQQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 16807 - protein, 735 aa, Arabidopsis thaliana
MGGKSEPAKSESMATKPDLLNTSFFSFKSLKLKTKQQELLLRISILGLVYILAFIARLFSVLRYESMIHEFDPYFNYRTTLFLTEKGFYEFWNWFDSESWYPLGRIIGGTLYPGLMVTAALIYWTLRFLRFFVHIREVCVLTAPFFASNTTLVAYFFGKELWDTGAGLVAAVLIAICPGYISRSVAGSYDNEAVAIFALLLTFYLFVKAVNTGSLAWALASAFGYFYMVSAWGGYVFIINLVPLYVLVLLITGRYSMRLYIAYNCMYILGMLLAMQIRFVGFQHVQSGEHMGAMGVFLLMQVFYFLDWVKYQLNDTKLFQTFLRITVTSAILVGGVAVGVGTASGYISPWTGRFYSLLDPTYAKDHIPIIASVSEHQPTAWSSFMFDYHILLFLFPAGLYFCFKRLTDATIFIVMYGLTSLYFAGVMVRLILVATPAVCLISAIAVSATIKNLTSLLRTKQKVSQTGSTKGAGSSKASSKVTLDQSQPFQKNGAIALLVGVFYLLSRYAIHCTWVTAEAYSSPSIVLAARGAHGNRIIFDDYREAYYWLRQNTATDAKIMSWWDYGYQITAMGNRTVIVDNNTWNNTHIATVGRAMSSYEDDAYDIMRSLDVNYVLVVFGGVTGYSSDDINKFLWMVRIGGGVFPVIKEPDYLVNGEFRVDKGASPKMLNCLMYKLCYYRFGELTTEYGKPPGYDRARGVEIGNKDIKLEHLEEAYTTSNWIVRIYRVKPPTNRL

SEQ ID NO: 16808 - protein, 113 aa, Arabidopsis thaliana
IKGLKYPEDPDKKAYALRYIGSMVADIHRTLLYGGVFIYPADAKSPDGKLRLLYEAAPMAFLIHHAGGKSTTGKEDILDVMPTGIHQRVPVYMGSPEDVADFEAVHAKINNTV

SEQ ID NO: 16809 - protein, 208 aa, Brassica napus
MDKLKIAEWGEKLKTGGAQMSRMVSDKFKDILQAPTLESKMVDEATLDTLEEPNWGMNMRICAQINNNEFNATEIVRAIKRKISGKSPVAQRLSLELLEACAMNCDKIFSEVASERVLDEMVWWVKNGEADSENRSRAFQLVRAGGQSQDLAYLPVFKQTYLSWEGDNGLNSRNEENPMSGQSSLESLMQRPVPVPPPGSYPVPNQEH

SEQ ID NO: 16810 - protein, 483 aa, Pseudomonas syringae pv. tomato str. DC3000
MIPVILSGGSGSRLWPLSRKQFPKQFLALTGEHTLFQQTLQRLVFEGMQEPIVVCNKDHRFIVNEQLAALNLETQAILMEPFGRNTAPAVALTAMKLVNEGNDGLMLVLPADHVIEDQKALQRALALATVTAERGEMVLFGVPANKPETGYGYIKSTADALLPEGVSRVSQFVEKPDEKRAKEFVEAGGYYWNSGMFLFRASRFLEELKKHDPDIYDTCLLTLERSVQDGDALEIDASTFACCPDNSIDYAVMEKTQRACVVPLSAGWSDVGCWSSLWEVNAKDAHGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 16811 - protein, 288 aa, Lactobacillus acidophilus NCFM
MSIFDETLTMNNGLKIPKMALGVWEIPDTQTPKAVEEAVKIGYRHIDTAQAYGNERGVGEGVKNSSVAGDEIFINSKVAAEIKNYKEAKTSIDETLDKMELDYLDMMIIHNPQPWNKVNQSSDRHFEGNLETWRAMEDAVKEGKLRTIGVSSFEKEDLDNIIKNSSTKPAVNQILVHIGETPMDLINYSQENDIVVEAFSPIAHGAALNNPQVKQMADKYGVSVPQLCIRYDWQLNCVVLPKSANPEHMKSNAEIDFKISDEDMAELKKFTPVDYGKADIFPVFGGKM

SEQ ID NO: 16812 - protein, 593 aa, Aspergillus oryzae
MDGFDEEAFKKFFPGSFGKQERKTDVNTQIDRTKRTHVSAKTTADDDKAGLISDEQANVQTGAEDRKDKSESDSDNESDDSDSDDEDEDEFPVSHELVLKTHERAVTTLTVDPSGSRLITGSTDCTIKLHDFASMTPSTVRAFKSVDPTAKKQSALQEAHAVHYAAFNPLSPGYVMVVSATPQPRILDRDGETITEFMKGDMYLRDLHNTKGHISEVTSGAWCPTDENLCVTAGSDSTVRIWDANIGRSQKEVIMHKSRAAGSAGRSKMTAVAWGSPKQGGPNVLIAAALDGSLMMWSGNGPFTRPSGEIRDAHTRDTWTSGLDISSDGRLVVTKGGDDTIKLWDTRKFKQPISTVAHPSSSSRYPTSNIVFSPTSANVLTGSETGHLHILNPATLKPELVTPVTPGSPLITVQWHEKLNQILTGSANAETHVLYNPDMSSKGAALVMSKAPKRRHIDDDPNLTMDLSQGISGDNVVVGSNGVPHYSSATWSSRHPTIGLTASGRPRDPRRPHLPATTPFAKSQPDEKHIRENIPLSSMRDEDPREALLKYAEKAEKDPVFTKAWKETQPKTIYREISDDEGEQEPDKKRARR

SEQ ID NO: 16813 - protein, 507 aa, Oryza sativa Japonica Group
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 16814 - protein, 559 aa, Synechococcus sp. WH 7805
MPTTANSFEEFRQRVDYSLLEQLKADPQATTDGVDLRPRQVTSGHYVPVRPTPLPDPAYVAHSSVLFDELGLSEALVHDDAFQRMFSGDLSASTDPMHPWGWATGYALSIYGTEYIQQCPFGTGNGYGDGRAISVFEGVFKNQRWEMQLKGGGPTPYCRGADGRAVLRSSVREFLAQEFMHALGVPTSRSLSLYVSQSETVARPWYSENSRSFDPDIMVQNAAAICTRVAPSFLRVGQIELFARRARNDAHPEARQELQLIVQHLIERNYRPAIDPAEPFHKQVIALAHLFRERLTSLVAHWMRVGYCQGNFNSDNCAAGGYTLDYGPFGFCELFDPRFQPWTGGGTHFCFFNQPVAAETNFKMFWSSLRTLLDGDRQAQEELDALHDGFAAVMQQKMEAMWASKIGLPAYDDTLVTELLQLLATTGADYCKAFRLLSTLPRAVSELTPSFYQPCPDELAGRWQGWLGHWRSSLEAQGNLSETSAAMQQVNPAITWREWLVAPAYQRAELGDMSLIHELQQVFSNPYDDPSDAVLSTYGQLRPRELFNAGGISHYSCSS

SEQ ID NO: 16815 - protein, 560 aa, Triticum aestivum
  misc_feature (30)..(30): Xaa can be any naturally occurring amino acid
  misc_feature (261)..(261): Xaa can be any naturally occurring amino acid
MIEQVCTKKQAGTGPEFPGYRRPTRPWCIXRPSPRQTHSHTMGNRTSRHRRAAADQPATAPPPTAQPKPQPPPKPQTAPAPAPTPEAGQVAMGRVLGRPMEDVRATYTFGRELGRGQFGVTYLVTHKATGQRFACKSIATRKLVHRDDIEDVQREVQIMHHLTGHRNIVELRGAYEDRHSVNLIMELCEGGELFDRIIARGHYSERAAALLCREMVSVVHSCHSMGVFHRDLKPENFLFLNNKEDSPLKATDFGLSVFFKXRGTQFKDLVGSAYYVAPEVLKRHYGAEADIWSAGIILYILLSGVPPFWADNEDGIFEAVLLGHIDFSSDPWPSISNGAKDLVKKMLRQDPKERLTAAEILNHPWIREDGEAPDKPLDITVISRMKQFRAMNKLKKVALKIVAENLSEEEITGLKEMFRSLDTDNSGTITLEELRSGLPKLGTKISESEITQLMEAADVDGNGTIDYSEFVSATMHMNRLEKEDHILKAFEYFDKDHSGYITVDELEEALKKYDMGDDKTIKDIIAEVDTDHDGRINYQEFVAMMRNNSPEIVPNRRRMF

SEQ ID NO: 16816 - protein, 617 aa, Aspergillus oryzae
MVSASKAARLAKRADGDSKKKLGKGKKSGTESPQVDSDVPADDQPATTTEKMKEVEKLTAQMDKHGLSDRVTTGVLSSMESSRDVKVTSASLVFHGKVLITDSTLELNFGRRYGLLGENGCGKSTLLKAIAHREYPIPEHIDIYLLNEGAPPTELGALEWVVTEAQNQLDRMEKQAEDILEEQGPDSPILEDLYDRMDKMDPSTFHTRASLILTGLGFNKVTINKKTKDMSGGWRMRVALAKALFVKPSLLLLDDPTAHLDLEACVWLEEYLKKWERTLVLVSHSMDFLNGVCTNMIDMRMKQLLYYGGNYDSYHKTRSEQETNQMKAYNKQQEEIAHIKKFIASAGTYANLVRQAKSRQKILDKMEADGFIQPVIPDRIFSFRFAEVEKLPPPVLSFDDVSFSYSGSWEDTLYEHLDFGVDMDSRTALVGPNGVGKSTLLRIMTGKLQPIGGRVSRHTHLKLGMYSQHSAEQLDLTKSSLDFVRDKFPEKSQDYQYWRQQLGRYGLSGESQTALMGTLSEGQKSRIVFALLAIESPNMILLDEPTNGLDIPTIDSLADAINAYSGGVVVVSHDFRLLDKIAKDIMVCENKTVTRWDGTIGQYKDHLRKKMIDAGAV

SEQ ID NO: 16817 - protein, 376 aa, Solanum tuberosum
HIITAVIGSGVLSLAWATAQLGWVAGPTVLLLFFFVTYYTSALLSDCYRTGDPVTGKRNYTYMDAVRANLGGFQVKICGVIQYANLFGVAIGYTIAASISMVAVNRSNCFHKQGHRAACNVSSTPYMIIFGVMEIIFSQIPDFDQISWLSIVAAVMSFTYSTIGLGLGVAQVAETGKIEGSLTGISIGTEVTEMQKIWRSFQALGAIAFAYSYSLILIEIQDTLKSPPAEAKTMKRATLISVAVTTVFYMLCGCFGYAAFGDQSPGNLLTGFGFYNPYWLLDIANVAIVVHLVGAYQVYCQPLFAFVEKTATEWYPDSKIITKEIDVPIPGFKPFKLNLFRLVWRTIFVIITTVISMLMPFFNDVVGILGAFGFWP

SEQ ID NO: 16818 - protein, 100 aa, Glycine max
TRPDARWFSRASCTSDALQEALMTVASSIRHLVDAMEQSKCSFDASELLQAVMEIDGLEEGKQMYAFEYLNADPAKARAFLTYNARMRKTYLFRQFWWWR

SEQ ID NO: 16819 - protein, 422 aa, Candida glabrata CBS 138
MFVRLARIPRITRHYRLGLFSTQPKPKPNEYLYYRNKHKSKMEAPIKRSSSAVSLVELEREPFKVTVIGSGNWGTTIAKVVAENTKANPQVFQERVDMWVFDENIDGTMLTEIINTKHQNVKYLPNIDLPENLVANPDLLKSVEGADILVFNIPHQFLPKIVDQLRGHVEPHVRAISCLKGFEVGKKGVQLLSTYITEELGIECGALSGANLAPEVAKEHWSETTVAYHIPKDYQGDGMDVDHKVLKLLFHRPYFHVSVIDDVAGISIAGALKNVVALGCGFVEGLGWGNNAAAAIQRVGLGEIIKFGQMFFPESRVETYYQESAGVADLITTCSGGRNVRVATHMAKTGKSAEDSEKELLNGQSAQGVITCKEVHEWLSTCEMIEEFPLFEAVYKIVYEDVPMHKLPEMIEELDDIVVAGQ

SEQ ID NO: 16820 - protein, 335 aa, Geobacter sulfurreducens PCA
MSERIGVIGAGSWGTTLANLLARKGLDVTLWAYEAELVEEMRATRVNSLFLPGIELAPALSFTNSLEEAATGKDFLVLVSPSQVMRGVLAQLAPLLRPGVVLVNASKGIELDTLMTMDQVCAAVLPPEVARCFSVLSGPSFAREVSLEMPTAVVAASGDPAVAAAVQRLFTTPSFRVYTNTDVVGVEIGGALKNVIAVAAGISDGLGLGHNTRAALITRGLAEMTRLGLSMGAQPETFAGLAGMGDLVLTCTGDLSRNRTVGMKLGQGMKLADVLGEMRMVAEGVKTAESAYRLARRTGVEMPITEKVYQVLHEDKPARQAVMELMTRDLKAERW

SEQ ID NO: 16821 - protein, 361 aa, Wolbachia sp. wTai
MFIGNQSRNKVERAISEVRRGLPILIYDDKNNYLLFAAAETLEKNLFSQYKLISGNVYVTLTASKVKYICQSKEHSSKRLLVNNFDELLHLIDCSKEDHIKELQCSKTIDEYAIALLKFSELLPYALVADMTFENKHEMRNWCEENDIIALNTLLVNDFQRNHSVYEVCKTSLFLKQTQEVDIISYRTKSGGREHYAIIIGNPDKDNEPLVRIHSSCYTGDLLDSLSCDCRSQLHQAIQIMTDFGNGIILYLMQDGRGIGLTNKLRAYSMQRKYNLDTVDANRVLGFEDDERSFAVAAKILKKLNINKIQLLTNNGRKLSELKNNGIEVTKCVPLIMERNEYNDSYMETKFDKLGHGLRVY

SEQ ID NO: 16822 - protein, 324 aa, Oryza sativa Indica Group
MGVPPVDWEAESYPAYSDFAAIPLFAVFLFAVRYLLDRFVFEVVMVFTVLFPHHAHFRIVTGVWLARRLIFEKDEKLDLATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFRFGRVGSIVLAIHDASDVFLELGKISKYSGYQLLADVSFLIFVCSWAVLRLIYYPFWILWSTSYEVVPMLDKKKHKFDGPLYYYVFNCLLFSLLVLNIYWWVLMYRMLVEQILSKGHVGDDVRSDSEGEEEHED

SEQ ID NO: 16823 - protein, 392 aa, Oryza sativa Japonica Group
MADGASANPGDPPSPASARSGQRKHVPDWLNSPIWKVVDLAELRRLACQGVPDAAGVRPVVWKQLLLGYLPTDHALWAYELEKKRSQYSAFKDELLVNPSEVTRRMEEMTISKGNRHNSEGTGVLPRAEIVHDEHPLSLGKTSVWNQFFQESETIEQIDRDVKRTHPEMQFFNGDSSDALSNQESLKRILTIFAKLNPGIRYVQGMNEVLAPLYYVFKNDPEENNAESAEPDAFFCFVELLSGFRDNFCKQLDNSVVGIRSTISKLSQLLKRHDEELWRHLEVVTKCISAPTLMLCIFQVNPQFYAFRWITLLLTQEFKFRDCIHIWDALLGDPEGPQATLLRICCAMLILVRRRLLAGDFTANLKLLQSYPPTNIDHLLHIANKLRGPIPY

SEQ ID NO: 16824 - protein, 487 aa, Zea mays
MATAAAFSVSSPAASAVAARSKAELRAVPCRHSVPPAHSRLVSVDWGGLNVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPIMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 16825 - protein, 625 aa, Oryza sativa Indica Group
MEVALAVYSLVLLASFSFPCRLASALLSPKGVNYEVQALMMIKTSLKDPHGVLKNWDQDSVDPCSWTMVTCSPENLVTGLEAPSQNLSGLLSASIGNLTNLEIVLLQNNNINGPIPEEIGRLTKLKTLDLSSNHFSGGIPNSVGHLESLQYLRLNNNTLSGAYPSSSANLSQLVFLDLSYNNLSGPVPGSLARTFNIVGNPLICAAGTEHDCYGTLPMPMSYSLNNTQGTLMPSKSKSHKVAIAFGSTIGCISFLIPVMGLLFWWRHRRNQQILFDVDEQHTENVNLGNVKRFQFRELQVATENFSNKNILGKGGFGNVYRGKLPDGTVVAVKRLKDGNAAGGQAQFQTEVEMISLALHRNLLRLYGFCMTATERLLVYPYMSNGSVALRLKGKPPLDWITRQRIALGAARGLLYLHEQCDPKIIHRDVKAANILLDDYCEAIVGDFGLAKLLDHRDSHVTTAVRGTVGHIAPEYLSTGQSSEKTDVFGFGILLLELITGQTALEFGKSSNQKGAMLDWVKKMHQEKKLDVLVDKGLRSNYDRVELEEMVQVALLCTQYLPGHRPRMSEVVRMLEGDGLAERWEASQRADSHKFKVPEFTFGRCYSDLTDDSSLLVQAVELSGPR

SEQ ID NO: 16826 - protein, 151 aa, Triticum aestivum
MMGSNNPSGAGGGMAPGMGVGSSDGRHDDEAVLTEFLSSLMDYNPTIPDELVEHYLGRSGFHCPDLRLTRLVAVATQKFISDIASDSLQHCKARVAAPIKDNKSKQPKDRRLVLTMDDLSKALREHGVNLKHPEYFADSPSAGMGPSTREE

SEQ ID NO: 16827 - protein, 725 aa, Brassica napus
MASRTKGTTTIEVGADGVAVITLINPPVNSLSFDVLYSLKSNYEEALSRNDVKAIVVTGAKGKFSGGFDISGFGEIQKGTMKEPKVGYISIDILTDLLEAAKKPSVAAIDGLALGGGLELSMACHARISAPGAQLGLPELQLGVIPGFGGTQRLPRLVGLTKALEMILTSKPVKAEEGHSLGLIDAVVPPAELLNAARRWALDIAERRKPWVSSVLKTDKLPPLGEAREILKFAKDQTRRQAPNMKHPLMCLEAVEVGIVSGSRAGLEKEAQVGSEVINLDTTKGLIHVFFSQRGTTKVPGVTDRGLVPRKINKVAIIGGGLMGSGIATALILSNYSVILKEVNEKFLEAGIGRVKANLQSRVKKGKMSKEKFEKTMSLLKGSLDYESFRDVDMVIEAVIENISLKQQIFADLEKYCPQHCILASNTSTIDLNKIGERTKSQDRIIGAHFFSPAHVMPLLEIVRTNHTSAQVIVDLLDVGKKIRKTPVVVGNCTGFAVNRMFFPYTQAAMFLVEHGTDPYLIDKAVSKFGMPMGPFRLCDLVGFGVAIATATQFIENFPERTYKSMIIPLMQEDKRAGEATRKGFYLYDDRRKAKPDPEIKNYIDKARSVSGAKPDPKLEKLSEKEIIEMTFFPVVNEACRVFAEGIAVKAADLDIAGIFGMGFPPYRGGIMFWADSIGSKYIYSKLEEWSKAYGEFFKPCAFLAERGSKGAPLSAPLEQSRSRL

SEQ ID NO: 16828 - protein, 360 aa, Oryza sativa Indica Group
MGRFSNGVLGALSFAALLASVPLIGAGAYLLDHPASECQRLVRVPAVALGSAALLLSLMAIAGVTCCHGAALLWAYASAMFLLIVGMFFVTAFVFVVTNRGVATAVSGTGYGDYRVRDYSEWLRARIEDYETWHRIESCMADAAVCGGPLAGINPGEFYRLHLPLIQCELNTTVVSDYLCDVTTVQSGCCKPPVYCGYERVNETFWIAPARGLDAADVDCLEWSNDQAVLCFRCNACKASVLDTVRRNWRAVAVLNVAVLAILMLAYSLACCSVRDRSRSSCPAMATAPTTTPSVCDRRVLLKRQGISSEEANKMVAVAKEAVAIENSQVVNEQESVVTNQDVIEEQLLLPNLHLNYCHN

SEQ ID NO: 16829 - protein, 335 aa, Dehalococcoides sp. BAV1
MVTRIGINGFGRIGRITLRTINQYHRGELEVVAVNDLADNKSNAHLLKWDSTYGKYAGTVESDDCSIIVDGKPIRVFSERDPMQIPWETAGVDLVIESTGLFTDASKAAAHLRGSVKTVVISAPAKGEDITIVMGVNEDKYNCNTHRIISNASCTTNCVAPLIKVLHDKFGVKKGFMTTCHAYTNDQKIQDMFHKDIRRARAAAVNVIPTTTGAAKAVALVLPELKGKLDGISFRIPSASVSLVDFVGELARDVTVEEVNASFKEASQGKLSGILEYCEEELVSSDFKGNPASSIIDAPSTMVLGGNMVKVLSWYDNEWGYSTRLGDLIAYIAKK

SEQ ID NO: 16830 - protein, 428 aa, Dehalococcoides sp. BAV1
MSAVVKSIKAREILDSRGNPTVEADVVLSDGSFGRAAVPSGASTGSHEAVELRDGDKSRYNGLGVHKAVANVNTTIASAISGFKASDQQRLDNLLIELDGTPNKAKLGANAMLATSLAVAHAAAASRHMPLYRYLNNSEEYILPVPMFNILNGGKHASNSTDFQEFMVMPVGAKSFAQALQMGTEVYHSLKKVLKGMNQNTTVGDEGGFAPSLPTNKDAVEVILKAIEKAGYRPGEDIFIALDPASSELYQDGKYTLATENKTLSSAEMVDYWCGWVEKYPIISIEDGLFEDDWDGWKLLTRKIGNKVQLVGDDFYVTNIKRLDRGIKEKASNSILIKLNQIGTLSETIAAIKMANNAGWTAVVSHRSGETEDTTIADLAVAMNAGQIKTGAPCRSERTAKYNRLLRIEEELGGKAKYPGKDAFLNLK

SEQ ID NO: 16831 - protein, 246 aa, Coprinopsis cinerea okayama7#130
MAAFFSSLTVASVGLTCKSFLNLGFCSIQVNGLNILLDALNHPERRNDRGLVTVPGRPGGLLAPPISSSPTQRVFSSFFRLGQTLETFRGQGIYQESVNTAIQKLNEGSWVHLFGEGKVNQPDSYTIDPEGYAHIPRFKWGVGRIVMESSNLPVVIPMWLSGYDKLMPEGRPFPRKYLPRLGVRLSVTFGEPIPPELLSQAINHSAPDDKGAPSIDAQRSRLTALIHNHVESLGRTVCGPLLQMKQ

SEQ ID NO: 16832 - protein, 86 aa, Spinacia oleracea
HNSYLTGNQLTSDCSDVPIKHALQKSVRVIELDIWPNSSKDNVDVLHGGTMTSPVELIKCLKSIKEHAFSASEYPVVITLEDHQTP

SEQ ID NO: 16833 - protein, 490 aa, Coprinopsis cinerea okayama7#130
MPFPHLKRSTSSSSSVTLGNRETTATDNGRPVGYKLDSGGDWNDNRREVTSPIPLDGQVEETTNPSVGPEESATSLPKRKRTFLERWNREGKKKVGVRESLMAVVRSSLSFVAILPLAKMFEFGAEQMKFYLGKDFGDLLSVTLHNAVEATLAIILLLHCELALLKATIIGVVILHLLLVPGFAFIVGGTRVVNQDLHPHLTELNHSLLAVGVLSLMLPAAFFAALDDIEIDDPLRDSFLNLSRGVSFCLLFVYVCSRIYLHYPPGDDSDSSRRVPEVPQDFKKYEQKLDKEDPKVNPYICITMLLICIGLMAVTAEWLVKALEDVKKDINVELGWFGLILLPIVSYIPNGAIAIAYGVRKSIRVYLGLAAPIPPTTLAKGKAIDLSIQFTLFWTPFLVLLGWMVGTPMTLLFDLFEIAVLVGSCFIVNYVTADAKTNWAEGATMVSFYVIIVICSWYYPGSRESEIMSACDPISISLQKLADVASGLDP

SEQ ID NO: 16834 - protein, 438 aa, Pseudomonas syringae pv. tomato str. DC3000
MRISIFGLGYVGAVCAGCLSARGHDVVGVDISSTKIDLINNGKSPIVEPGLEELLQKGLATGKLRGTTDFAEAIRATDLSMICVGTPSKKNGDLELDYIESVCREIGYVLRDKNTRHTIVVRSTVLPGTVANVVIPILEDCSGKKAGVDFGVAVNPEFLRESTAIKDYDLPPMTVIGEFDKASGDVLQSLYEELDAPIIRKDIAVAEMIKYTCNVWHATKVTFANEIGNIAKAVGVDGREVMDVVCQDKALNLSQYYMRPGFAFGGSCLPKDVRALTYRAGSLDVDAPLLNSLMRSNTSQVQNAFDMVASYDTRKVALLGLSFKAGTDDLRESPLVELAEMLIGKGFDLSIFDSNVEYARVHGANKDYIESKIPHVSSLLNSDFDQVINDSDVIILGNRDERFRSLANKTPEGKRVIDLVGFMTNATTEDGRAEGICW

SEQ ID NO: 16835 - protein, 273 aa, Arabidopsis thaliana
MSMASIASSSSTTLLSSSRVLLPSKSSLLSPTVSVPRTLHSSSASSSSLCSGFSSLGSLTTSRSASRRNFAVKAQADDLPLVGNKAPDFEAEAVFDQEFIKVKLSEYIGKKYVILFFYPLDFTFVCPTEITAFSDRYEEFEKLNTEVLGVSVDSVFSHLAWVQTDRKSGGLGDLNYPLVSDITKSISKSFGVLIPDQGIALRGLFIIDKEGVIQHSTINNLGIGRSVDETMRTLQALQYVQENPDEVCPAGWKPGEKSMKPDPKLSKEYFSAI

SEQ ID NO: 16836 - protein, 506 aa, Vitis vinifera
MYRTAASRLRALKGRGGNWRAARFASSSAVTVRSSSSPSLFSWLTGEKSSSLSPLNLPLAGVSLPPPLPDYVEPSKTKITTLSNGVKIASETSPNPAASIGFYVDCGSIYETPLSFGATHLLERMAFKSTTNRSHLRVVREVEAIGGNVTASASREQMGYTFDALKTYVPEMVELLVDCVRNPVFLDWEVNEQLQKVKAELGELSNNPQGLLLEAIHSAGYSGALANPLLAPESAINRLNSTILEEFVAENYTAPRMVLAASGVEHEEFLSIAEPLVSYLPSVPRPEEPKSVYVGGDYRCQADSGITHLALAFEVPGGWHNEKEAITLTVLQMLMGGGGSFSAGGPGKGMHSRLYLRVLNEYQQLQSFSAFNNIFNNTGIFGIYASTGSDFVAKAVDIAAGELLSIASPGQVDQVQLTRAKEATKSAVLMNLESRMIASEDIGRQILTYGERKPLEHFLKAVDEITLKDITTIAQRIISSPLTMASYGDVIHVPSYESVNRKFHAK

SEQ ID NO: 16837 - protein, 481 aa, Candida glabrata CBS 138
MSNIVIFGGDSHPDLVKRICENLDIEPAKVTLGKFSNGETSVQLGSSVREKDVYVIQSGCGHVNDTFLQLLILISACKSSSASRVTAVMPYFCYSRQPDIPYTVKGAPIISNPKESNPTDSRPGTPGFKLMTQKPGSESPFKSLDTAIRSTIHMENPQPMRKPAPPTPQMSQSRIPVIPGGKAQPPSGSSNDAGEMFNAQNAGYKLWVVQAGTLIANLLTAAGADHVITMDLHDPQFPGFFDIPVDNLYCKPIVQGYIKHEIPDYKDAVIVSPDAGGAKRATAIADALELSFALIHKERRSQLLKGPPDASLSSGGGVPLSPKPLVANLNNASIAGPSSTEMRRSSSSASIHSNASQSSASKYIQTTMLVGDVRDKVCIIIDDLVDTSYTINRAAKLLKDQGAKKVYAIITHGIFSGDALTRIRSSKIDKLVISNSVPQDRTVSILGKDRVDVIDVSKVFGEAIRRIHNGESISMLFEHGW

SEQ ID NO: 16838 - protein, 424 aa, Oryza sativa Japonica Group
MAVIALKCPDVEVVVVDISAARIDAWNSDALPIYEPGLDDVVRRCRGRNLFFSSDVERHVGEADIVFVSVNTPTKARGLGAGKAADLTYWESAARMIAAVATSDKVVVEKSTVPVKTAEAIEKILDHNGRDGVGFQILSNPEFLARAPPSATCSPPTAISSVNAMSALCEATGADVAEVAYAVGKDSRIGAKFLNASVGFGGSCFQKDILNLVYICECNGLPEVANYWKQVIKGFKSPAIATTMSKDIYSLTPFQVIKINDYQKSRFVNRVVSSMFNTVAGKKIAVLGFAFKKDTGDTRETPAIDVCKGLIGDKAKVSIYDPQVTEDQVQRDLAMSKFDWDHPVSVAWDAYEAARAAHGVCILTEWDEFRSLDYARIYGGMQKPAFVFDGRNVVDAEKLREIGFIVYSIGKPLDAWLKDMPAVA

SEQ ID NO: 16839 - protein, 427 aa, Cytophaga hutchinsonii ATCC 33406
MSLIEEIVARQIFDSRGNPTIEVDVITENGLIGRAAVPSGASTGKHEAVELRDNDKSIYMGKSVLKAVANVNDIIAPELIGSHVFEQNLIDRLMIDLDGTANKGKLGANAILGVSLALAKAAAQEAGLPLYRYVGGVSANTLPVPMMNIINGGSHADNSIDFQEFMIMPTGAKSFTEAMRMGSEIFHNLAKVLKSKGMSTNVGDEGGFAPNIASNEDALITVIQAIEAAGYRPGEDVMIAFDAASSEFYDSETKLYHFKKSTGDKLTSSQMASYWADLVKRYPIVSIEDGMDEDDWSGWAELTKLVGDKVQLVGDDLFVTNVSRLQQGIDQGIANSILVKVNQIGSLTETISAVNLAKRNSYTSVMSHRSGETEDNTIADLAVALNCGQIKTGSCSRSDRMAKYNQLLRIEEELGEAAYFPGKNMRK

SEQ ID NO: 16840 - protein, 296 aa, Oryza sativa
  misc_feature (65)..(65): Xaa can be any naturally occurring amino acid
  misc_feature (82)..(82): Xaa can be any naturally occurring amino acid
MAASSPASSGKAASDSSAPAVAVANGNGTTPQKLPPASAFDMPKPNLRGLNKPKCIQCGNVARSXCCKSCCYKAQNPCHIHXVMGINKWRFEKLKEHIQGDIDAENEAYERYTQNVGLLEETFGLTEDAADEPEPEATSSEERMETLVSEAKVRLKSDSANADGFRDRIATILDQKIKELLESKSTYEDDNPPDQNPDDHPKPVKLSIKQQMERGAKMTELLAKMIRAQSEVDLKICSGIAAQLFGKKNELSNQESVASVTIPYSFPKLWTRVEIDDAMMCKINGEFSSSTERQKP

SEQ ID NO: 16841 - protein, 363 aa, Wolbachia sp. wKueYO
MGKNVIGNQSSNKVERAISEIRRGRPIVIYDESNYLLFAAAEALERDLFNQYKLTSSNVYVTLTSSKVKYISQNKEHNSKRLLVNNFDELLYLINCSKEDCIKELQCSKTIDECAIALLKFSELLPYALVADMTFENNHEMRNWCEKNDVIALDTSFINNFQENQDVYEVCKTSLFLKQTQEVNIISYRTESGGREHHAIIIGNPDKDDEPLVRIHSSCYTGDLLDSLSCDCRSQLHQAIQMIADSGSGIILYLMQDGRGIGLTNKLRAYSMQRGHNLDTVDANRILGFEDDERSFAVAAKMLKKLNINKIQLLTNNDRKLSELESSGIGVTKCLPLIVERNKYNDSYMETKFGKLGHRLRVF

SEQ ID NO: 16842 - protein, 365 aa, Cytophaga hutchinsonii ATCC 33406
MKLHEQKEAYLMLEDGTWYKGIAVGKIGTTSGEICFNTGMTGYQEIYTDPSYYGQIIVNTTSHIGNYGVKEDEQESAGVKFSGLVCRNFSEMFSRKDGDGSLQAYFEKNNIVGISDVDTRELVRYIRSKGTMNAVISSEILDVEKLKEEVKKVPSMKGLELSSRVSTKESYFLGNPDAKYKVAVLDLGVKTNILKNLTDRDCYLKVFPAKTTYAEMKQWSPNGYFISNGPGDPAVTSYAIDTVKNILSENRPMFGICLGHQILAEANGIPTYKMPNGHRGLNHPVKNLISGLSEVTSQNHGFAVDANAVPKDSNVEITHINLNDNTVEGIRLKDKNAFSVQYHPESSPGPHDSRYLFDQFVSNLN

SEQ ID NO: 16843 - protein, 583 aa, Oryza sativa Indica Group
MAARRAASSLLSRGLIARPSAASSTGDSAILGAGSARGFLPGALHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFRFATLEFPRIPSDRDRLSTGIYTNTLRAMCSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 16844 - protein, 209 aa, Methanosarcina mazei Go1
MAFDQDWVPKTRLGKLVVEGQVASMDEAIKSGLPIREPQIIDMLLPDLEDEVLDINMVQRMTDSGRRVKFRATVIVGNRNGYVGLGQAKDVQVGPAIRKAIDAAKLNITYIRRGCGSWECACGLPHTVPYEVTGKAGSVSVTLIPAPRGLGIAAGNTATKVLEKAGIKDVWTKTFGTTRSTLNFAKATYDALNQVNVVRLPVYYGKEEI

SEQ ID NO: 16845 - protein, 480 aa, Oryza sativa Indica Group
MWWVLISLVWSRMADLWKLCGETVAIPLLQTYPVTVLCWWLLCPWGILVDSYIIFFSEEGGFCGVESCAQASLPDSFLADLDELSDNEAYPEGEDEEARNMEEDGDGGMPCCEFLNHDDLNSASELHKTQRYNDIMQWWVLISLVWSRMADLWKLCGETVAIPLLQTYPVTVLCWWLLCPWGILVDSYIIFFSEEGGFCGVESCAQASLPDSFLADLDELSDNEAYPEGEDEEARNMEEDGDGGMPCCEFLNHDDLNSASELHKTPRYNDIMQLLGAKKKNLSGFSTAASQFRVGYLEQTEVFQSTIPSLRTHACRIISAKSTLAARIDSIRGDPTGKAGHSLLEEICKKTEKLQELPPAKILKPLPVPDCDGLGKGYGLLGPTGSGKLRLLAAQSRLAAKFAKRFKARSCDRSESRSGLTSTLAFTPVQGMELSNPLVHNDHSVSGTQSTYFSDVGTFSSIRGKDAIPIQSSEIQNPGV

SEQ ID NO: 16846 - protein, 178 aa, Aegiceras corniculatum
SGGHINPAVTFGLLLARKLSLTRAVFYMIMQCLGAICGAGVVKGFEGSSRFTIAGGGANVVQPGYTKGDGLGAEIVGTFVLVYTVFSATDAKRNARDSHVPILAPLPIGFAVFLVHLATIPITGTGINPARSLGAAIIYNKDQAWDEHWIFWVGPFIGAALAALYHQVVIRAIPFKSK

SEQ ID NO: 16847 - protein, 423 aa, Vibrio parahaemolyticus RIMD 2210633
MTNQQLHQRRSQVIAQGMGALYPLYVEKAENAYVWDIEGNKYIDFAAGIAVTNTGHSHKRISEAVKAQLDNFSHTCAMVTPYASFVELAEKLTELAPGETKKKAIFLTTGAEAVENAVKVARAHTGRSGVIAFKGGFHGRTNMTMGLTGKVAPYKAGFGPFPNEIYHAPYPNAFHGISVEQSLQAIDDLFACDIEPSRVAAIIFEPVQGEGGFYKAPDAFAQGLRQLCDKHGIMLIADEIQTGFARTGKMFATEYLGIEPDLMTMAKGIAGGFPISAVVGKADVMDSALPGGLGGTYAGSPLGCVAGLEVLKIIEEEDLCAKAMGIGEVVNARMTKLQQSVPAIGEIRTTGAMMAIEFTDPESGKPLQEMTKAVISKAQENGLILLSCGVKANVIRLLPPLTIEPEVLSEGLDKLEKVILEVA

SEQ ID NO: 16848 - protein, 481 aa, Vibrio parahaemolyticus RIMD 2210633
MSKGMTMQQIQNQSLVSFMVANPQQGIAVTNPATGELLGYAPVSTENDILNSIERAHVAQKEWSALPAKTRAGMLNRWFQLLLENKADLGRLMTLEQGKPLAEAQGEVLYGASFIEWFAEEAKRTYGETIPAPSADKRLVTIKQPIGVACAITPWNFPIAMITRKAAPALAAGCSFVVKPSESTPLSAFAVAELAYQAGIPRDVLQVVLGENSRQVGAIFTSHPLIRKLSFTGSTQVGRVLMQQSAADIKRTSMELGGNAPFIVFDDADIDAAVAGAMASKFRNAGQTCVCANRFYVHSKVYDEFVAKFDAAVQQLKVGNGLEEGVNIGPVISESAKQGIQALIDGAIEQGAKPVSALKELDGLFMQPVVLKGVTHDMKIVSEEIFGPVAPVIRFDSDEQLIEMANDTIYGLASYFYSQNIHRVWKIAEALEYGMVGINEGMISTEVAPFGGVKQSGIGREGAKQGIDEYMDVKYLCFGGN

SEQ ID NO: 16849 - protein, 360 aa, Vibrio parahaemolyticus RIMD 2210633
MKLSTTPAQDGFYFPAEFQPVSEVWLAWPERKDNWRDDALPAQETFARIANLIAEVTKVCVAVCSHNFDRARQMLHSDVRLVEIPFNDAWMRDIGPTVLVNQAGERRGISWQFNAWGGEYNGLYDNWQQDDLVAGSVCDIIGIDYYRAPFVLEGGAIHTDGEGTLYTTEECLLSPGRNPQLSKAQIEEQLKVYLGIEKIIWLPNGLFNDETDGHVDNLMHVIAPGKVVLSWTDDPSDPQYALSRQAEQVLKSQHDAKGREIEIVRLPLPGPLHYSEREANGIDASSGMSRQAGERLSASYANFLIVNGHVFLPMLDEDTDAIAIDILQNAMPEYQIIAIPSREVLLGGGNIHCITQQIPA

SEQ ID NO: 16850 - protein, 193 aa, Aegiceras corniculatum
VLVYCTAGISGGHINPAVTLGLFLAQKVSLVRAMLYMMAQCLGAICGCGLVKAFQKSYYTKYGGGANYLHDGYNKGTGLGAEIIGTFVLVYTVFSATDPKRSARDSHVPVLAPLPIGFAVFMVHLATIPITGTGINPARSLGAAVIYNKKKTWDDQWIFWGGPFIGAPIAAFYHQFILRAGAIKALGSYRSNA

SEQ ID NO: 16851 - protein, 337 aa, Bradyrhizobium japonicum USDA 110
MNSLDLMMASVACIGECMVELRQAQGGHSAGQSAGQSAGQGGGLYSRGFGGDTLNTAVYLARLEVKVDYFTALGDDALSDEMIAAWNAESIGTRRVVRLPGKLPGLYMIQTDAKGERQFFHWRDSAAARQLMSLPETDELLNSLMSYDIVYLSAITLSIYDAPGRERLLAAIKRARLLGTRFVFDTNFRARGWPDRDVAREAFAAAFATADIVLTSTEDLLALYPGESRDQLMARIPSPELVFRLAEPVSLLRFPGGTSEVRAEPMTKPVVDTTAAGDSFAAAYIAARLAGSEPVEAAQAGHRLASLVICYPGAIIPGYAMPPKKRHRPAATRQATK

SEQ ID NO: 16852 - protein, 516 aa, Vitis vinifera
MLDKEFFTEYGEATQYEIQEVVGKGSYGVVASAVNTHTGERVAIKKINDVFENVSDATRILREIKLLRLLRHPDIVQIKHIMLPPSRREFKDIYVVFELMESDLHQVIKANDDLTPEHYQFFLYQLLRALKYIHTANVFHRDLKPKNILANADCKLKICDFGLARVSFNDTPSTIFWTDYVATRWYRAPELCGCFFSKYTPAIDIWSIGCIFAEMLTGKPLFPGKNVVQQLDLMTDLLGTPSYESIARIRNEKAKRYLNNMRKKSPIPFSQKFPNADPLAVRLLERLLAFDPKNRPSAEEIRFTDPYFHGLANADYEPCTQPISKFLFEFERRRMTKEDVRELIYREILEYHPQMLQEYLQGTDLTSFMYPSGVDRFKQQFAHLEEHHGKGERTAPRLRQHASLPRERVCAPIDDPVSQTNDFEKRTAASVGRTTLQSPPRFQAINVSESANKKVTTMQNGANKPNYSACSLMKSPSISASKCMEVKERDCEDEAIPEQNAEAAERLSQKVAALYA

SEQ ID NO: 16853 - protein, 758 aa, Dehalococcoides sp. CBDB1
MQKGHEAIVWFNEVTKNDIPLVGGKGANLGEMTNAGIPVPPGYIVTANAYFDFINSSNLHPAISKALESLDINDSKQLSVVANIVKEMILSTPMPPGLATQIKTAYKKMGQGLVAVRSSATAEDLPEASFAGQQSTYLNIEGGDEVVVAVQKCWASLFEARAIYYRVQQNFDHLQVGIAVPVQKMVQSQASGVCFTIEPITSDPTKIVIEAIYGLGEGLVSGEITPDLYILDKEGPAVLSRTISHQERRLVRKNGNSTSGAEDESGNNYWQPVPSTKQEQQKITEDDIITLAKLAMLIENHYKGPQDIEWAKEENEIYIVQSRPVTALKDASELEPEIDAPIMLQGAAASPGLATGGVKILQDPSEIDLVLPGDILVAEMTTPDFVPAMKRAAAIVTNRGGRTSHAAIVSRELGIPCVVGTGEATKVLKNDQMITVDGTHGKVYNGKVTRNVKTSNIASIVREAIRTKTRVYVNLAQPELADKVAARNVDGVGLLRAEFIFSQIGKHPRYMIEMGQQEEYIQQVYAGVLSFAKAFYPRPVVYRTNDFKTNEYRDLLGGDKYEGQEENPMLGYRGVSRYIKDIEVFKMEIEAIKRVRKDYPNVYVMLPFVRTVDELVKVKRILEDEGLKRGPDFKLWMMVEVPSNIFLIDKFIDAGIDGISIGSNDLTQLILGVDRDSEMLRETFDERNEAVLVALEKAVTTAARRGITASICGQAPSVYPELTEKLVSWGITSVSVSPDMIGTTREIIAKAEAKLKIK

SEQ ID NO: 16854 - protein, 202 aa, Colwellia psychrerythraea 34H
MSVNFVDSCRLPTHLGEFEMYGFVEESGQEHIMLTYGEITPDKPLLIRLHSECLTGDSLFSMRCDCGYQLETALENIVDAGQGALLYLRQEGRGIGLINKIKAYHLQDDGADTVEANEQLGFAADLRRYTMCKPMLEHFRVNKVKLLTNNPKKVQALKDLGIEVVEQMPIQVGRNQYNHEYLNTKAERMGHMMTHGLLSDLG

SEQ ID NO: 16855 - protein, 180 aa, Triticum aestivum
RVGVAAPHRRRRGFPPLTSAGARRTRRVSSVVLFPAGDPHPRSASDLCNNCKRPGHFARDCPNVSVCHACGLPGHIAAECSSKDLCWNCKEPGHMANACPNEGICRNCGKSGHIAKDCTAPPMLPGEVKLCNNCYKPGHMAVECTNEKACNNCRKSGHLARNCTNEPVCNLCHGAGHWAR

SEQ ID NO: 16856 - protein, 264 aa, Solanum tuberosum
MAELREKWCLKGTTALVTGGSKGIGYAIVEELANFGARVYTCSRNENELQECLDIWRKKGLKVEGSVCDLLSRTEREKLMKTIEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPQIETAIKKNPQQKEEIDSIVVKTPLGRAGKPEEVSAVIAFLCFPAASYITGQIIWADGGFTANGAF

SEQ ID NO: 16857 - protein, 363 aa, Listeria innocua Clip11262
MTKRILMLEDGNYFIGDAIGSEKETIGEVVFNTGMTGYQETITDPSYYGQIITFTYPLVGNYGVNRDDFESINPAVKGVVVREAAEYPSNWRNQITLNEFLKEKGIPGIAGIDTRKLTKLIRKEGTLKGILSAATADKEELLHHLRSVRLPVDQVHEVSSAKAFASPGDGKRVVLVDYGVKSSILRELNKRNCYVTVVPYNTTAEEILAMHPDGVMLSNGPGDPKDVPEALEMIRGIQGKLPLFGICLGHQLFALANGADTFKLKFGHRGANHPVKELATGRVDFTAQNHGYAVEKESLIGTDLKVTHIELNDETVEGLAHKEYQAYTVQYHPEANPGPSDVNYLFDEFMEMMNVKEEGELHA

SEQ ID NO: 16858 - protein, 103 aa, Glycine max
  misc_feature (68)..(68): Xaa can be any naturally occurring amino acid
  misc_feature (81)..(81): Xaa can be any naturally occurring amino acid
MASSMISWPGVTTVKRADAGMVASFTGLKSMAGFPTSNTNNDITFIAINGGRRRCTQASPPIGNKKFXTLSYLTDLDNAQXAKEVLFLLTKGLIPCFKFELEH

SEQ ID NO: 16859 - protein, 234 aa, Oryza sativa
  misc_feature (136)..(136): Xaa can be any naturally occurring amino acid
MAGGGDELKLLGMWASPFALRAKLALSFKGLSYEYVEEDLKNKSELLLTSNPVHKKVPVLIHNGKPVCESQVIVQYIDEAFPDAGVPLLPSDPYDRAVARFWAAYIDDKLLKSWLQASMCKTEQEKAAAMKETFAXAVANLEAAFKECSKGKPFFGGDAVGYVDVTLGAVIGFVRVGEAVHGMRLFDASRSPLLDAWLDRFAALDAAKAVLPDTGRLAEYAKMKQAEWAAAATN

SEQ ID NO: 16860 - protein, 541 aa, Coprinopsis cinerea okayama7#130
MDGLVADLESKLAQVRLGGGPKAAERMRSKGKLLPRERLGLLLDPASPFIELSPLAAHEVYPESIPGAGIITGIGRISGRECMIVVNDATVKGGSYYPLTVKKHLRAQEIARENGLPCVYVVESGGAALPHQANVFPDKEHFGRIFYNMAQMSALRIPQIAIVHGISVAGGAYVPAMADENIIVQNQGRIFLAGPPLVKAATGEVVDEETLGGGLMHSSESGVTDHLARDDEHAIAIARGIVGDLGSAGRRGVAPTAVPEDPLYSASELHGIVGTDVRQPFDMRDVIARIVDGSRFREFKKEYGTTMVTGFAHIHGYEVGIVANNGILFSPSALKATHFIELCSQRQIPLLFLVNVTGYMVGSKAEKGGIAKDGAKMVRAVACADVPKLTVIVGGSFGAGNYGMAGRAYSPRFLWMWPNSKVSVMGSGQLSDVMATVSKDPKQHQSLKQEIEHQSTALYSTARLWDDGIIKPTDTRDVVGLALGLIVSELLQNSLDAGAKSIEIGLNAQEWFCWVKDDGCGINREGLAAIAQEGDAGRYCE

SEQ ID NO: 16861 - protein, 130 aa, Brassica napus
  misc_feature (9)..(9): Xaa can be any naturally occurring amino acid
MEQTFIMIXPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALW

SEQ ID NO: 16862 - protein, 407 aa, Oryza sativa Japonica Group
MGKQMAALCGFLLVALLWLTPDVAHAQTQILFQGFNWDSWKKQGGYMPGRLYDLNASKYGTKAELKSLIAAFHAKGIKCVADIVVNHRCADDKDGRGVYCIFKGGGPRGCLDWGPSMICCDDTQYSDGTGHRDTGADFAAAPDIDHLNPLVQRELSDWLRWLRRDVGFDGWRLDFAKGYSAAVARTYVQNARPSFVVAEIWNSLSYDGDGKPAANQDGQRQELVNWVKQVGGPATAFDFTTKGILQSAVQGELWRMRDKDGKAPGMIGWYPEKAVTFVDNHDTGSTQRMWPFPSDKVILGYAYILTHPGVPCIFYDHVFDWNLKQEINALAATRKRNGINAGSKLRVLAAESDMYVAMVDERVITKIGPRIDVGNIIPSDFHIVAHGNDYCVWEKSGLRVPEPEGRR

SEQ ID NO: 16863 - protein, 179 aa, Geobacter sulfurreducens PCA
MIRPFKGMSPQIDPSAFIADTAVVIGDVTIGPESSIWYNVVARGDVNFIRIGARSNIQDLSMLHVTHKKHADDPGAPLVIGDDVTVGHSVTLHGCTIGNGAFIGMQAMVMDKAVVGEGALVGARALVTEGTVIPPHTLWVGAPAKYKRDLTPDEIAWLKRSAGNYVRYSREYLEEDADR

SEQ ID NO: 16864 - protein, 256 aa, Clostridium thermocellum ATCC 27405
MISIKTKKEIELMKKAGEIVALALKKVEEAIKPGVSTMELDRIAEETIRKCGAIPSFKGYKAAFKNVPDFPGSICASVNDEVVHGIPGLRVLKDGDIISVDIGAYIDGFHGDAARTFAVGKISGEAQRLIDVTRESFFKGLEKAVKGNRIIDISGAIEDYVVANGFSVVRDFVGHGIGKEMHEEPQVPNYRCSGQRTRLEAGMTLAIEPMVNQGTHMVKILRNGWTVVTADGKLSAHYENTIAITEDEPIILTMLA

SEQ ID NO: 16865 - protein, 259 aa, Cytophaga hutchinsonii ATCC 33406
MAVIHYKSNEELEIIRESGKILGKAHAEIAKIIRPGVKTNELDKIAYQFIADNGGIPSFKGLYGFPSTLCISVNEVVVHGFPSEYELKDGDIISVDCGVKYNGYHSDSAYTYPVGNVKEEVLKLLRVTKESLYKGVEQAIVGNRIGDIGFSIQSFVEKEGYSVVRELVGHGLGKSLHEKPEVPNYGNRGKGLKLEENLVIAIEPMINLGKKNVVQENDGWTIRTSDKMPSAHFEHTVAVKKGKPEILTTFEFIEQIINI

SEQ ID NO: 16866 - protein, 181 aa, Methanosarcina mazei Go1
MHLPNPHKQHPKVSKRAWISETAVIIGNVSIADNVFVGPNAVLRADEPGSSITVQSGSNVQDNVVVHSLSHSEVHIGKNTSLAHGCIVHGPCRIEENCFIGFGAVVFDCNIGKDTLVLHRSVVRGVNISSGKVVPDGSVVTGQGCADTLEGTTKDLNEFKRSVVRANVDLVEGYIRLGEES

SEQ ID NO: 16867 - protein, 170 aa, Zea mays
MADREHRTVFVTVGTTCFDALVMAVDSPEVKKALLQKGYSNLLIQMGRGTYVPLKVSGDATLQVDHFTFSPSIADNMRTASLVISHAGSIFETLRLGKPLIVVVNEDLMDNHQSELAEELAERKHLFCARPQTLGETIRAMDLETLVPYEPGDAKPVVTLINRFLGFPVD

SEQ ID NO: 16868 - protein, 462 aa, Vibrio parahaemolyticus RIMD 2210633
MVISNFYSSGYLEKKMESYLQEVQNFKQKWPDIEFIDLIFTDINATPRGKRIPIDALEKLDKGVALPLSTITLDTKGNVVETAGLGEDLGEPDHLCYPISGTLMPTAKEQVGQLLLSMMDETGQHPNPLFIRNILASMLQTLHAKDQYPCVALELEFYLIDKTRGENGEPLTAINPTKKTREKDTEVYDLDGLDDYADFLTDLNRIALEQGLNTSGALSESAPGQFEINFNHSKDVLRACDEIIIAKRLIRQVAHQHGFDATFMAKPFGEQAGNGMHIHLSLVDKDGNNHFSQTDGQPSPFFYQTMAAMLSQTSDAMGLICPNVNSFRRFLPGAYVPTKADWGENHRGVALRVPISDSKNRRIEHRIAGADVNPYILAAVVLSAVLASDNYTKDQCPPTLSDDAVELPLRMSEALERLEHSELAQYISQDFIDLYLACKRSELAEFERAITPLEIDWMLHSA

SEQ ID NO: 16869 - protein, 468 aa, Bradyrhizobium japonicum USDA 110
MEAARVFDSKPNSAEARDIAFHLHSQTNPQRHAEIGPLIMARGEGVHVYDASGKRYLEAMAGLWCTSLGFSETRLKAAAATAYDKFGFYHSFNHKTPDNTIELAEKLVEISPIPDAQAYFATSGSEATETMVKLAWVYHAVRGKPGKRKIIARDRGFHGSTIVAASMCGLPRMHREFGLPLDGFLHTHCPDAYRGTRPGESEAAFVDRLAADLEALIMAEGPDTIAAFIGEPINAGGGIVVPPKGYFAAIEAVLRRHDILVLGDEVVCGFGRTGNWFGCETVGMKPDMVALAKGITSSYFPMSAVLLGRPIRDALSEMNKGGELFGHGFTNSGHPVGAAIALETLNIYHEMDVVPHVRRMGSRLRAGLEQIARDSRIVGQVRGEGLMIGVELVAAPATRQAFDPALKVGAMFDALAIENGLIIRAMGDTIGFCPPLIIDEAGVDEALDLFGRTLFSAEAKLAEKRPSA

SEQ ID NO: 16870 - protein, 300 aa, Zea mays
WPGPHHFHLVTFSLTPTSTAVAHELSAQQKRRWLLEASLAGSVATNAPRKISSPTAMAAADASRTLLAAVSLALAACCLAQLAAGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLQNLHWKKDGCGACSGKSNFVCLGKQTCAIRTQSCKSQGPVDCSVGIQLAFSGTDKHESVLNSWYEVSNLRQYSLYGLYSNLKGTLSGQFNKIF

SEQ ID NO: 16871 - protein, 310 aa, Kineococcus radiotolerans SRS30216
MTQRDERPGRTVRKAVIPAAGQGTRFLPATKAMPKEMLPVVDTPAIQYIVEEAVRSGLTDVLMITGRNKRPLEDHFDRNVELEVGLEKKGDQTKLARVQESTDLAQVHYVRQGDPKGLGHAVLVAEQHVGDEPFVVLLGDDIVDSRDPLLDVMIKVREERGGSVVAFMEVPHDQIHLYGCAVAEPTDETDVVKVSGLVEKPKTEEAPSDLAIIGRYLLDPAVFAVLHETAPGKGGEIQLTDALQVLAQGDGPGYGVHGVVFRGRRYDTGDKLDYIKAVVRLATERADIGPDLREWLGEYVASGAGASTSA

SEQ ID NO: 16872 - protein, 458 aa, Xanthomonas axonopodis pv. citri str. 306
MSALFGATPADWLDARNLRLATRLGTLGLEPTAGRTLIREGILRRAVGLTLEATGCEAPMGATCKVEVDGGWVDAEVVGFAGERTYLIPSAELHGLLPNARVVPSRRRGGVEVGEGLLGRVIDSDGTPLDGKGPIRAEGSIGMAGVSINPLAREPITTSLDVGVRAINAMLPIGRGQRVGLFAGSGVGKSTLLGMMTRFTSADVIVVGLIGERGREVRDFVETTLGEEGLRRAVVVAAPADRPPLARLHGAYRATAIAEWFRDQGLNVLLLMDSLTRFAQAQREIGLSVGEPPTTRGYPPSVFAKLPALVERAGNGAKGRGSITAFYTVLTEGDDPQDPIADAARAILDGHILLSRRVADSGLYPAIDLESSVSRVVQDIADDTWRLRIRKLKRLLSAYTANRDLIAIGAYQRGSDPATDEALARWPEIVEFLGQDVHKASLLSDSLSALQQLVEPEN

SEQ ID NO: 16873 - protein, 613 aa, Bradyrhizobium japonicum USDA 110
MTPPPASAWTRSKPPLLRFLDTCLNEFSAETSGAVADYIPELGNADPAYFGISLATLDGHVYEVGDSRVPFTIQSMSKPFVFALALDLLGAGRVESAIGVEPSGDPFNSIRLNSDNHPFNPMVNAGAIACTGLIYDSKGAEAFEQIRLALSRFAGRDLAVDEAVYSSESQTGDRNRAIGYLLKTNAVISDNVAAVLDVYFRQCAVLVTARDIAVMAATLANRGINPVTGEQVMSAYAISRTLSVMTSSGMYDYAGEWIYRIGIPAKSGVGGGILAALPARLGLGSYSPKLDKHGNSVRGIKVCEALSSHYDLHMLNRSDDARNAVIADYDIGKSPSRRVRRAQEREILAAHEQEVRIIELVGTLSLSAVDYVSRRLAGRPRPQFVIFDLHRVTSTTRAGARLVAEAFEELAALNVTVVLSGVRRASKEWNTLREWTAELKNVRDFYLLDTAIEWAEDQIVYRYGGSIDFHETTELAEQPLLEGLSADELAELGAICTIRTYQSGAKILTTGDPADALFFLRSGAVHVTLPDGVRLATLTAGMAFGEMALLEQTRSADVFADMAATAFEAPLKDFERFREQHPRASERIMRNLAQLLADRLIVANAKVDILTST

SEQ ID NO: 16874 - protein, 256 aa, Triticum aestivum
MDEWVRQAEAWAGQAERWIRQQPPEQIYVAVAVIAVTILVLLAASCLKSSKSNTIVLSGLSGSGKTILFYQLRDGSSHQGTVTSMDPNNDTFVLHSELERKGKVKPVHVVDVPGHARLKPKLDEFLPRAAGVVFVVDAQDFLSSMQAAAEYLYDILTKATVVKKRIPVLIFCNKTDKVTAHSKEFIKKQLEKEVNKLRESRNAISSADITDEVELGVPGEAFNFSQCQNKVTVAEGAGLTGNVSAVEQFIREHVRA

SEQ ID NO: 16875 - protein, 321 aa, Nicotiana tabacum
EKEREGFPLTSLGEINILLSIHHPSIVDVKEVVVGSSLDSIFMVMEYMEHDLKALMETMKQPFSQSEVKCLMLQLLQGIKYLHDNWVIHRDLKTSNLLLNNRGELKICDFGLARQYGSPLKPYTHLVVTLWYRAPELLLGAKQYSTAIDMWSLGCIMAEMLSKEALFNGKTEVDQIDKIFKILGTPNETIWPGFSKLPGVKVNFVKYQLPALGDFWFNSLRKKFPATSFTGLPVLSDAGFDLLNKLLTYDPEKRITADAALNHEWFREVPLPKSKEFMPTFPAQHAQDRRVRRVMKSPDPLEEQRRKEPKQGMLGTGGLFG

SEQ ID NO: 16876 - protein, 500 aa, Kineococcus radiotolerans SRS30216
MTLDEFSRVLLLSSGVLLLAVLAVRLSARTGLPSLLIYLGLGLVLGEDGLGIPFADAEIAQVLGYGALVLILAEGGLTTRWSAIRGVVAPAAVLSTAGTLVSIGVVGVGAHLLLQTTWPVSLLIGAVVSSTDAAAVFSVLRSVPLPRRLSGLLEAESGLNDAPVVIAVLALTEVAGGTAHHAWWYFAGEAVLELVLGTAVGVGIGAAGAFLLRRTALPSSGLYPVAVLALTVMAFAVADVLHASGFLATYLCGLVLGNARLPHRHATRGFAEGFGWLAQIGLFVMLGLLASPSRLPNALVDALLVGLVLTLLARPVSVLVSLAGFRMPGRELLFLSWAGLRGAVPVVLATVPVVAGVEGSERLFDLVLVLVVVFTLVQAPTLAPVARRLGLIPSTPTQELDVEVSPLGTLSADVVQVRVGPASRLHGVEVFELRLPRGANVSLVARDGATFVPQPRTVLRRGDDLLVVTATSERSAVEERLQAISRHGKLAGWRSSPNGE

SEQ ID NO: 16877 - protein, 224 aa, Colwellia psychrerythraea 34H
MSPFLIAPSILSANFARLGDDVAKVLAAGADVVHFDVMDNHFVPNLTFGPMICKSLRDYGITAPIDVHLMVKNVDTLIPGFAEAGADIITFHPEASDHIDRSLQLIKDNGCKAGLVLNPATPLHCLDFVMDKLDVILLMSVNPGFGGQSFIPTTLDKLRLVKEKIKQSGYDIRLQVDGGVKANNIAEIADAGADMFVAGSAIFSQDDYKVAIDEMRAELAKVSQ

SEQ ID NO: 16878 - protein, 319 aa, Vibrio angustum S14
MLNSTVTKIAFFGECMIELSGDPIRKSFGGDTLNTALYLSRLTRQHSVHVSYATGLGVDTLSQELLETWRLEGIHTNLVETFAQQLPGLYMVQTDKTGERSFLYWRDNSAAKRYFSTSSLNKLEIALQDKQYEYFYLSGISLAILDQASRLRLKHLLEAFSKTGGKIIFDNNYRPKLWSSEEAQHWYSQILPLVDIALITQDDDLLVWGDDESVAARCLRMGCNEIVIKRGCEPCQLIWRQDQYVYHTYVAAEQVSNVIDTCAAGDSFAAGYLAGRLTGQSYQDSATLGHALAAIVIQHSGAIIPENAMKHLTLPSKSA

SEQ ID NO: 16879 - protein, 501 aa, Aspergillus nidulans FGSC A4
MATAVSLTAPNGHKYEQPIGLFINNEFVASKSGEKFATVNPSDEEEITQVYAAGEEDIDIAVKAARKALKDPSWKLLTATDRGNLMLKLADLIDQNKETLAVIETWDNGKPYQVSLNDDLSEVVNTIRYCAGWADKIHGQTISTTPAKFAYTLRQPIGVVGQIIPWNFPLAMAAWKLGPALACGNTVVLKPAEQTPLSILYLAKFIKEAGFPPGVVNIVNGLGRVAGSALVTHPGVDKVAFTGSTMTGKEIMKMAAGTMKNVTLETGGKSPLLVFDDADLEQAAKWAHIGIMYNQGQVCTATSRILVHEKVHDEFIRLFREAVATTSKVGDPFSDDTFQGPQVTKAQYERVLSYIESGKQEGATLVDGGVPYKNVKDGKGFFIAPTIFTNVKDNMRIYREEVFGPFVAIARFSTEEEAIDRANDTTYGLGAAVFTKDIERAHRVASEIEAGMVWINSSNDSDFRVPFGGVKQSGIGRELGEAGLEAYTQIKAVHVNMGTKL

SEQ ID NO: 16880 - protein, 398 aa, Methylobacillus flagellatus KT
MELSQRVQSIKESPTLAVTARAAKLKAEGRDIIGLGAGEPDFDTPQHIKDAAKQAIDQGFTKYTPVAGIPGLKKAIVAKFKKENGFDYTEKEVIVGVGGKQCIFNLALAVLNPGDEVIVPAPYWVSYADIALVAGAKPVIIECGIEQGFKLTAAQLEAAITPQTKLFMINSPSNPTGAVYSLEELKALGAVLKKHPHILVATDDMYEHVNLTGDKFYNILNAAPELKERCIVLNGVSKAYSMTGWRIGYAAGPAKIIKAMEILQSQSTSNPTSISQVAAQAALEGPQECITPMLDAFRERHEFVVKRFNEIKGLKCIKAGGAFYAFPDAREAIHNLFAAGKIKQATDMALSEYLLEQEGVAVVPGSAFGAEGYFRISFATSMDNLKKALERIERALAN

SEQ ID NO: 16881 - protein, 210 aa, Salmonella typhimurium LT2
MILHPSLASADPLRYAEALTALHDAPLGSLHLDIEDTSFINNITFGMKTIQAVAQYTRHPLSFHLMVSSPQRWLPWLAAIRPGWIFIHAESVQNPPEILADIRAIGAKAGLALNPATPLLPYRYLALQLDALMIMTSEPDGRGQQFIAAMCEKVSQGREHFPAAECWADGGITLRAARLLAAAGAQHLVIGRALFTTANYDVTLSQFTAL

SEQ ID NO: 16882 - protein, 233 aa, Triticum aestivum
  misc_feature (177)..(177): Xaa can be any naturally occurring amino acid
  misc_feature (180)..(180): Xaa can be any naturally occurring amino acid
  misc_feature (197)..(197): Xaa can be any naturally occurring amino acid
MSDNSIQRALLPDNPDANVLQTKPSQGAKRFRRCRSAPRSETDEKPQENGSSLPAKELFSVVRPSFRLVGFLLFLYLLAGVIVFYLVMDQLSGKRTNRVLDALYFCIVTMTSVGYGDLVPNTDTTKLLACVFVFTGMAIIALFVSKSADYLVEKQEVLFFKALHMNMKCGEAKMLRXIEXNKTKYKFYTAALLLVTXLVVGTVFLWKGEELNLVDSFYWVCATSLPWVRGIKL

SEQ ID NO: 16883 - protein, 184 aa, Triticum aestivum
PATLPPPTPWPPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 16884 - protein, 531 aa, Methylobacillus flagellatus KT
MRDMFTKDGRRFEKFSLEAEGLLLDYSKHRITDETLPLLFKLARDSKVEEWRDRMFAGEKINFTENRAVLHTALRNRSNTPVYVDGKDVMPDVNRVLAQMRKFSTSIRSGEWKGYSGKRITDVVNIGIGGSDLGPVMVCGALKPYAQAGLNAHFVSNIDGTHLAQTLERCDPETTLFIVASKTFTTQETMTNARSARSWFLQAAKDEAHVAKHFVAISTNADEVGKFGIDAANMFEFWDWVGGRYSLWSAIGLSIAIYIGMDHFEELLQGGYEIDRHFKNAPLEQNIPVIMALLGIWYNNFFGADSLAILPYDQGLARFPAYLQQADMESNGKFVARDGRIVQCTTGPIIWGEAGTNGQHAFYQLIHQGNRLIPCDFMMPLQSHYSMGKNGNEHHLILLANCFAQTSALMQGKTLDEAKAELVAQGLTGEALETLLPHKVFEGNRPSTTILFDKLTPKTLGKLIAIYEHKIFVQGIIWNINSFDQWGVEYGKQIAKKILPQLSEDQASTEYDSSTNGLMNYFKSRTQSSGT

SEQ ID NO: 16885 - protein, 541 aa, Lactobacillus acidophilus NCFM
MTNAYNILNDPFLNKGTAFTKSERESLGLIGALPAKVQTIDEQATRIYDQDQLHEKGIDQRKFLMELFNTNRTLFYYVIEQHIEELMPIIYDPVIAPAIEEYSEIFMKPQGAAFLSIDNPGEIEASLTNAAGGRKIKLIVVTDGEGILGIGDWGSNGVNISVGKLMVYTAAAGIDPREVLPIVLDVGTDNQTLIDDPLYLGEKHARVTGDKYYDFVDKFVKIARKVFPDVYIHFEDFGRDNATKILNKYRKEIPVFNGDVQGTGIVCLAGVLGVLNISKQKFSDQIFLTFGAGTAGMGIANMMYREMLVEGMDPEEAKKHFYLVDKQGLLFSDTPGITPEQRPFVRERSEFVNADELTNLEAVIKTVHPTVMIGTSTTPGAFTEKAIKEMATHTERPIIFPISNPTKLIEASAEDLIKWTDGRALVATGVPSDPVKYNGVTYHIGQANNALIYPGLGLGVLASKAKLVTDEMLSAAAHSLGGIVDPNEKGASVLPPISKIRIFSDKEAISVAQTAIDQKLATPNITDAKAATENIKWIPKY

SEQ ID NO: 16886 - protein, 214 aa, Triticum aestivum
  misc_feature (140)..(140): Xaa can be any naturally occurring amino acid
NKFVQKSRLVPVRNSRDIVDPRVRAAAVFRSQPAVLLTGLSKKLPGVRPREDDRKPLVVNAGQVAAGTLKTLTAADMAALGGLGISVVLGRLEPGAARAPWVLREGAAQLVYVARGSARVQVSSSAGGETLLLDEEVAAXSVFVVPRFAVTLISAGADGAQWVSLIKSARPAVEHLTGDGSMLGGLTAQVVQASLSVAAELLELLGVRSAQPSH

SEQ ID NO: 16887 - protein, 452 aa, Nostoc punctiforme PCC 73102
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 16888 - protein, 84 aa, Nostoc punctiforme PCC 73102
MSQTELFEKVKKIVIEQLSVEDASKITPQAKFMEDLGADSLDTVELVMALEEEFDIEIPDEAAEQIVSVQDAVDYINNKVAASA

SEQ ID NO: 16889 - protein, 181 aa, Methanosarcina mazei Go1
MIMRFKGMSPRIAETAFVADSADIIGDVEVGSHSSIWFNAVIRGDQNKIKIGNRTSIQDGVIIHADPENGVQVGDNVSVGHGAVLHGCKIEENVIIGMNSTVLNGAEIGKNSIVGANALVPQGKKFPPNSLIIGVPGAVKRETNEEDIEAIQENAEEYVEMAEEYREEIKRYAFTKSSSMT

SEQ ID NO: 16890 - protein, 519 aa, Bradyrhizobium japonicum USDA 110
MTWKPELDELARREAFAREMGGVDKVKRQHDQGRLTVRERIDKLIDKGSFHEIGAVSGIGEYDSSGELQKLTPANCVFGRARVDGRTVVVVGDDFTVRGGSADASISAKPLMAEEMAHDFRLPIVRIIEGSGGGGSVKTIETKGAANLPGGIGGTRWYRFTTENLSRVPVVALGLGSVAGLGAARLAASHYSIMTRKSAMFVAGPPVVKALGQDLSKEELGGADIQTRAGAIDHAVGTEEEAFACARRFLSYLPSSVYELPPTLPCTDNPERTEEALMNAVPRNRKQVYKMRPIIESVVDKGSFFEVAKNFGKPIIVGLARLEGRAVLLLASDSFHYGGSWTADACQKVVRWVDFAETFHLPIVYLMDCPGFMIGLDAEKAATIRHGVRVMAAVNQTTVPWCTVILRNAFGVAGVVHQPADRFSIRYAWPSAYWGSLPLEGGIEAAYRADIDAAEDKAAKLREIEERLNKLRSPFRSAEKFWVEEIIDPRKTRSLLCEFARLAEPLRKAGPPENMTIRP

SEQ ID NO: 16891 - protein, 323 aa, Arabidopsis thaliana
MPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 16892 - protein, 128 aa, Glycine max
PGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 16893 - protein, 262 aa, Roseovarius nubinhibens
MRMLNWAEAALHWREDGDPGGRPLVFANSLGTDLRLWDALLPYLPVGLRLIRYDMRGHGLSACPPGPYDMDALARDAEALIEYLDLTNVTFIGLSIGGMVGQALAARRPDLLSALVLSNTAAAMGTPEAWQARIAAIRAGGIEAIADAVMERWFAARFRATPELALWRNMLTRTPPEGYIGCCAAIAGADLRATTATLTLPTLAIAGAEDGASPPDLVADTARLIPGARFATLPDTGHLPCVEAPAAYAAILSDFLKETAHV

SEQ ID NO: 16894 - protein, 590 aa, Zea mays
  misc_feature (115)..(115): Xaa can be any naturally occurring amino acid
MLNGGGGGQKKRNTKIEPYRHRVETDPKFFDKSWRKLHDAIREIYNHNASGLSFEELYRTAYNMVLNKFAPQLYEKLTENMKEHLEEMRTCIEAAQGGLFLEEFKAAWTAHHAEXLANQMQSLILIENSGLVNMLVEDRYEDLTRMYTLFNHVPDGLATIRSVMVSHIKDTGKSLVTDPERLKDPVDFVQRLLNMKDKYDNIINVSFSNDKSFLNALNSSFENFINLNNRSPEFISLFVDDKLRKGVKEANEEDLETVLDKVMMLFRYLQEKDLFEKYYKQHLAKRLLSGKAASDDSERSMLVKLKTECGYQFTSKLEGMFTDLKTSQDTTQGFYASTSSELPADAPTMSVQILTTGSWPTQTCNTCNLPPEIVSVSEKFRSYYLGTHNGRRLTWQTNMGTADIKVTFGNGSKHELNVSTYQMCVLMLFNSADVLTYREIEQSTAIPAADLKRCLQSLALVKGKQVLRKEPMSRDIADDDSFCVNDKFTSKLFKVKIGTVVAQKETDPEKLETRQRVEEDRKPQIEAAIVRIMKSRRVLDHNSIMTEVTKQLQPRFMPNPVVIKKRIESLIERDFLERDKTDRKMYRYLA

SEQ ID NO: 16895 - protein, 486 aa, Nocardioides sp. KP7
MINAKLIINGREETSDRTIDVVSPADTRVVLGSVPDATSEQVDEAVQAAATAFPEWSSRPLEERQGALFAAAGAIHDMIEEYAPLLSRENGKILEESHIDLEFASGICGYTAGISAEALADQRIHDAGGTTLIRRRPIGPVAAVTPWNFPVVLSFMKLAPALVAGNTVVLKPSENSPLVLTEVIRALQEHFPPGVLNMVTGGDATGEALVAHPLIRKIGFTGGIDTGRKVMAVAAQDIKRVTLELGGNDPAVVLDDVDLSPETMRRIAKGAFSATGQVCFGLKSIYVPTRIHDRFVEAFHAAVDEIVVGPGDDPRSTMGPLNNAQQKGSVEKILEEARGAGAVVTTLGRKLDTAAWEHGHFMMPSVVTDADPRLAIVEQEQFGPTVPVVRYTELDEVIRLTNRSQFGLAASIWSADEDRAFELGRRLDTGSVFINSHSFSSLDPRAPFGGTKNSGLGREFSPASLDAYTELQTISRRTGPPGPPLS

SEQ ID NO: 16896 - protein, 1123 aa, Aspergillus nidulans FGSC A4
MAEGRAAPLRLGSTAPNFTADTSNGPITFHDYIGDSWAILFSHPDDFTPICTTELGAFAKLEPEFTARGVKLIGLSANGTESHKAWIKDIDEVTGSKLTFPIISDPERKIAHQYDMVDYQDTTNVDSKGMALTIRSVFIIDPAKKIRLIMTYPASTGRNTAEVLRVVDALQTTEKHGVTTPINWLPGDDVVIPPPVSTEDAQKKFGDVRVVKPAYPYSSQLHRIYTSRFFLASKTPPRTRVRTASTGVLGTPISSSTVPPHRIAVAPSADLPDSATGTPAPNSSPNPVNLSGLVCNVRRTSGREPPPLVGATTTILGDKLYVFGGRILSKTRPHLTSDIYELDLIRRHWSKIEASGDIPRPRYFHSVCALGDSKLVCYGGMSPIANPPKDSTNGGNEPQPEVVVMSDINIFDVPTRTWTRINTHDSPQGRYAHCATILPSSAYFTSATAPLSAIHHNPASANPHQGSIGVDIDGLGGAEMVVVGGQDSTNRYIEQISVFNLRSLKWTNTSPLGRSCGAYRSVAAPLTGMRLSDIGSASADQEAQDPIEDVGAPGFPMLIYSNYNFLDVKLELQIRLPDGRLVEKPMPSQASPPGLRFPNGAVINGHFVVSGTYLTSSKQEYALWALDLKSLTWGRIDAGGSVFGHGSWNRGVLWSRRNTFVILGHRKRNLVEDYNHRRINFTHLCMVELEAFGLYNNPCRTSPTSAYISHSGPAVPASFQQKLAQLRSGGRPFSAAAAELGRLAQTVPEMADMELQAVGGERISVNSRILSRRWGPYFIQLLRESSDTASDTATLRTGLQPYPSRNSSITITPSLDHGSTYSNATTLASSNNNPAKSILANLELPSAHSLPPTSRPRVLFLPHTVLTLQVLVFYLYTSALPPVGSPLCTPQILCSLLQLARPYQVDGLLEAVVERLHQVLDGRNAAAVFNAAAMAAGGGRGTGFISGPGGTLEALNGAHAANELADLTNAISLTDTRSRLNSDSSDTEHGTASAVSVASSSAGGGTRGVPLRINTNIFSRRQGREREDSISNASTSSASATSYDFSDSEGLPGDMARSSRRRRGTHGDNEVWTGDLSSVIGLQKRGLRGLMEGRRLRERSAKPPSSGQASVAAVPVDHTANVI

SEQ ID NO: 16897 - protein, 415 aa, Neptuniibacter caesariensis
MSEDMKQAALDYHEFPRPGKISVELSTEAESQLDLSLAYSPGVAEPVREIAKDPENAYRYTAKGNLVAVISNGSAILGLGDLGPLASKPVMEGKALLFKRFAGLDSIDIEVDAESPQAFIDTVARIADTFGGINLEDIKAPECFEIERVLIERCNIPVFHDDQHGTAIVTAAGMINALEIAGKKLEEASIVCLGAGAAAHACMKLLVNMGAKVENIYMIDRTGVIHSGRENLTPEKAAFASETDKRTLDDAIDGADVFVGLSGPNLLSGEQLSKMAANPVVFACANPDPEIRPELAHETRDDVIMATGRSDFPNQVNNVLGFPFIFRGAMDVRATAINEEMKAAAVRALAELAKEPVTQEVLDAYGLDSLEFGSDYIIPKATDSRLLGAVSTAVAQAAIDTGVARLPLPDNYPLS

SEQ ID NO: 16898 - protein, 427 aa, Vibrio angustum S14
MSFQSLNLHPNLLKALTELGYSTPTDVQQQAIPLALKGDDVMAGAQTGTGKTAAFALPLLQRLMTLPSQAEQVSTAIENNHKSRNNIRALILTPTRELAQQVYDSITTYAKYTEIKVAVAYGGTSMNVQVKALNAGAEILVATPGRLLDHVFNGSVSLSEVETFVLDEADRMLDMGFIVDIQRIMKRMPAERQTLFFSATFSKQVKKLAFDILTNPKMVEVTPANTAAETVEQMVYPVDKHRKAELLAYLIGSRNWRQVLVFTKTKQGSDQLAKDLGLDGIKASSINGDKSQGARQRALDDFKSGKTRVLVATDVAARGLDIEQLEYVVNFDMPFKAEDYVHRIGRTGRAGMTGHAITLMSLDEEWALKAIEELLDSRLPQQWLEGYEPDPALIETQSVHRGAAAEKRRAKSKSKIHQNRGKHRNRR

SEQ ID NO: 16899 - protein, 307 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYHHRDRDDYRGGGGGGRGRGSRYDRYDDGAGRGGRHARYDDGAGRGGRHDRYDDGGRRRHGSPSRRARSPVRESSEERRAKIEQWNREREGKQ

SEQ ID NO: 16900 - protein, 372 aa, Salmonella typhimurium LT2
MKSRAAVAFGPGQPLKIVEIDVAPPKKGEVLVKITHTGVCHTDAFTLSGDDPEGVFPAVLGHEGGGVVVEVGEGVTSLKPGDHVIPLYTAECGECKFCKSGKTNLCQAVRATQGKGLMPDGTTRFSYNGEPVYHYMGTSTFSEYTVCAEISLAKVNPQAPLDKVCLLGCGVTTGIGAVHNTAKVKAGDTVAVFGLGGIGLAVIQGAVQAKAGRILAVDTNPEKFTLAGEMGATDFINPNDYDKPIQDVIVELTDGGVDFSFECIGNVNVMRAALECCHKGWGESIIIGVAGAGQEIKTRPFQLVTGRVWRGSAFGGVKGRTQLPGMVEDAMNGKIRLDPFITHRLPLEQINDAFELMHQGKSIRTVIHFGDN

SEQ ID NO: 16901 - protein, 145 aa, Listeria innocua Clip11262
MDESKKNERLKQLTDIQYNVTQKADTERPFQNEFYDNVAKGIYVDIVSGKPLFSSNDQYDAGCGWPSFTKPIDEAEVIEHRDLSHGMIRTEVKSVEADSHLGHVFPDGPQDQGGLRYCINSAALRFIPVDKLEEEGYQTYKKIFE

SEQ ID NO: 16902 - protein, 441 aa, Lactobacillus acidophilus NCFM
MGKENNELKRSLGFGSAISIVIGTIIGSGIFFKQASILDSAGSSSMAISAWIFGGVITLAAGLTIAEIGAQMPYTGGLYVYVENLYGRICGFLAGWMQVIVYGPAIIASVAGFMSIMITNLFGIDAKWRIPIALIIIIAIGLMNFLENKVAAAFSVITTIGKMIPIAAIIIFGLFWGHQDALGQTVSEINRSAGGFGVAVLATLFGYDGWILIANLGGEMKNPQKLLPKAIILGISTVLVIYTLITVGIFRFVPANMIHSLGENTTSYLATRAFGDIGGKLLSIGIIVSMMGTLNGKIITFPRIVYAMARRGDLPFSRILSYVTPKGKSPVVATIFIILLATIMMLFFDPDHLSDLCVFTIYCFYLLTFFGIFILRKKNSKRPFSTPLYPFVPIVAIAGGIFVLVSELFNDPAGVLLFAGIVIIGLPVLYVVKKMDKKRLK

SEQ ID NO: 16903 - protein, 132 aa, Oryza sativa Japonica Group
MSRSLGIPVKLLHEAAGHVVTVELKTGEVYRGSMVECEDNWNCQLDNITFTAKDGKVSQLEHVFIRGSRVRFMIIPDMLKNAPMFKRLEARIRGKGSAIGVGRGRAVAMRARAAAGRGGGPVGRGGAPPVRR

SEQ ID NO: 16904 - protein, 195 aa, Lactobacillus acidophilus NCFM
MLVKNVSELIGHTPLLELPIKIPNHNKIYAKLEMNNPCDSIKDRLGQFLIEDAINKGKINKKTTIVEPTARNTGIGLALAAQKYHLRTILVVPEKFSFEKQTLMRALGADIINIPGELGMMGALKKSYEIASELANAYVPNQFDNLANPEAYRKTIVPKIIPDLNEVKVDAFVAGPGTGGTFAGIAQGLHDFFQI

SEQ ID NO: 16905 - protein, 705 aa, Pseudomonas syringae pv. tomato str. DC3000
MTQPAATILIVDDDVHVRDLLEVLLQNQGYETLTAESGEQALAMVDARAPDLILLDIMMPGMDGYEVASVLKAGKGTANIPIIMLSALDEQGARLSGLEAGAEEYLSKPVESAELWLRVRNLLRLKAFGDYLKSHSMILEDQLQQRTIDLERFRTVMDASEDAIFLINRNTMSLIEFNRRACQLLGYTAEELAHKTPAELGETSMENLEVVYDQIIAGKGPSEPLETQIRDKSGRDVEVEIHRQAYRTGEDWVIVGIVRDITQRKESDQRLLTMAHYDTLTGLPNRDLFFTSLQMGLTQAAVSRWKLATLTVNLDGFKNINETWGHVLGDQVLLEVSHRLSECINASDTLGRVDGDQFALILMIRVGQPDTRQTLERIRKALRVPFMVEGQSIVMTASIGIALYPEDGEDARELVRHAYTAMNSAKKIGPDTYRFYTAQMNADVSARLDLEAALRDAVEKQAFEIVYQPKLSLVTGRICGLEALLRWPRPGQQGVSPAVFVPVLESLGLIGEVGNWVVDRVCAQIAHWQRTGLGLFQVAVNVSGQQISNSSLVADIRQALTNHRVAPQWLEVELTESSLMENTSHTIATLETLKANGVSISIDDFGTGYSSLAYLRRFPIDKLKIDIAFIREVTSNPQDAAIARAIIELAHSLGLKVIAEGVETPEQLAFLRDNQCDQIQGYLISKPLPLAELETFLSTPERQFG

SEQ ID NO: 16906 - protein, 404 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHDSLYSDSMWLSLPAKAEEGLGMGPLDFMSRGPAGYINRQPNGGMNNE

SEQ ID NO: 16907 - protein, 408 aa, Oryza sativa Japonica Group
MATASGGVTQASVMAEAAVWLLEQLPSIMVAKIKRQIGGLSLLAKLGLLLLALLLLLAAILLLVFLLPRHHRRPLPPGSPPVNASDPDNIVAFDFSPFLILYKSGRVHRMDGTDRVPAGVDEATGVTSKDVVIDRSTGVGARMYLPPAKGAGKKDLAGALPVLVFFHGGAFVIESAFTAKYHDYLNKVTAKARVVAVSVDYRLAPEHPVPTAYDDSWQALNWVAKNGRSGPEPWLRDRGNMSRLFLAGDSAGANIAHNMAMRAGKDGGQLEGGVAITGILLLDPYFWGKNPVGAETTDPARRRQYEATWSFICDGKYGIDDPLVDPLSMPAPEWRKLACSRVAVTVSDLDDFKERGKAYAAALRDSGWGGEVEEYETAGEVHVYFLDKPSSPKSAKELTFVAGYLSHE

SEQ ID NO: 16908 - protein, 270 aa, Glycine max
INVSLVAEAESALILVRHGESLWNEKNLFSGCCSVPLTNRGVEEAIEAGQRISYIPIDMIFTSALIRAQMTALLAMTRHSQKKVPIIIHDESEQATTWTQVYSEKTTKQSIPVITAWQLNERMYGELQGLNKQETAERYGKEKVHEWCRSFDIPLPKALYWIFYDTDILLGIETYEISTGIEPPLKSGKHVMVAAHGNSLRSIIMYLDGLTSQEVTSLEISTGIPLLYIYKEGKFNSRGSPVGPTEAGVYAYTQSLAVYRQQLDDMSSCY

SEQ ID NO: 16909 - protein, 212 aa, Oryza sativa Japonica Group
MEVLSWRTVCLLVLCTVALLRPAAAIRFVIDREECFSHNVEYEGDTVHVSFVVIKADTPWHYSEDGVDLVVKDPNGAQVRDSRDKTSDKFEFIVQKRGVHRFCFTNKSPYHETVDFDVHVGHFSYFDQHAKDEHFAPLFEQIAKLDEALYNIQFEQHWLEAQTDRQAILNENMSRRAVHKALLESAALIAASVIQVYLLRRLFERKLGTSRV

SEQ ID NO: 16910 - protein, 491 aa, Schizosaccharomyces pombe
MTVVRADKKHRRRGSIYMVTPYMDHDLSGLLENPSVKFTEPQIKCYMKQLFAGTKYLHDQLILHRDLKAANLLIDNHGILKIADFGLARVITEESYANKNPGLPPPNRREYTGCVVTRWYRSPELLLGERRYTTAIDMWSVGCIMAEMYKGRPILQGSSDLDQLDKIFRLCGSPTQATMPNWEKLPGCEGVRSFPSHPRTLETAFFTFGKEMTSLCGAILTLNPDERLSASMALEHEYFTTPPYPANPSELQSYSASHEYDKRRKREQRDANSHAFEQTANGKRQFRFMTRGPSDPWYGIRRPNYNSQPQYQRGSYNREGGNMDRSRNVNYQPKRQQNFKPLTSDLPQKNSEFSETNAMNQTSNHSHADGQRYYRPEQDRSQRLRNPSDYGRQGRQSSQSQQPAWNVSSRYQNNSKVQTTSRASENADTNKTQHNIKYIDSYVPEYSIARQSANQKTNEQHPSSTSLHQQSTSDLKSPSFHENSNVDDTPK

SEQ ID NO: 16911 - protein, 262 aa, Hyphomonas neptunium ATCC 15444
MAVTADILAAIALAAGKEIMRVYRTDFSVSHKDDHSVLTEADGLAEAIILKGLAEAEPSLQVIAEEAVAGGHMPEHGARFALVDPLDGTKEFVAKNGEFTVNIAIIEHGRPVMGVVYVPAQNRLFVAEGPGKAWHANAAPDGPVPGDRTTLKVRPAPAAGLTAVASKSHRSPETDEWLSQYPVAEIKGAGSALKFCLVAAGEADVYPRLGRTMEWDTAAGQAVVEAAGGRVLTISGEPLLYGKRDRGYDNPHFVVFGDVTPH

SEQ ID NO: 16912 - protein, 356 aa, Triticum aestivum
MENGHAGKHRVAVIGSGNWGSVASRLLASNTAKLPSFHDEVRMWVFEETLPTGEKLSESINQAHENCKYLPGIKLGTNVIADPDLESAVKDADMLVFVTPHQFVEGICKKLVGKLRPGVEAISLIKGMEVKMEGPCMISKLITDTLGINCCVLMGANIANEIAVEKFSEATIGYREDKEAANRWAKLFTTPYFLVAIVEDIEGVELCGTLKNVVAIAAGLVDGLDMGNNTKAAIMRIGLREMRAFSKLLFPSVRDNTFFESCGVADLITTCLGGRNRRVAEAFARNGGKRSFDELEAEMLHGQKLQGVSTAREVYEVLTYHGWQELFPLLSTVHEICIGQLPPTSIVEYRLAEGQS

SEQ ID NO: 16913 - protein, 531 aa, Bradyrhizobium sp. ORS278
MPYQFSNRQQIRKPAVTSKGGIVAAQSRRAAEIGAEVLAAGGDCIDAVVATGFALGVVEPWMSGLGGGGAMVLYRAKDNKVEVIDYGMRAPDSLRVEDYPLTNDGSVSPDIFPWPRVKDDRNLHGPGAIAVPGVVAGMDMAYRRYARLPWQDLVAPSVALAAEGLLVDWWTTVMISSCAADLRRYAGSAAAYLKDGLPPNPQWGAKAITRLPQEQLKATLAHLASTGARDFYQGDIARSLTRDIQAAGGALSVEDLAAFAAQVRDPLRIPYRGGAVFATPELTAGPTLAHALRLMQTSIEPAGKAPDAGAFIAYAEAMQSAYRERLNDMGDAPGKRALGAEYLAPACTTHYSVVDRDGNMAAVTQTLLSGFGSKFQAPQSGIMMNNGIMWFDPTPGTTNSLAPGKRCLTNYTPVVAETADGRRLALGASGGRRILPAVAQMLSFVMDYRMDLDAAIHQPRIDASEGDVVGADTRLPAEVMSALTAKFETVPAPVQTMPMKFACPSIVLRDGVTNSGATEIAHAWGDAVAEG

SEQ ID NO: 16914 - protein, 498 aa, Bradyrhizobium japonicum USDA 110
MRSIGHFIGGKEVKGTSGRTADVFEPMTGDVQAKVALASKAEVRAAVENARAAQPEWAATNPQRRARVMMKFVELVQRDYDKLAELLAREHGKTVPDAKGDIQRGLEVAEFACGIPHLMKGEYTEGAGPGIDIYSMRQALGVVAGITPFNFPAMIPMWKFAPAIACGNAFILKPSERDPGVPMLLAELMMEAGLPAGILNVVNGDKEAVDAILDDPDIKAVGFVGSTPIAQYIYERAAQTGKRCQCFGGAKNHAIIMPDADMDQAVDALIGAGYGSAGERCMAVSVAVPVGKPTADRLMEKLIPRVESLKIGTSIDPSADYGPLVTREAVEKVKGYIDIGIKEGATLAVDGRGFKMQGYEKGFYLGGSLFDNVTKDMRIYKEEIFGPVLSVVRAHDYKEALALPSEHDYGNGVAIFTRDGDAARDFAAKVNVGMVGINVPIPVPIAYYTFGGWKKSGFGDLNQHGPDSVRFYTKTKTVTSRWPSGVKEGAEFSIPLMK

SEQ ID NO: 16915 - protein, 401 aa, Rickettsia prowazekii str. Madrid E
MSVKIIIPSLGESVTEATIAKWYKKLGDSVKTDELLLEIETEKVTLEVNAPCNGTIEKIAKTDGANVTVGEEIGEINEVVDTDTACTNNNSYKKQAIVQHDSEQIVDKPASSSNILAPSVQKLVTENKLDPNNIKGTGRGGRITKCDVLETINTTPVTIETPALNKTNEERTQRVRMSRLRKTIAQRLKDSQNTAAILTTFNEIDMSKVIALRNQYKEEFEKKHTVKLGFMSFFVKATIEALKLIPSINAEIDGDDLLYKNYYDIGVAVGTDQGLVVPVVRDADKMGFADVEQAIGDLAKKAREGKLSMSDLSGGTFSISNGGVYGSLLSTPIINPPQSGILGLHKTEERAVVIDGKIEIRPMMYIALSYDHRIIDGKEGVSFLVKIKNLIENPEKLLLNL

SEQ ID NO: 16916 - protein, 358 aa, Glycine max
MSSFKSKYQDELIANATYIGTPGKGILAADESTGTIGKRLASINVENVETNRRILRELLFTAPGCLECLSGVILFEETLYQKSAAGVPFVDILKKGGVLPGIKVDKGTVELAGTNGETTTQGLDDLAQRCKKYYEAGARFAKWRAVLKIGPNEPSPLSIHENANGLACYAAICQENGLVPIVEPEILSDGPHDIAKCADVTERVLAACYKALNDHHVLLEGTLLKPNMVTPGSEAARVTAEVIAEHTVRALQRTVPPAVPAIVFLSGGQSEEEATVNLNAMNQLKGKKPWSLTFSYGRALQQSTLKAWGGKDENIPKAQSALLVRCKANSEATLGTYKGDATLGEGASESLHVKDYKY

SEQ ID NO: 16917 - protein, 195 aa, Methylococcus capsulatus str. Bath
MPIVIEQSARGERAFDIYSRLLKERVIFLVGQVEDYMANLVIAQLLFLESENPDKDIHLYINSPGGLVTAGLAIYDTMQFIKPDVSTLCVGQAASMGALLLAGGAAGKRYCLPHSRIMIHQPLGGFQGQASDIDIHAREILAVRDRLNKILAHHTGQPIEKIQIDTDRDNFMGGDDAVSYGLIDKVLTHRTVTAA

SEQ ID NO: 16918 - protein, 252 aa, Neptuniibacter caesariensis
MADQHKNDTTHFGYEDVRTEDKVNRVADVFHSVAGKYDLMNDLMSGGVHRLWKRITIEQSGVRTGNTILDIAGGTGDLTMRFSRLVGPSGKVVLADINDSMLKVGRDKLLDKGVTGNVEFVQANAECLPFPDNTFDVITIAFGLRNVTDKDAALRSMARVLKPGGKLMVLEFSKTDNPLLTKAYDFYSFNILPQMGSMIAGDADSYRYLAESIRMHPDQETLKSMMQDAGLTNCKFQNMTGGIVALHTGIKP

SEQ ID NO: 16919 - protein, 591 aa, Vitis vinifera
MESTLKELRDGNTVLEVDSKSAVSGGVRDVQGEDAATEDQIVTPWTITVASGYSLLRNPHHNKGLAFTEKERDHHYLRGLLPPAVVSQDLQVKKLMANIRQYTVPLQKYMAMMDLQERNEKLFYKLLMDNVEELLPVVYTPTVGEACQKYGGILRRPQGLFISLNEKGKILEVLKNWPEKNIQVIVVTDGERILGLGDLGCQGMGIPVGKLSLYTALGGVRPSACLPVTIDVGTNNQKLLDDEFYIGLRQKRATGQEYAELIHEFMCAVKQNYGEKVLVQFEDFANHNAFDLLARYGTTHLVFNDDIQGTASVVLAGLISALNLVGGTLAEHTFLFLGAGEAGTGIAELIALEMSKQTQAPLEETRKKIWLVDSKGLIVSSRMDSLQHFKKPWAHEHEPIKNLVDAVKAIKPTVLIGSSGVGRTFTKEVVEAMASFNEKPIILALSNPTSQSECTAEEAYTWSEGRAIFASGSPFDPVEYNGKVFVPGQSNNAYIFPGFGLGLIISGAIRVHDDMLLAASEALAKQATQENFDKGMIYPPFSNIRKISAHIAANVAAKAYELGLATRLPQPENLVEYAENCMYSPVYRSFR

SEQ ID NO: 16920 - protein, 98 aa, Borrelia burgdorferi
MNTQAILVLDFGSQYSQLIARRIREIGVYTKVIPYYTPLKEIKNMNISGIILSGSPASVYSKEAPTLNMEIFNLKIPILGICYGMQIIVKLFGGLVSK

SEQ ID NO: 16921 - protein, 329 aa, Bacillus anthracis str. Ames
MIDNFWRDLPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLLTINGDIPDRKTGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRALLNKFEESVNVVEGSETV

SEQ ID NO: 16922 - protein, 879 aa, Listeria innocua Clip11262
MRKFVYQFSEGSKEMKNLLGGKGANLAEMTKIGLPVPPGFIISTDACNDYTTSNKHLSEDIFEEVKIHLTELEKQTGKIFGFAENPLLVSVRSGAPFSMPGMMDTVLNLGLNDQAAEGLANLTGDARSAFDSYRRFIQMFGDVVFEIPSYQFEQALARIKKDNNYLLDTELTAANLSELIEIYKLIFSQATGRDFPQDPLEQLRLAIIAVFDSWMNPRAVIYRRLHDIDASFGTAVNIQAMVFGNTGETSGTGITFTRNPSTGEKQVFGEFLLNAQGEDVVAGIRTPEPISALEQRMPLVYNELLKTCELLENHYLDMQDIEFTIEKGKLYVLQTRSGKRTAKAAIQTAVDFVHEGKITREEAIMRVETKQLHQLLHPAFHESALKAGQVIATGLPASPGAATGQIFFEAKEAVAASERGISVILVRNETSPEDIEGMARSSAILTAHGGMTSHAAVVARGMGKCCIAGCAELTINEKEKTIILTTGEQLHEGDFLSLDGSTGNVYLGQIALTEASIGGHFDELMAWADAEKKLKIRVNADTPTDFKKALLFGAEGVGLCRTEHMFFDEKRIPYVRQMILAESLKERESVLTSLKEMQKTDFSELFRIANGRAVNIRLLDPPLHEFLPKTNREIEQLARDMNRTVPQITKRIEELAEANPMLGHRGCRLAITFPEIYRMQAEAIMESAVIVHDEGIDVHPEIMIPLIATKSELSYIKNEIKQAIHAIFEKERVVLPFDIGTMIEIPRACVTADEIAEEAQFFSFGTNDLTQLTYGFSRDDATKFLADYYEKDILPKDPFVTIDKTGVGALVEMAVTRGRMTHANLKMGVCGEHGGDPESIHFFHQLGLSYVSCSPYRVPIARLAAAQAALSENKLVSTI

SEQ ID NO: 16923 - protein, 321 aa, Legionella pneumophila str. Paris
MDLSKRIEPKTWSFVEKIQNAGGKPIYDIPVAEGRAIFDQLQALPNEKPDVDVEDKTLPVGPGGKVDIRIVRPKGAKESLPVIMFFHGAGWVFGDYQTHGRLVREIAVGTHAAVVFVKYTLAPEAQYPTQIEESYAAMKYIAEHGKQFNLDTSRFVAAGDSVGGNMTSVMALLAKERGGPKIDYQVLIYPVTDANFDNASYKEFAEGPWLTKKAMEWFWDKYLPNKEKRKEITASPLQASLEQLKGLPPALVITGECDVLRDEGEAYAHKLNAAGVTVTAVRHLGTIHDFLMLNDLSETPACRNAVETIIGHLTHIFGKKK

SEQ ID NO: 16924 - protein, 209 aa, Dehalococcoides sp. BAV1
MKKIYDLSPEIRPDMISWPGDSCPEITLLHSIKYGSHSNLSRLTMTLHNGSHIDAPYHFFEAGIGASEIPLEILVGDVRVLRFGGVKTITRKMLEHADLKGVTRLILATDNESLWKKPDFDENYTYIDIGAAQYLTEIGIRLLGIDYLSVEDFQGLDGVHKHLLSQGVVILETLQLAGVPEGDYELYCLPLKLGKVDGAPARVILIERD

SEQ ID NO: 16925 - protein, 126 aa, Zea mays
QRRGANSVRPGYTKGEGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 16926 - protein, 220 aa, Dehalococcoides sp. BAV1
MKDVKVVPAILTDDPAAFESMIKQSEGFAPVAQIDIMDGQFVPSLSIPPEVLGRYKPCFASEIHLMTLNPEEYLTYCKQHGARRVIFHFEATPRPEYVISRIKEMGFKVGLAVNPETSVAEFAYLVPQVDMVLFMSVIPGFYGAPFIPEVLLKVKEFKRRFPETEIGLDGGAKQANIPEIVAAGVNDICVGSAIFRQSDPQSSYLYLDKLAKNSAKEAGL

SEQ ID NO: 16927 - protein, 382 aa, Coprinopsis cinerea okayama7#130
MAEPKTFRIAVLPGDGIGPEVVREAVRVLELASERSSDFKLELKSYPFGGCAIDEVGEPLPEATLKACQEADAILMGSIGGPKWGVDAKVRPEQGLLALRKTLGLYANIRPANIASDSLLDYSPLRPEVAKGTDLIVVRELIGGAYFGKRKEQGVDPDPEAAWDTMIYSVPEVQRITRVAAQIALAANPPLEIHSIDKANVLASSRLWRKVVTETLTNEYPQLKFDHQLVDSAAMVIVANPRKLNGVILTENLFGDILSDQSSVIPGSLGLLPSASLAGAPSSPSSADFKPTSGLYEPIHGSAPDIAGKGIANPIGTILSAAMLLRYSLGLEKPAAAIEAAVRKVLDNPEIGGLGLRTADLKGNVGTAELGDRIVEVLKTLL

SEQ ID NO: 16928 - protein, 416 aa, Exiguobacterium sibiricum 255-15
MEIKVPELAESITEGTVASWLKQPGDQVEKGEAIVELETDKVNIEVPSDEAGILSEVMAAEGDTVRVGETIAIITAGGEAAQQAATTPAPEQKEAPVAQEAKKEQPAPVAATEATSVADRPIASPAARKMAREKGIDLAQVATQDPLGRIRVQDVATFEVAPREQAKAPQAPAPQATPSAAPGKPEERIKMSRRRKTIANRLVEVQQTAAMLTTFNEIDMSAVMSLRKRRQEKFVKDNEVKLGFMSFFTKAAVAALKKMPYLNAEIQGDEIVLKKFYDIGIAVSAPDGLVVPVVRDADKKNFGEIEKDIINLAVKARDNKLGLSDLTGGTFTITNGGTFGSLMSTPILNGPQVAILGMHAINLRPVAIDAERMENRPMMYVALSYDHRIVDGKEAVTFLKHIKDLLEDPESLIFEA

SEQ ID NO: 16929 - protein, 149 aa, Salmonella typhimurium LT2
MTSEKLSAACHCGSVVFTVQLSDGFHTARRCNCSFCRMRGAVAVSAPLSGIKVLKGQDKLTEYRFNTGKAVHFFCSVCGIYTFHQRRSNPDQYGVNVACIENMSPFDFACVEVNDGVTHPSDGGSSGVVGYLRYKPKKSPPVETGGKNI

SEQ ID NO: 16930 - protein, 333 aa, Pseudomonas syringae pv. tomato str. DC3000
MTLRIAINGFGRIGRNVLRALYTQGYRQDLQVVAINDLGDSEMNAHLLRFDTVHGPFSGTVECDKESLTVNGDRISVSAIRNPAELPWKAQDIDVVFECTGLFTSRDKAAAHLTAGARKVIISAPASGADATIVYGVNHDTLRQSHQIISSASCTTNCLAPVAQVLHRELGIESGLMTTIHAYTNDQNLIDVYHTDPYRARSATQSMIPSKTGAAEAVGLVLPELAGKLTGMAVRVPVINVSLVDLTVTLKRETTAEEVNALMKEASQHSKVLGYNTLPLVSHDFNHNPLSSIFDANHTKVSGKLLKVLSWYDNEWAFSNRMLDNCLALHNAE

SEQ ID NO: 16931 - protein, 392 aa, Oryza sativa Japonica Group
MRRSLVIVMVACSCATAIARGGGGGGLKLNFYSESERCPRAEEVVREEVRRLYEEHGNTAVSWLRALFHDCMVYSCDASLLLHTTTTTGVSEQSSHRSFGMRNFKYITAIKAAVERECPATVSCADILALAARDGVAMLGGPSVAMRTGRRDSRESYYGVVEQYIPNHNDSVSTVLSRFAAIGVDTEGAVALLGAHSVGRVHCFNLVGRLYPQVDGSMEAAYGEYLRGRCPTAAATEDTREVVYARNDRVTPMLIDNMYYRNLLAGRGLLLVDQQLASDARTAPYVRRMAADNDYFHQRFAAALLTMSENAPLTGAQGEAFGLSSLARGGTLLPPTSSRVKLGRLSLLSGKKGAKAALLNDDDYEPPAPPLPPGDGDDDEEPINLVFKGGDD

SEQ ID NO: 16932 - protein, 262 aa, Lactobacillus acidophilus NCFM
MVYSELKNRVAVVTGGSKGIGTAISERFGKEGMKVVINYHSDEKGAQEAADAVKKNGGDAVIVQADIGSEEGAQKLIDAAVNNFGGLDIWVNNAGMENQVATKDMSLEDWNRVINVNLTGVFLGTKMALRYFTDHNKKGNIINMSSVHEQIPWPTFAHYAASKGGVKLFTETVAMEYAKQNIRVNAIGPGAINTPINAKKFADPEQKATTTSMIPMGRIGDPEEVAAAAAWLASDESSYVTGITMFVDGGMTLYPSFQGGRG

SEQ ID NO: 16933 - protein, 290 aa, Candida glabrata CBS 138
METEHQADKNAELGYDSGSTVAPPNKYSTLRSRFNLGPDTMRNHVIAFFGELVGTFMFLWCAYVIANIANHDVLLDVYPDGSHPGQLIMIALGFGFSVMFSIWCFAGVSGGALNPAVSLSLALSRTITPMRCIVMWVAQMLGGMAAGGAASGMTPGPVLYANTLGNGCSRTRGLFLEMFGTTILCLTVLMTAVEKGESNFMCALPIGISLFIGHLALTGYTGTGVNPARSFGAALAARSFPVYHWIYWIGPLLGAILAWFVWQVLQWLDYSSYVTREKEAAAKTKVMVEP

SEQ ID NO: 16934 - protein, 495 aa, Zea mays
MCAYHMRLTGGAAFVLLMVLLLLLYAVHRWRNPRCSGRLPPGSMGLPLVGETLQFFSPEASLDVPRFVRHRLQRYGPIFKTSLVGHPVVVSADEELNYMVFQQEGQLFQSWYPDSFVEILGRDNVGEQQGAMFKYLKNMVLRYFGPESLRESMLRDVEHAVSSSLCTWSTLPSVELKEAVSTMVFDLSANKLLSLEPSRSKILRRSFFDFVRGLISFPLYLPGTAYYSCMKGRQSAMEVLQEVLAERKRLVQVPGAGGGAMETIRRHGGDFLDLVIQEVTKEKPLVTDRMALDLMFVLLFASFHTTSLALTLAVKLLADHPRVLEELTVEHEAILNERNARHGSDGITWMEYKSMTFTSQVINETVRLANIAPGIFRKALKDIQFRGFTIPAGWGVMVCPPAVHLNPVIYPDPLIFNPTRFKDKPEINRGSRHFMAFGGGLRSCVGADFSKLQMSIFLHFLVTRYRWRSLGGGKVVRNPGLEFPDGYHIQIRHWN

SEQ ID NO: 16935 - protein, 350 aa, Brassica napus
  misc_feature (157)..(157): Xaa can be any naturally occurring amino acid
  misc_feature (245)..(245): Xaa can be any naturally occurring amino acid
LERPKTLKTKGSPFVFLPPLSNSKHCDEKDMDMETDQIYQIDVGNLLAFNPNHRFSSAPSSREELVKECVTEGTKLVQAIADTLFNLPSTETNDGPLVQLPPPTTKLPREKHLPRPKPPTKWEEFALKKGIQKRKKDKIVYDETTDKFKRRHGYDRXVNDDNDIPIIEAKASDEPGEDPFAKRLDDKKKRVDKQQQNRLQNLKSAAKAGALPSHVQLAASALPITGTKAQPKKLGKEELGDVAGXLAATSTASGGKFDKTLPGEKPPKKQGKHHKYLPVVPRYGWVDEEKEQTNKVLGKLLSKHSHEILNVGKAINMYNDKKEKKKSGRSDKLKAKKDITKKKPYANKAN

SEQ ID NO: 16936 - protein, 202 aa, Brassica napus
PTRPAFARAVANLCNKITVHNADTLMTLVRSRPPGVPLITVSNHMSTLDDPVMWGGFKGLLSLDPELARWVLAAEDICFKNPVFSYIFRTGKCIPITRGGGIYQEHMSEALERLKEGYWLHTFPEGKVFQEDVPIRRLKWGTASLIARCPVTPIVLPIIHRGFDEMMPEKYIYGRRPPLPLWNKNLRVVVGEPIEFDVPMMV

SEQ ID NO: 16937 - protein, 460 aa, Candida glabrata CBS 138
MSSQVNEPEFQQAYHEVVSSLKDSSLFEKHPKYAKVLPVVSVPERIIQFRVTWENDNHEQEVATGYRVQFNSAKGPYKGGLRFHPSVNLSILKFLGFEQIFKNALTGLDMGGAKGGLCVDLKGRSDNEIRRICYAFMRELHRHIGADTDVPAGDIGVGGREIGYLFGAYRHYTNSWEGVLTGKGLNWGGSLIRPEATGYGLVYYTQSMIDYATKGKESFSGKRVAISGSGNVAQFAALKVIELGGIVVSLSDSKGCIISETGITTEQIASIAEAKIKFKSLEQIVGEYSAFAENKVEYVAGARPWTLVGKVDIALPCATQNEVSGDEAKALVAAGVKFVAEGSNMGCTPEAIDVFESSRATASAPGEAVWYAMGKNSNLGGVLTSGLEMAQNSQRMSWTSEEVDQELKKGMVNCFNDCIEAAEKYSNESNKNALPSLVKGGNIASFIKVADAMFDQGDVF

SEQ ID NO: 16938 - protein, 461 aa, Hyphomonas neptunium ATCC 15444
MTDTAYDYDLFVIGGGSGGVRAGRIAAQAGAKVALAEEYRMGGTCVVRGCVPKKFMVYSSTYGKHIKLSAGYGWSVGDVSYDHSAFMVALHAEVERLSAIYDRNLKNAGVDVFDDRAEFVDAHTLRLKKSGKTVTAGKILIATGGRPWMPSADELPGIEHAIDSNGVFEMDTLPKRMLIAGGGYIAVEFAHIFAGLGAEVTLVYRGETVLRGFDDEIRLAVHEGLKEAGVRVVTKCTFKSIEKTGGGLMVTMSSGNEIDTDVVLMAVGRRANTDDLGCDKAGVKLAEQGEVIVDEWSRTNVENIWAVGDVTGRVALTPVAIREGHAFADTEFGDKPWKMDHSNIPTAVFTQPEVGTVGISEAEARKTFGEIDIYKTKFRPMKNMLNGDQTRTFMKLVVRASDQRVLGVHVVGEDAAEMIQTAAIAVKMGATKQDFDQTCALHPSSAEELVTMRTKWVPEGV

SEQ ID NO: 16939 - protein, 132 aa, Glycine max
  misc_feature (115)..(115): Xaa can be any naturally occurring amino acid
MATIIAGIPTTSITRAGLVLKRPVGASSSTVLGLPAMAKAGKVRCSMEEKPSSSSNIGMGASLLAAAVAATMSSPAMALVDERLSTEGTGLPFGLSNNLLGWILFGVFGLIWALXFVYASTLEEDEESGLSL

SEQ ID NO: 16940 - protein, 185 aa, Methanosarcina mazei Go1
MESTITIENVVASTRLAEDFDLEKMMESGLEGAEYNKVKFPGLVYRINNPKAAFLIFTSGKVVCTGSKSIGNAHAAIINLANTLKSICCEKIDLEPDVRVQNIVASADLKTNLNLNTIAIAFGLENVEYEPEVFPGLIYRVEAPKVVVLVFSSGKLVITGGKCPEDCEEGLRIVKTEFDNLGLLY

SEQ ID NO: 16941 - protein, 69 aa, Vigna radiata
YFDAWKAYESNPFHPTQNPQGVIQLGLAENPQLTLDLIQDWIMKNPQASVCTPEGVKWFKYIANFQDYH

SEQ ID NO: 16942 - protein, 68 aa, Vigna radiata
YFDGWKAYERNPFHPTKNPQGVIQMSLAENQLCFDLIEDWILNNPEASICTPEGVHQFRNIANFQDYH

SEQ ID NO: 16943 - protein, 287 aa, Zea mays
MAAVLRRAVAQCFASSSSSSPATFGLRRFLQEQPAFRPAVPPDRFMPLADRIRDLGVGVAFPRINLDGLVPYADFLRLCCDAAGPDAGPSVARALDESGSVIVLGKTVFLRPDMVVVKAIENAIPVRHAAAAAAAEIDPAREEELRAMEAEKAEIDRAAAARVRRELWCGLTYLVIQTAGFMRLTFWELSWDVMEPICFYVTSMYFMAGYAFFLRTKKEPSFEGFFESRFAAKQKRVMRARGFDLRRYEELRRACGVAAPPLQARTPCASAGAARESGHCHSYCHCH

SEQ ID NO: 16944 - protein, 370 aa, Sulfitobacter sp. EE-36
MKTRAAVAVAAGQPLEVMDVNLEGPKRGEVLIEINATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 16945 - protein, 742 aa, Oryza sativa Indica Group
MAMPLFLGLAVLTLLVATAAAALPPPGCPRTCGGVAVEYPFGIGPNCSLSDGFSLDCVRDTPQLRLGPVKQQQTVRVLGVDLLHGKIRTTNAIASQCLDARTGKLVNTSWEGLNAAALPYRFSDEDNRFFAVGCSGVVLLQGTAAGADDRVVIGCISTCFGNASIRTGSCSNIGCCETAIPRGLNSYLLAMERMPGGSPVNRCFYATLMEAASFSFEAADAAADGFYRKSSNGTVPVVLSFVVGSETCKEAQTSDTYACLSDHSVCVDGAPGYVCNCSQGYTGNPYLPNGCVDIDECGPGKHGCPDGMICTNFPGGYNCSCPEGEYKSNKNGVLICESDQKRSSLSVSVIIVIGVSGGVVIAVIAILITYLMRQRRALADVKRKYFERHGGLLLYDELSTRPGNTFTIYTEEQLEQATNGFDDGNILGRGGHATVYMGIVPAGGDGLVVAIKRCKVMDETNKKEFGKEMLILSQVNHKNIVKLLGCCLEVDVPMLVYEFVPNGTLYHLIHGGGGGGGGGDGGVISFATRLRIAHESAESLAYLHSFASPPILHGDVKSSNILLDESFMAKVSDFGASILAPTDEAQMVTMVQGTCGYLDPEYMRTCQLTEKSDVYSFGVVLLELLTGKKPLCLDGPEEERSLSARFVAAMGERKVGEMLDEQVKREASGESLEEITRLALECLQMCGADRPAMKEVAERLGGLRKLHQHPWTQDAVELEEARCLLHGSPEYQLSARYTTGSR

SEQ ID NO: 16946 - protein, 341 aa, Rubrobacter xylanophilus DSM 9941
MKGVVWRGPREMAVEEIPEPEAGPGAVVLRTGAAGICGSEVEGYLGRMGNRTPPLVMGHEFSGTVVAVGEGVDEAWVGRRVAVNPLISCGECRLCRSGHENICPERALIGIHRPGAFAEYVEVPAGSLHALPEGVDLRSAALAEPLANGVHAAGLGLERGPAELAVVVGAGTIGLMCLQAAVLSGIPEVWAVEPHGGRRARALELGAGRAFPPGGEAEEAVREATGGLGADVVLDAAGAGETRRAAARLVRPGGTVVLVGLHEDETALGFHDVVRRQLALQGSYAYTPRDFERALGWLVSGEAGIGELPDPLPLERGPAAFEELVRGPSDRVKVFLGGEGA

SEQ ID NO: 16947 - protein, 630 aa, Listeria innocua Clip11262
MKQLKVENLTKTYGEKSLFENISLTITEGERIGLIGVNGTGKSTLLQIISGSESGDKGSVTKAKDYTIGYLAQDPVFNEEDTVLSAVFDGDTAALRAMRKYEEVLLAMSLDAENTKLHDAYTAASQEMDASAAWDMNTEAKTILERLGITDLTAKISELSGGQRKRVGLAQVLIETPDLLILDEPTNHLDFQSIRWLEEYLNRFKGAVLLVTHDRYFLDRVTNHMVELDRGSAYRYVGNYEKFMESKAIRMENEVRESEKNKNLYRKELAWMRRGPQGRATKQNARQDRFHDLEKKVKTKIDDSELAIDFVTSRLGKDVFELKNLEKRFDEKQVLQDFSLIIQPGERLGITGNNGTGKSTLLNMLAGKLTPDAGEVITGQTVQIGYYTQQNEEMDPDMRMIAYLQEAGEQVTTSGGEVISVSAMLERFLFPPNSHGKKIGSLSGGEKRRLFLLRILMERPNVLLLDEPTNDLDTQTLTVLEDYLESFNGTVITVSHDRYFLDKVVNKLLVFRAIGEVEIFYGEYSDYLKELEAKGKPAKSMKKMANTSAEKSSPEKKEKVKLTYQEQLEWDGIEDAISDLEQDIESLNETLEQTGADFTKAAEISELITAKESELEQMMERWEFLSQYAE

SEQ ID NO: 16948 - protein, 601 aa, Legionella pneumophila str. Paris
MNGHLLLNVFIFLAAASIMVPLASRFRLGSVIGYLTVGMLIGPFGLKLIGNAEQIMHFAEFGVVMMLFLIGLELEPIMLWKLRKLIVGLGGLQVLLTTIALSSAAVMMGYNLRASVAVSMALALSSTALVLQMLQEKNLLKTAEGETSFAVLLFQDIAVIPILVILPLLGNHHGINVAINPHTAASIAQLPKWLNAIVVAGIIGSIVLAGHYLSRYLFLIIAKTNIREVFTAFSLSLVVGITLLMETIGVSPALGAFIAGMVLANSQYKRTVEADIQPFKGLLLGLFFISVGMGINFNLLFSQMAVIIPIVLGLITIKALILFTLGKIFQLTKIQALGFALGLSQGGEFAFVLFQYSSTLKVISPEINSFFTLVVALSMLATPFLMLLYHRFMMPKLISKLPEREYDSIHEKNNIIIAGYGRFGQIIGRFLSGENIKVTVLEKNPEQVELLRKFGYTGYFGDANRLDLLKSAGATHAQLLIVTVGNPDTNLEIVKLAKEEFPQLKIFARARNRRHAYELHKAGVHYFKRELFDSSLTMTKEILKFLGYKPEEIEKKANAFQKHDEETLIKSFDFFEEEASLINFSRQAKGELERILQNNNP

SEQ ID NO: 16949 - protein, 435 aa, Coprinopsis cinerea okayama7#130
MLAEPDPNSSSSFHEEMPIRVTDRLPTEDETPRVRHLVLQRLAPSAAVTDDRLAEALKNSPHLESVVLSGVPETTDRTVVLLAQRANNLQGLNLSNCTQVTDVSILELANKALPLQWLILNGVTGLTDPSISAIAKSCSRLAELELCDLPLLTPLAVRDIWSFSRKLRTLRLANCPLLTDKAFPAPLSMIPTPDPGEEPDKPPPHTPATWIEELPSLFLRHTADNLRVLDLSSCNKITDNSIDGIVTHAPRIQSLILSGCSLLTDASLDSICKLGDHLDVLMLAHVSNITDRAVVQVARSCPNLRCIDVAYMSVFELAGLGRLRRLSLVRVHKITDIAIFTLAEHATHLERLHLSFCDGLSLDAIHLLLQKLGNLQHLTATGIPSIRRKGVERFSELPPPNCDPDQRAAFRVFTGDKVVALRKFLDKEERRRREQ

SEQ ID NO: 16950 - protein, 187 aa, Bacillus anthracis str. Ames
MLLIGTEVKPFKANAYHNGEFIQVTDESLKGKWSVVCFYPADFTFVCPTELEDLQNQYATLKELGVEVYSVSTDTHFTHKAWHDSSETIGKIEYIMIGDPTRTITTNFNVLMEEEGLAARGTFIIDPDGVIQSMEINADGIGRDASILVNKIKAAQYVRNNPGEVCPAKWQEGSATLKPSLDLVGKI

SEQ ID NO: 16951 - protein, 506 aa, Exiguobacterium sibiricum 255-15
MIYEIPNTQGSKVQYKDRYENFINGKWTAPVGGEYFDNVTPITGKVLCQVARSGKEDVELALDAAHAAKDAWGKTSVAERSNILNKIANRMEENLEMLAYAETLENGKAVRETLNADLPLAIDHFRYFAGVIRAQEGSIGELDNDTVAYHFHEPLGVVGQIIPWNFPILMAVWKLAPALAAGNCVVLKPAEQTPASILLMTELIEDLLPPGVLNIVNGFGLEAGKPLASSKRIAKIAFTGETTTGRLIMQYASQNIIPVTLELGGKSPNIFFADIMDADDAFFDKAIEGLLMFALNQGEVCTCPSRALIEESIYEPFMERVLERVKAIKLGNPLDADVMMGAQASSEQMEKILSYLEIGKSEGAECLIGGERNHLDGDLADGYYIQPTIFKGNNKMRIFQEEIFGPVLSVTTFKTEEEALQIANDTLYGLGAGVWTRDMNRAYRFGRAIEAGRVWTNCYHQYPAHAAFGGYKMSGIGRENHKMMLNHYQRTKNLLVSYSPDKLGFF

SEQ ID NO: 16952 - protein, 148 aa, Bacillus pumilus SAFR-032
MDKTFLMVKPDGVERQLIGEIVSRFEKKGLQLVGAKLMSIPKEVAETHYGEHKEKPFFGELVDFITSGPVFAMVWQGEQVVDVTRQMIGKTNPKEALPGTIRGDYGLTVGKNIIHGSDSPESAEREINLFFKQEEITNWDQTISSWIY

SEQ ID NO: 16953 - protein, 443 aa, Lactobacillus acidophilus NCFM
MKKYDYIILGSGPVAIHLLAKLERTTNKVLLIEKGLWGGTCPNTGCQPKIFMEGTVRPVLNSYYLAGKGIKEAAKIDWPTLVARKKKIWTAFHKNERKSMTSEHTDTVQGKGVITGPHTVKVGDQEYEGKNIVIGTGLAPRDLDVPGNEYAITNNEFFDLDKLPKRAIVIGGGYVAMELATILQAAGAEVTILQHSDRLLRPFDQEMVGTLKRIMEDRGIKFHLNAPVKEIAKDGDQYTVTTENGDTFDTDLVINAAGRKPNVEGIGLEDVGIEFDPNKGIKVNEHMQTNIPSIFAAGDVADNGQPSLTPVAWVDAYHIINFVENGITDPIQYPPVATNAFTYPEIAQVGICEDEMEEGDYIKTLDLSDMFFSMGEGDSHAKLKVILNKNGEVRGASELSIHAAEDINNFVPLVGRKDPKKFVEENLTFAFPTPANNLDTLFR

SEQ ID NO: 16954 - protein, 234 aa, Bacillus pumilus SAFR-032
MQQSKEQRVHGVFEKIYKNYDQMNSVISFKQHKKWRDKTMKLMNVQKGAKALDVCCGTADWTIALADAVGDKGEVKGLDFSKNMLSVGETKVKSGGYNQIELLHGNAMELPFEDNTFDYVTIGFGLRNVPDYLTVLKEMTRVVKPGGMVVCLETSQPEMIGFKQGYYVYFKYIMPLFGKLFAKSYQEYSWLQESAKAFPGMKELAALFEEAGLSDVSYHPFTGGVAATHIGKKL

SEQ ID NO: 16955 - protein, 357 aa, Oryza sativa Japonica Group
MESDASTSPRRSDSSDSSTCSDGDDLLSSSSPKGTGIHRLPPLPCATDGAIAALVEELESPASSLDDLRRAAMELRLLAKHSPDNRLRIVAAGALPPLVALLSRPDPLLQEHGVTALLNLSLREDNRGAVVDAGAVGPLVRALRSAASPAARENAACTLLRLAQLDGSAAAAIGRAGAVPVLVSLLESGGARGKKDAATALYALCSGAPEENGPRAVEAGAVRALLELMGEPERGMVEKAAYVLHALVGTAEGRAAAVAEGGVPVLVEMVEGGTPRHKEMATLCLLHVCEDNAAYRTMVAREGAIPAARRALPLIRRATKAQSQGRGVGRVAAAAEEREPVAGAAVGGGFKVAGRSL

SEQ ID NO: 16956 - protein, 159 aa, Cytophaga hutchinsonii ATCC 33406
MKIKVGFGYDVHQLKEGRPMWLGGIQLEYTKGPDGHSDADVLIHAICDAILGAANMRDIGFHFANTDDRWKGVDSKVLLKEVCRMIREKGWEISNVDASLALEMPKINPHIERMQTALSEAMSIPVEDISIKATTNEKLGYVGREEGVNAYAVALLIKP

SEQ ID NO: 16957 - protein, 178 aa, Glycine max
MDHDKTGCQSPPEGPKLCINNCGFFGSSATMNMCSKCHKAILFQQEQGARFASAVSGGTSSSSNILKETFAATALVDAETKSVEPVAVSLQPSSVQVVVAEVVAPEAAASIPKEGPSRCATCNKRVGLTGFKCRCGDLFCGTHRYADIHNCSFNYHAAAQEAIAKANPVVKAEKLDKI

SEQ ID NO: 16958 - protein, 248 aa, Glycine max
MGGIAFGRLDDSFSLTSIKAYIAEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 16959 - protein, 404 aa, Hyphomonas neptunium ATCC 15444
MTRKFSIGPGALVAAAFIGPGTVTACTLAGANFGFALVWALVFATFATIILQEMTVRLGILGGAGLGEALVAPGTPAALKWGAIVLVLAALALGNAAYEAGNITGGALGMRAILGEGEGIQRITALATGLLAALILLLGRYKTLERVLIGLVLLMSLAFAASLVLVRPDIGSMIGGLRPTLPDGSLLTAMALIGTTIVPYNLFLHAAAVRERWKENTEAGLNAAIADTRVSVGLGGLISILVLSTAAASLFGAGMVISSGADMASALEPAYGSAARILAGAGLCAAGLSSAITAPLATAYAVCEVTGRPKSGWFFKGIALAIVFIGLSVALLGIRPVELILIAQVANGLLLPVVAAFLLITMNRKSVLGSHTNGPVRNALGVLVVLVAAFLGLRLILRALGIWP

SEQ ID NO: 16960 - protein, 384 aa, Petunia x hybrida
MGSSQKWVIGLLLFSSIFFELTAITLADDKLEESRWGNDNGCGFGRRGCGGGRFGGRGPSFGRGRGAGGGFGGGAGGGAGGGLGGGGGLGGGGGAGGGGGLGGGGGAGGGFGGGAGGGAGGGLGGGGGLGGGGGGGAGGGGGVGGGAGSGGGFGAGGGVGGGAGAGGGVGGGGGFGGGGGGGVGGGSGHGGGFGAGGGVGGGAGGGLGGGVGGGGGGGSGGGGGIGGGSGHGGGFGAGGGVGGGVGGGAAGGGGGGGGGGGGGGGGLGGGSGHGGGFGAGGGVGGGAAGGVGGGGGFGGGGGGGVGGGSGHGGGFGAGGGVGGGAGGGLGGGGGAGGGGGIGGGHGGGFGVGVGIGIGVGVGAGAGHGVGVGSGSGSGGGGNGR

SEQ ID NO: 16961 - protein, 287 aa, Hyphomonas neptunium ATCC 15444
MTSQPSLLFVFGLGYSAQQLASRLLAAGWQVAGTVRSEAKAAELRSRGIDARVWSGEGPVEVPEGAHWLVTLPPGKDGCPAAQSVLKCPDLSRSVTYLSTTGVYGDLNGGWVTERSPVNPGSPRAAARVKAEGQWQALTGDTARLVRLPGIYGPGRSAFDRLRDGTARRIVKEGQVFSRIHVDDIASGLEALMQRPEITGVFHLCDELPAPPQDVIAHAAGLLGIDPPPEVPFDAASLSPMAASFYAECKRVSNARAKAALRWRPAYPTYREGLAAILAAETGKIFP

SEQ ID NO: 16962 - protein, 222 aa, Hyphomonas neptunium ATCC 15444
MTDTLNQDIANRRAAILAALTAAHAPPPELIAVSKFQPDEAIEAALAAGQRVFGENRVQEAQQHWQARRETYADLTLHLIGPLQTNKAADAVRLFDVIQTLDREKLADALAAAMEKEGRRPKMLIQVNTGEEDQKAGVFPSKVGALLRYARESANLEVDGLMCIPPVDEPAGPHFALLKKIAKDYGLPVLSMGMSGDYELAARYGATHVRVGTAFFGERNTG

SEQ ID NO: 16963 - protein, 252 aa, Phaseolus vulgaris
MATSKVLLSNVLFVFVCFGICSAARTLLTLEDRVNLHVGTVVGGYGGGGGSGGGGGGAAVELGGGGYGEGAGGGEGAGAGYGAAGGGHGGGGGNGGGGGGGADGGGYGGGAGKGGGEGYGGGGANGGGYGGGGGSGGGGGGGAGGAGSGYGGGEGSGAGGGYGGANGGGGGGNGGGGGGGSGGAHGGGAAGGGEGAGQGAGGGYGGGAAGGGGRGSGGGGGGGYGGGGARGSGYGGGGGSGEGGGHGGGYYP

SEQ ID NO: 16964 - protein, 458 aa, Streptococcus agalactiae NEM316
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 16965 - protein, 402 aa, Vitis vinifera
MSDSLGAAAFMMKPKNFLQNIMKPFKFSSSKEGQKEEDLEKIAAQEQKLFPFETLVAATKNFHQKLGEGGFGPVFKGRLEDGREIAVKKLSQNSNQGKKEFENEAKLLARVQHRNVVNLLGYCTRGAEKLLVYEYISNESLDKFLFKTGRREELDWKRRYDIVGGIARGLLYLHEDSHSCIIHRDIKASNVLLDDKWAPKIADFGMARLFPEDQTHVNTRVAGTNGYMAPEYVMHGHLSVKADVFSFGVLILELISGQKNSTFDVNLDAQNLLEWAWKLYKKGRSLEVLDPSLASSAVAEQVAMCVQIGLLCTQADPQSRPNMRRVVVMLSKKPGTLEEPTRPGYPGSRYRRSRRPTTSASTAGTSGESSHTFESTTNSATATTSGVASPRLDSRGKRPVQG

SEQ ID NO: 16966 - protein, 198 aa, Streptococcus agalactiae NEM316
MAEEFLNTHNASILLSAANKSHYPQDDLPEVALAGRSNVGKSSFINTLLGRKNLARTSSKPGKTQLLNFYNIDDKLRFVDVPGYGYAKVSKTERAKWGKMIEEYLVTRDNLRVVVSLVDFRHDPSADDIQIYEFLKYYEIPVIIVATKADKIPRGKWNKHESSIKKKLNFDKKDHFIVFSSVDRTGLDESWDTILSEL

SEQ ID NO: 16967 - protein, 164 aa, Neptuniibacter caesariensis
MRHIISVLMENEPGALSRVVGLFSQRNFNIESLTVAPTEDETLSRLTVTTIGDDRVVEQITKQLNKLIDVVKVVDLTEGDHLERELMMIKMKANNGTVRAEIKRTADIFRGTIIDVTPNTFTVQLVGSSSKLDAFIEALGTSNIMEVVRSGVSGIARGEKVLTL

SEQ ID NO: 16968 - protein, 406 aa, Magnaporthe grisea 70-15
MSFSGMLNRLHGQPESYDKKSKYRFGKTLGAGTYGIVREAEGQTGKVAIKIILKKNVKGNERMVYDELEMLQRLQHPHIVRFVDWFESRDKYYIVTELATGGELFDRICEQGKFTEKDASQTIKQVLGAVDYLHSKNVVHRDLKPENLLYLSKAPDSDLVLADFGIAKMLDSRDEVLTTMAGSFGYAAPEVMMKKGHGKPVDMWSMGVITYTLLCGYSPFRSEGLQDLIEECSNAQVTFHDRYWRDVSEDAKNFIRSLLQANPDDRATSGQALRHPWLSGENATDHNLLPEIKSFMAKARLRRGIEMVKLANRIQTLKLQEEDPDNTDMPDDAVEAADDSQGNAGSSGGSGLFKPGEKKTMSKAVKGAIFREVVLAKVREMKTQEETLKVAEEVEKEARRKSFTGS

SEQ ID NO: 16969 - protein, 308 aa, Arabidopsis thaliana
MATTIRTGGYYSTHQEYSIDVFGNTLSVTVTSDFAIISQWIHEVEYNNCRPYYLQPLVVGVGVQWTPPVSYDANPPPDRYYSDHHPPRSYDPNPPPNRYYSDHHPPRSYDRNPPPNRYDANDLPPNRYYDHQTEGYYEHSAPRDHNADPLEDNESAHPPRASYCADPYPGDYISDGDSNSDPPADTLQLCVGNQCLIIQLCHCDQVPTSLRSFLTDPNTTFVGVWNSQDAGKLARSKHQLEIGKLLDIRGCSFEEIVDEFLGSPGSGLRLDPAISMSDWSVHVLDRDQVLQASIDVHVCHLLGVMARL

SEQ ID NO: 16970 - protein, 225 aa, delta proteobacterium MLMS-1
MENKPVNGPRLAPSILSADFARLGEEIRAVEAAGADIIHVDVMDGHFVPNLTIGPPVVAAARRVTELPLDVHLMMVNPQDYVEDFARAGADWITIHVETGYHLHRTIHRIKELGKRAGLVLNPGTSLASLDYLLAEVDLVMLMSVNPGFGGQSFIPSALAKIRQLRQMIDQRGLKVEIEIDGGVTPATIGEIYRAGTDICVAGSAVFGRDDYAGAITELRQQALA

SEQ ID NO: 16971 - protein, 471 aa, Mycobacterium smegmatis str. MC2 155
MVTRIVILGGGPAGYEAALVAAARGPEVADVTVVDCDGIGGACVLWDCVPSKSFIAATGVRTELRRAPRLGYSIDFEQAKVGLPLLNERVKALAAAQSRDIADRLRSEGITLIAGRGELIDDVPGMAHHRIKVTGHDGTVQQLTADVVLIATGASPRVLPNAEPDGERILNWRQLYDLDTLPEHLVVVGSGVTGAEFVNAYTELGVDVTVVASRDQILPHEDSDAAAVLEQVFAQRGVTLVKNARAESVTRTGDGVLVTMTDGRTVDGSHALMTVGSVPNTSGLGLERVGIELGAGGYLTVDRVSRTQVPGIYAAGDCTGLLPLASVAAMQGRIAMYHALGEAVAPIRLRTVAAAVFTRPEIAAVGVPQAKIDDGSVPARTLTLPLATNARAKMSSLTHGFVKIFCRPATGVVIGGVVVAPIASELILPIALAVQNGIPVSELAQTFSVYPSLSGSITEAARQLMQHDDLD

SEQ ID NO: 16972 - protein, 333 aa, Streptococcus thermophilus CNRZ1066
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDQAYGIKYVPLRYFNVAGAKPDGSIGEDHDPETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDILIASSEKARTVLGWKPQFDNIEKIIASAWAWHSSHPKGYDDRG

SEQ ID NO: 16973 - protein, 364 aa, Ipomoea batatas
MVTTISATVPSRVERLAGSGIERIPKEYIRPEEERPSIGDIFAEEKMGGGPQVPTVDLKRINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRQTDQEGADTPKPDE

SEQ ID NO: 16974 - protein, 489 aa, Exiguobacterium sibiricum 255-15
MKRRDQFMNVPRQAGKERDSSERIGDFNEYKERFSETEASEQASRCMDCGTPFCHVGETYSQVKIGCPVYNLIPEWNVLVEQGNFQEALERLQETNNFPEFTGRVCPAPCEGSCTLSINEPAVTIKQIERTIIDIGFENGWVQPRIPSVRSQHRIAIVGSGPAGLAAADQLNQAGHHVTVFEREDQVGGLLTYGIPAMKLSKDIVARRVRLLETEGITFKTGVTIGLDVSLDQLEADYDAVILCVGATEPRKIPDAPGQGVGYAMDYLTSVTRQLLTGQSLIDLHDTRGKDVLVIGGGDTGADCVATALRQGCRSVVQFGKHQMPGSTRTADNMWPDTPNLFTLDYGYEEAHVQFGRDPREYLIAIERYTTDEAGRLTGVWTIYNDKIRHADGRVEFQKLPGTEKYYPVDTMLIAIGFSGVEQDVLRHLPVASQNGKIKTMAYATDRPGVFAAGDARRGQSLIVWAIREGREVAEKVEQHLLTVHKQTG

SEQ ID NO: 16975 - protein, 282 aa, Zymomonas mobilis subsp. mobilis ZM4
MMSPISIPSIRLNDGNDLPAVGFGTYKLNGSAGVSDIVSAIKVGYRLLDSAFNYENEGAVGEAVREAGIARDKLRIVSKLPGRHHHFEEAIATVEESLYRAQLDYYDLYLIHWPNPSKDLYVEAWQALIEARKKGLIRSIGVCNFLPEHLERLIKETGVTPVVNQVELHPYFPQEEQRAWDKAHGIVTESWSPLGRASKLLQDDTIKKIADRLGKSIPQVILRWHVQLGAIPIPKASSKERQIENLSLFDFELSPQDVEIIATLARPDGRLADQDPARYEEF

SEQ ID NO: 16976 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPEPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 16977 - protein, 504 aa, Chlamydomonas reinhardtii
MSRPPRPAPARCCMLMATPGFGSCAVRGGQGCEAAASSRRVEESCPASLCAGCCYVLSDREQDRQPRGEVCSSIILGGGAGTRLFPLTKSRAKPAVPIGGAYRLIDVPMSNCINSGISKIYILTQFNSTSLNRHLGRAYNMGSGVRFGGDGFVEVLAATQTPTDKEWFQGTADAVRQYSWLLEDTKNRAIEDVLILSGDHLYRMDYMKFVNYHRETNADITIGCIAYGSDRAKEFGLMKIDEKRRVTSFAEKPKTQEALDAMKVDTTVLGLTPEEAAEKPYIASMGIYVFKKSVLLQLLNDSYAKANDFGGEIIPSAAKDHNVVAYPFYGYWEDIGTIKSFFEENLKLCRHPATFEFYDPQSPIYTSPRVLPPATVRNCKVTDAIIAQGSFVSDCTINNAVIGIRSIIGQNCTIQDALVMGADYYESDDQRATLLKKGGVPVGIGANSVITNAIIDKNARVGKNVKIVNKEGVTEGTREAEGIYIRSGIVVIDKGALVPDNTTI

SEQ ID NO: 16978 - protein, 345 aa, Bacillus pumilus SAFR-032
MKKITVLGAGSWGTALALVLADNHHDVHMWGHRQELIDQIDEKHENHDYLPNVALPASIKATTDMKQALEGTDAIIVAVPTKAIREVLKRANELITSKVPFVHVSKGIEPDTLLRISQMIEQEVPDEKREAVVVLSGPSHAEEVGLRHPTTVTVSSENIEAAQFVQDLFMNNNFRVYTNPDVIGVEIGGALKNIIALAAGITDGLGYGDNAKAALITRGLAEIARLGTQMGGNPLTFAGLTGVGDLIVTCTSVHSRNWRCGNLLGKGYKLEEVLEKMGMVVEGVRTTKGAYQLSKEYKVSMPITEALYHVLFEGKKVDDAVESLMARVKTHEMEDLVNMFENQTK

SEQ ID NO: 16979 - protein, 371 aa, Bdellovibrio bacteriovorus HD100
MAGKRDYYEILGVEKGADQDTIKKAYRKLAMQFHPDKNPGNKEAEEKFKEAAGAYEVLSDAQKRAQYDRFGHDAFTRGGGGGGFTDAEDIFSHFGDIFGDFFGGGMGGQQRQRRNRNEPRRGSDLRYVTEITLKDVITGIEKEIEFDTDKNCDECKGTGAEKGSQVSTCGTCGGSGQVVRQQGFFAMASTCPTCHGQGTVIKNPCKPCKGKGRVAEHRKIRLNIPAGVDTGTRLRVATEGEGGYMGGPPGDLYVEIRVKQHNNFERRNEDLFAELSLPYVQMLLGAEIEVPTVTGKAKLEVPKGTHHGDNVKLVGEGLPSLRGNRRGDIYFTVNVQFPEKLHKDEEKLLREIAKARGLNVTSEGGFFGKKK

SEQ ID NO: 16980 - protein, 349 aa, Zea mays
MDSHAAGSSSGGSGDGGAQPRRSSRKPKYSKFTQQELPACKPILTPKWVISVFVLVGVIFVPIGIVSLQASRQVVEIVDRYDDACVPAGVTDKLAYIRNDSIPKSCTRNLTITKDMKQPIFVYYQLDDFYQNHRRYVKSRNDAQLRDKSKATDFTNCDPEAKTVDGKPIVPCGLIAWSLFNDTYKLIHNNVTLRVEKKDISWKSDRDHKFGSDVFPTNFQKGPLKGGKTLDPSIPLSKQEDLIVWMRTAALPTFRKLYGRIYVDLKENDTITVQLDNNYNTYSFGGKKKLVLSTATWLGGKNDFLGLAYLTVGGLCFFLAFAFTLLYLIKPRKMGDNSYLSWNRPPSGR

SEQ ID NO: 16981 - protein, 465 aa, Phaseolus vulgaris
MATIHRLPSLVFLVLLALGVCSARRALLTLDAGYGLGHGTGGGYGGAAGSYGGGGGGGSGGGGGYAGEHGVVGYGGGSGGGQGGGVGYGGDQGAGYGGGGGSGGGGGVAYGGGGERGGYGGGQGGGAGGGYGAGGEHGIGYGGGGGSGAGGGGGYNAGGAQGGGYGTGGGAGGGGGGGGDHGGGYGGGQGAGGGAGGGYGGGGEHGGGGGGGQGGGAGGGYGAGGEHGGGAGGGQGGGAGGGYGAGGEHGGGAGGGQGGGAGGGYGAGGEHGGGAGGGQGGGAGGGYGAGGEHGGGAGGGQGGGAGGGYGAGGEHGGGGGGGQGGGAGGGYAAVGEHGGGYGGGQGGGDGGGYGTGGEHGGGYGGGQGGGAGGGYGTGGEHGGGYGGGQGGGGGYGAGGDHGAAGYGGGEGGGGGSGGGYGDGGAHGGGYGGGAGGGGGYGAGGAHGGGYGGGGGIGGGHGGNVP

SEQ ID NO: 16982 - protein, 276 aa, Zymomonas mobilis subsp. mobilis ZM4
MTEYIHVKEGDAAIRTHAIKLYDENAFAGMRKAGRLAADVLDALVPYVKPGVTTEALDTLADDLIRQGGGVSACRYYRGYPKSVCISANHVICHGIPGPKALKSGDIINIDVTVIVDGWHGDTSRMFFVGDVPLKAKKLVDVTYQALMLGIEQAKPGNHIGDIGYAIQTLAAKHRYGVVRDFCGHGLGKVFHDRPEVVHVGIPGEGVELKPGMLFTIEPMINIGKPDVKILDDGWTSVTRDRSLSAQFEHSIGITEKGCEIFTKSAAGLDAPPYQV

SEQ ID NO: 16983 - protein, 649 aa, Oryza sativa Indica Group
MPLGQRAGDKSESRYCGVEVLDFPAGEELPAVLSHSLSSSFDFLLAPLVDPDYRPTPGSVLPVAASDLVLGPAQWSSHIVGKINEWIDLDAEDEQLRLDSEITLKQEIAWASHLSLQACVLPPPKRSSCANYARVVNHILQGLTNLQLWLRIPLEKSEPMDEDHDGAKDNSDMSDTVDSWEWWNSFRLLCEHSSQLCVALDVLSTLPSMNSLGRWFGEPVRAAILQTNAFLTNARGYPCLSKRHQKLLTGFFNHSVQVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTVLMVVGAGRGPLVRASLQAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKVWYEWAVTAPSPSPIHNSNGRSYWVGL

SEQ ID NO: 16984 - protein, 174 aa, Coffea canephora
DIETLKQELLEAIAPLDRGAEATAEDQERVDQIARKLEAVNKVKEPLKSSLLNGKWELLYTTSKSVLQPQRPKLLRPNGKVYQAINVDTLRAQNMETWPFFNQATANLVPLNTRRVAVKFDSFKIAGVIPIMERGSGRGELEITYLDEELRISRGNQGNLFILRMVDPSYRVPL

SEQ ID NO: 16985 - protein, 495 aa, Bradyrhizobium sp. ORS278
MCQHSRASLESFEMNAILKNFIAGEWVDGSGVTRNINPSNTNDVVGEYAKADKAQTEKAIAAAKAAFPAWSRSTPQERYDALNKISAEILSRKEELGRLLAREEGKTLPEGIGEVARAGQIFAFFAGEALRLTGEKGASVRPGLDVEITREAVGVVGMITPWNFPIAIPAWKIAPALCYGNTVVFKPAELVPGSAHALSEIIARSGIPAGVFNLVVGSGSVVGQTLLEHPDVAAISFTGSVGTGRKIAQACVLSNPMKKFQLEMGGKNPLVVLDDADVKVAVEAAANGAYFSTGQRCTASSRLIVTEGIHDKFVAALTERLKGLVVDDAVKQGTHIGPVVDGNQLEQDQRYLKIGQDEGAKLAWGGELLNRESPGFYMQPALFTEANNNMRIAREEIFGPVACVIRAKNYDEALAISNDTEFGLAAGVCTTSLKYASHFKRNSEAGMVMVNLPTAGVDYHVPFGGRKGSSYGAREQGSYAREFYTTVKTAYTFPV

SEQ ID NO: 16986 - protein, 169 aa, Synechocystis sp. PCC 6803
MDLSRIPAQPKAGLINVLIEIPAGSKNKYEFDKDMNCFALDRVLYSSVQYPYDYGFIPNTLADDGDPLDGMVIMDQPTFPGCVITARPIGMLEMIDGGDRDEKILCVPAKDPRYTYVKSINDLAGHRLDEIAEFFRSYKNLEKKVTEILGWKDVDAVLPLVEECVKNYK

SEQ ID NO: 16987 - protein, 284 aa, Streptococcus agalactiae NEM316
MTTFTAKFIDQEWEVPVESGRYHMIVGEFCPYAQRPQIARQLLGLDKHISISFVDDVPSDIGLIFSQPEQVTGAKSLRDIYHLTDPTYKGPYTIPILIDKTDNRIVCKESADMLRLFTTDFSDLHQEDAPVLFSQETASLIDNDIKDINNNFQSLMYKLAFLDKQADYDTYSKEFFTFLDQKEHLLGQRPFLLGDNLSEVDIHFFTPLVRWDIAGRDLLLLNQKALEDYPNIFSWAKTLYNDFNLKTLTNPQSIKNNYYLGKFGRAVRHHTIVPTGPNMVKWEK

SEQ ID NO: 16988 - protein, 235 aa, Brassica napus
MDSTMENCNGGISNGDVSGLSSKREKLIIDTDPGIDDSMAIMMAFQTPELDILGLTTVFGNVQTQDATRNALLLCEIAGFPDLPVAEGSSEPLKGGIPRVADFVHGKNGLGDVSVPSPCRKKCDKSAAEFLVDKVSQYPGEVTVLALGPLTNLAIAIKRDSSFASKVKKIVILGGAFFSLGNVNPAAEANIYNDPEAADVVFTCGADITVVGINITTQLMLSDDDLLALRGVQGG

SEQ ID NO: 16989 - protein, 314 aa, Streptococcus agalactiae NEM316
MDGKSISVKSYANIAIIKYWGKADAEKMIPATSSISLTLENMYTETRLTTLGKDAKKDEFYISGVLQNDHEHDKMSAILDRFRQNKSGFVKIETTNNMPTAAGLSSSSSGLSALVKACNDFFGTNLSQSQLAQEAKFASGSSSRSFFGPVAAWDKDSGDIYKVHTDLDLAMIMLVLNDKRKPISSREGMKICTETSTTFNEWVRQSEQDYQDMLVYLKNNDFQKVGQLTERNALAMHSTTKTATPAFSYLTEETYKAMDVVKKLREKGHECYYTMDAGPNVKVLCLRQDLEALAAILEKDYRIIVSTTKELADG

SEQ ID NO: 16990 - protein, 356 aa, Galdieria sulphuraria
MEHWSQYKDELIATAKALVTPGKGILAGDESTGTIGKRFASIQVENNEENRRSYRELLFTAPNFGHYISGVITFEETLYHKTSQGKPFVDVMKEAGVIPGIKVDKGVTPIPGTKDETSTQGLDSLLSRCQKYYETGARFAKWRAVIKISIADGCPSDVAIKENAWGLARYAAICQQAGLVPIVETRKFLWMEITLLKTLTSDREVLYEVYYALDQQHVLLEGTLLKPNMVLPGTDCKDKASPKKIAECTVRTLQRTVPAAVPGIVFLSGGQSEEEASVNLNAMNQVEMVKPWKLSFSYGRALQSSCLKAWQGKAENVRAAQEAFLARAKANGEATLGKYAGGTGNNESLFVKDYKY

SEQ ID NO: 16991 - protein, 433 aa, Bacillus anthracis str. Ames
MQPSAPPHLESTKTIFSNSITKLVVFICWLAILADGYDLGIYGAVLPKLLEDNSWALSPAHAGTIASYALFGMFIGAILVGTITDLIGRKWTLICCLALFSITMGLAALAPSPELFGLWRFIGGIGLGGVIPTASALTVEYSPKKRQSFIYALMFTGYPLGIVLGAILSMFMLEDFGWRIMFGIGMIPLLLIPFIIRYLPESIQFLLSRNRQEEVDKILNRFQIEFYAKDETHQAPSNIRKKNGFLTLFSKEYIKATLLFWITYIMGMFLIYGLNTWLPQMMRQAGYPLGSSLSFLLMLNITAAIGALFAGAIADRIGAKIVISISYLMAAICIGLLTIKPSVSIIYLLIGLAGIGSVGITQILNAYVTQYFPSHIRATSLGWGLGLGRVGAIAGPILVGIIMTMQYDLAWNFYLFSFAGLLAAISVFFIPTK

SEQ ID NO: 16992 - protein, 419 aa, Galdieria sulphuraria
MTVAFVGSTNFSANLFGSKNKHGLQSKSFLGVSVSSEHPISRVQFTPAGGKSRIVCLAWGVKGGVEKFADSLIETARSIASPGKGILAVDESTKTIGKRLASIGVENTEENRQAYRELLFTCEGLGQYISGAILFEETLYQNARNGKSFVDCLRGVGVIPGIKVDKGLSPLPGGEAIETWCTGLDGLSERAAAYYKQGARFAKWRAVLQISPETPTELCVQENARGLARYAKTVQEQGLVPIIEPEILMDGDHDIERTAQVQEHVLATVYKECDSNGVLLEGSLLKPNMTVPGADCKRQVSAEDIARYTIRTMERRVPSAVPGIMFLSGGMSEEEASVYLNVMNKIQRRGPWSLSFSYGRALQQSCLKSWKGKQENVKAAQEALLARARANSKANLGKYVPGSEPTLDKTGTFEKAYVY

SEQ ID NO: 16993 - protein, 942 aa, Coprinopsis cinerea okayama7#130
MLYRQFAPSTTSLSDEYDEDEPSQSNFFKADQPLFATDAAVHPHWSSSNQPGASSKRALKAPAKSPIMDLPPEILIAILKYLSSPRDLLNALKVSTTWCECAVELLWVRPTFPRYSTLQKMARLLKQSKSTFPYAKFIRRLNFMTLSSELRDETLAVFNRCSRLERLTLTGCKLITPTSLEQVLTCFPNLVAVDLSGVVETTTEVITAFAPVAKRLQGINLSNCSKVTDPALIALAENCPMLRRVKLSGVNLVTDAGVSAIVKKCPLLLEIDLHQCELITDVAVRDIWLYSTHMREMRLSQCTAITDLAFPALNSAVNPFPSNDPNVLPPLHVNRTFEQLRLLDLTACANITDDAVEGIIAHAPKIRNLVLAKCTALTDRSVEAICALGKHLHYLHLGHASRITDASVKTLARSCTRIRYIDFANCIKLTDMSVFELSALPKLRRIGLVRVTNLTDEAVYSLAERHATLERIHLSYCDQISVMAIHFLLLKLHKLTHLSLSGVPAFRNPDLQQFCREAPKRQNFCVFSGKGVSHLRAFLTQLFDTITEQNGTDDTEYEDEDVFPEPFQRAPEPETGDGDEDMVGPAYHVISPNVNTTRGTRFSRQEAISPRSYEVALQQRETQRRAHRTFADGFSAMFSAGGNIGVTTVHGAVSGPLDTNRITVELDPPDRLPVVEPVSPVSPPGNSAGITNTEPSATSASFFQGFQEPVFAPNQGARTPELHFAEIGHGRGASAQHVASPGSSRNHGSRSSARDRTPRQPHAAIAAAIHQSAHRGRSSNAHRPVSDPGSVSLDMNGEREGWSQQGNGVVLPGPSIRELEASVQSALNPSPSTARNGQRRQTDGSHRERQRGLRARAGRDGEEEQHHHHGGGGSSSRGRSVRRTIRNGLNAAENYASTFLFGRPWTEDGGSGPGQGSNGNHSVNQNNAGSSTTHATHWFGGR

SEQ ID NO: 16994 - protein, 393 aa, Listeria innocua Clip11262
MDLPLSKRVKGVAPSPTLAITAKAKQMKQEGIDVIGLGAGEPDFNTPQNIIDAAIESMNKGFTKYTPSSGILELKQAIVDKLKKDQSLTYEANQIFVGTGAKHVLYSAFQTILDPGDEVIIPVPYWVTYPEQVKLAGGVPVFVETGFDADFKISATDFEHAITEKTKAIVLNSPNNPSGMCYTKDELAAIGAVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELSSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 16995 - protein, 579 aa, Coprinopsis cinerea okayama7#130
MQPTTHFSDDYYQMGDASPVFQAQRDRYGGKDEDMPSGRSPRAHRAVNLELSGLPGTTIGNAYTAVAKVFNYTNPKNGRRETLIAVLQYLESYDLFGALRVSKAWCRCAVELLWFKPNFPRYSAVEKVARVLQLSSPAFPYAQYIRTLNFMKFGRELRDDVLSIFDRCSQLERLTLYGCAMITPTSLQRVFTCSANLIAIDLSGVTETTPEVIISLSQVARGMKGVNLSDCRVAESALLALADNCHGLVRIKLAGNALVTNAAVTALVSNCPSLVEIDLGRCPSIADVAVRDIWLHSKRIREVRLPHCTSLTDRAFPAVDPTPESEVPSRPPPLHIENSLQELRLLDLTGCSMITDATIEGIIARAPKIRTLNLAKCPALTDRSVKAICGLEKYLHHLELGHLTSLTDDSIKTLAGSCTRIRYIDLASCRNLTDVSVAALSSLTKLRRIGLVRVEKLTDEAMYSLAERHETLERIHLSHCTQISAEAIYFLLSRLLKLTHLSLSGIPGIMEHNVHGFSREAPPDLNSVQLQQFRVFSKEGIPELRNHLKEFYDTAPYSQSGAEAAGPPTTVYTFKDVLV

SEQ ID NO: 16996 - protein, 903 aa, Oryza sativa
MGKGKGGFCARVRGGAKLILIRCHCLGFRKDVDASIKFPSLALPLPMQIDRSLGHWQGVVVVALLGADGGGCGRDMVVCGGGGEQSLWRWFTDISNLSVSPAGGDNDGLERRSLLHFRPLGPIAGSRWERSSTRASAGGRRGAVRRRGRGRRPEGGEDRRVHSAGGRRGDAGGGRGEREKSATRSASTCSLTAPHAPTDSPPTSSRASTTASSTRHQRLLILEGDGGVERLLDLLDAADAAVDARAALEREDGAVVEAVEMDTERGGGAAEAGREEGGEAEVRGGDGARGRRGDGRPMRWDLEGAAPGGGWRRRLELEGGGVVVGVDEAVGVLAAAAVAVATQSKVCGCELKTHPRRAMATDGGVLQLHPYAMAAAAVALASAYMVWFWALSRRLSGPRMWPLVGSLPSVVLNRARVHDWIADNLRATGDAATYQTCILPLPFLARRQGLVTVTCNPRNLEHILRARFDNYPKGPMWQASFHDLLGQGIFNSDGETWLIQRKTAALEFTTRTLRQAMARWANRSIKYRLWRILDDHCNAAASVDLQDLLLRLTFDNICGLTFGKDPETLSPGLPENPFANAFDEATEATMQRFLFPSLLWRIKKAFGVGSERSLRDSLAVVDRHMTETIAARKATPSDDLLSRFMKKRDSKGKAFPEDVLQWIALNFVLAGRDTSSVALSWFFWTLMQRRDVERKVVLEIASVLRETRGDDTARWTEEPLNFDELERLVYLKAALTETLRLYPSVPQDSKYVVADDVLPDGTVVPAGSAITYSIYSVGRMESIWGKDCAEFRPERWLSADGSRFEPVKDAYRFVAFNGGPRTCLGKDLAYLQMKSIASAVLLRNSVELVPGHKVEQKMSLTLFMKNGLRVHVKPRDIASYVEPSEPAPPQGSLVIPTTTAAAA

SEQ ID NO: 16997 - protein, 506 aa, Burkholderia thailandensis E264
MNHADMQHLNIEFPYRKQYGNFIGGEWVAPIGGEYFDNVSPVTGRPFTAIPRSREADVELALDAAHAAKAGWAATDAAQRANVLLRIADRMEANLARLAVAETIDNGKPLRETTAADVPLAIDHFRYFAGCIRAQEGSIADIGGDMVAYHFHEPLGVVGQIIPWNFPLLMAAWKLAPALAAGNCVVLKPAEQTPASILVFAELIQDLLPPGVLNIVNGFGLEAGKPLASSKRIAKIAFTGETSTGRLIMQYASENLIPVTLELGGKSPNIFFADVMDRDDSYFDKALEGFAMFALNQGEVCTCPSRALVEESIYERFIERAIKRVEAIKQGHPLDSQTMIGAQASSEQLEKILSYIDIGRGEGAQCLTGGERNVLGGELAEGYYVKPTVFRGHNKMRIFQEEIFGPVLAVTTFKTEEEALEIANDTQYGLGAGVWTRDGNRAYRFGRGIQAGRVWTNCYHAYPAHAAFGGYKQSGIGRETHKMMLDHYQQTKNLLVSYSEKPLGFF

SEQ ID NO: 16998 - protein, 70 aa, Zea mays
MAEQTFIMIKPDGVQRGLIGEIISRFERKGFYLKGLKLVTVDRPFAEKHYADLSAKPFFSGLADYIVSGP

SEQ ID NO: 16999 - protein, 411 aa, Oryza sativa Japonica Group
MNALAATSRNFRQAARLLGLDSKLEKSLLIPFREIKVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIDLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 17000 - protein, 621 aa, Zymomonas mobilis subsp. mobilis ZM4
MLSFSAITVRLGGQLILDQATASLPPGSHVGLIGRNGAGKSTLMKVVAGLLEADSGELSMPRGTRIGYIAQEAPEGSATPYETVLAADEERSRLMEASETESDLEKLAEIHERLNTIDAYTAPARAARILAGLGFDETMQHQPLSAFSGGWRMRVALGALLFSAPDLLLLDEPSNHLDLEAVLWLENFLRGYRGTLLLISHERDFLNKVADHILHLQQGKLTLYPGGYDAFERQRAERLSQLESARNRQLAEREKLQSFVNRWRTKAHSARQAQSRMKALERMEPIAAAVEDPSLSFSFPSPDDNLKPPLITLDQAAVGYDDKPILTKLNLRIDPDDRIAFIGRNGNGKTTLAKLIVGQLPTVDGQMVTSSKIKVGYFTQYQVEELDVDDSPLDHMTRLMPGASTTAVRSQLGRFGFSGDKATQKVGSMSGGERARLALALITRDAPHLLILDEPTNHLDVDVRQALIEALADYQGAVIIVSHDRHMLELTADRLILVDNGKATDFDGDLNDYTNFILGKSDKPTSEAPVKAQDKKADKRARAEKRQQNKALRDEIKKLEGEISKLTSCRSEIDQALFDPDQASPKDKKLTVTQLMKSRADIEDELNKKEAIWLEKSEMLE

SEQ ID NO: 17001 - protein, 841 aa, Oryza sativa Japonica Group
MGIPEVVVPPRAAGPRRYKGLVPWRFQPGFVRPPPVKPPAAAAAVAGGGVAGTPGGKGRGLGASGEGVGSSGGRGDPQSRRCTRSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGNGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRSTDEYLFAIGHNYYDEALWEGLSRSIPSLQKGPDKDEEAGFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 17002 - protein, 200 aa, Hordeum vulgare
MASKSKGLVVLALLLAAAILVASADEHPQAKKEENEAGVENFFHGGGGHHGHGRGGHGGGGYGGGGGYGGGGGGYPGGGGGYGGGGGGYPGHGGEGGGGYGGGGGYPGHGGEGGGGYGGGGGYHGHGGEGGGGYGGGGGYHGHGGEGGGGYGGGGGGYPGHGGGGGHGGGRCKWGCCGHGFLHHGCRCCARADEVPEVRN

SEQ ID NO: 17003 - protein, 589 aa, Saccharomyces cerevisiae
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLGKVKKFINKNTILLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 17004 - protein, 424 aa, Bacillus pumilus SAFR-032
MAADQNAAHNAEDKLDVLKSTQTVIHKALDKLGYPQEVYELLKEPIRLLTVKIPVRMDDGSVKIFTGYRAQHNDAVGPTKGGIRFHPNVTEKEVKALSIWMSLKCGIVDLPYGGGKGGIICDPREMSFRELEKLSRGYVRAISQIVGPTKDVPAPDVFTNSQIMAWMMDEYSRMDEFNSPGFITGKPIVLGGSHGRDTATAKGVTICIKEAAKKKGIDISGARVVVQGFGNAGSYLAKFMYDAGAKIVGISDAYGGLYDEDGLDIDYLLDRRDSFGTVTKLFNDTITNQELLELDCDILVPAAIENQITEDNAANIKAKIVVEAANGPTTLEGTKILSDRGVLLVPDVLASAGGVTVSYFEWVQNNQGFYWTEEEVETRLEDMMVKSFNNIYEMAQNRRIDMRLAAYMVGVRKMAEASRFRGWI

SEQ ID NO: 17005 - protein, 327 aa, Trichoderma atroviride
MATDTSQKTLSSTTYTLNTGAKIPAVGFGTFANEGAKGETYAAVTKALDVGYRHLDCAWFYLNEDEVGDAIRDFLARRPDVTRKDLFICTKVWNHLHEPEDVKWSAKNSCENLKVDYIDLFLVHWPIAAEKNADRTVKIGPDGKYVINKALTENPEPTWRAMEELVDSGIVKAIGVSNWTIPGLKQLLEFARIKPAVNQIEIHPFLPNTELVEFCFQNDILPEAYSPLGSQNQVPTTGERVRDNPTLNAVADRRGSSLAQVLLAWGLKRGYVVLPKSSTPSRIESNFIIPELSEEDFAAIQKVAEGRHVRFVNMKDTFGYDVWPEDK

SEQ ID NO: 17006 - protein, 568 aa, Zymomonas mobilis subsp. mobilis ZM4
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 17007 - protein, 391 aa, Geobacter sulfurreducens PCA
MKFPISDQIRSVQCAPIAEVKSWLAHREPDPERPLVDLCQAVPDYPPARQLTDYLAALLDDPLVSKYSPDEGLPEVREGVCARYGRVYGAAMNPDQLCLTIGASQAFWLAMVTLCRAGDEVIVPLPAYFDHPMALDILGVRPVYLPFDEERGGVPDPAAVERLITPRTRAILLVTPSNPTGVVTPPETIQELHGVARRRGIALVLDETYADFIPGGERPHDLFLDPRWGDHLIHLMSFGKTYALTGYRAGCLAASKEFIGHALKAQDTMAVCQPRITQYAVLYGVSHLDGWVEENRLMMTRRHDLFRSLFTRPGNPFSLVASGTFFAWVRHPLQEGTGREAARRLAVEAGIICLPGEVFGPGLEPYLRLAFGNIRDEAIPGAVERFRAFAL

SEQ ID NO: 17008 - protein, 364 aa, Hyphomonas neptunium ATCC 15444
MTSPQDYRQTPPEPDHRGGGLSRRSLLGMAAIGTTIAAVGIGGTRLWTGSSEIPDWTYKDIPPQNGRRVLVTGANGYPEEDRSGLGYHIALGLARAGADVIIASRNQTRGEEAIRRIGAESPAGRVRFETLDLADLKSVKDFTARMQASGNGLDLLVNNAGTMGTLERQESIDGFERVFATNAIGPFALTAGLLPLLRNGNAPRIVWMCSGRSAFGALDLDDLQQENAYEYASAYNDSKQAHLIAALECERRSRAHGWGVVSIAAHPGVARTSLILDGPGLDSAEGWRRRNMPFMFQDAAQGALPALYAAVSSQAAGGAYYGPKGLMGIRGLPGVSQVPDNSRDPQLATTVWETLEQLGTVSLR

SEQ ID NO: 17009 - protein, 326 aa, Saccharomyces cerevisiae YJM789
MNSESREDMAINSIKLLAGNSHPDLAEQISKKLGIPLSKVGVYQYSNKETSVTIGESLRDEDVYIIQTGIGEQEINDFLMELLILIHACKIASARKITTVIPNFPYARQDKKDKSRAPITAKLVANLLQTAGADHVITMDLHASQIQGFFHIPVDNLYAEPSVLNYIRTKTDFDNAILVSPDAGGAKRVAALADKLDLNFALIHKERQKANEVSKMVLVGDVTNKSCLLVDDMADTCGTLVKACDTLMEHGAKEVIAIVTHGIFSGSAREKLRNSRLSRIVCTNTVPVDLDLPIADQIDISPTFAEAIRRLHNGESVSYLFTHAPV

SEQ ID NO: 17010 - protein, 811 aa, Bradyrhizobium sp. ORS278
MNASGYIRWFKDLRIEDVPDVGGKTASLGELYSALAAQGVRVPNGFALTAASYRDALRADGADDALRELLAGLDKRRIADLAKRAAKARAIVFDATDRDDLRREVAMAYKQLEQEYGRNVAVAVRSSATAEDLPHASFAGQHESFLNISGARQLFETCRRCFASLYTDRAISYRIDNGFAHDKVALSVAVMKMVRSDRGASGVMFSLDTESGFRDVAFITGVYGLGETIVQGAVDPDEFYVHKPTFAAGFRSVLSRRLGAKSKRMVYAKPGARGATTRIEPTPPAERARFCIDDSDVLELAQATITVEQHYSQKAGRPTPMDIEWAKDGRDGALYIIQARPETVASQRRPESVETYVLKKAGKPLATGRAVGEKIAAGKVRLIRTATDLRAFKPGEVLVATSTSPDWEPVMKTAAAIVTDHGGRTCHAAIIARELGVPAVVGTEDFSKRARTGASVTVCCAEGDAGHVYDGALPFDVQRLAIDKLDKPHTHIMVNLGNPELAFKTALLPNDGVGLARMEFIINQSIGIHPMALAAPNKVTAPKDRATIKQLTARYRKPADFFVEQLSEGVGTIAAAFYPRPVIIRLSDFKTNEYASLIGGADFEPREENPMLGFRGASRYAHPAYAAGFALECAALKRVRDVMGLANLKIMIPFCRRVAEAEKVIAAMAGHGLVRGEHGLEIYMMCEIPNNVILIDEFAKHFDGFSIGSNDLTQLTLGVDRDSDIVAFDFDERDPGLLTMLKLAVEGAHRNHRHVGICGEAPANYPEVARYLASLGIDSISVNPASVMRTMEIVRVAERDAAASVPQALAS

SEQ ID NO: 17011 - protein, 412 aa, Rickettsia prowazekii str. Madrid E
MKENFNVSKLKNGLTILTYNMPYVHSVAINLIAKVGARYENEEEEGISHFLEHMAFKGTKTRTAQQIAEEFDSIGGYFNAYTGHENTVYYARVLSENCHKALNILADIIQNSIFADEEIAKEYQIIMQEIAHHHDNPDDLIYETFYNTVYKGQPLGKSILGTTKTLVTFTKEHFLNFIGKHYNAENLYLSIAGNIEHNKIVMIAEELFASLKQGVKSSFIPAKYIGGKGFIHKELEQTSLVLGFECTSYINLGQLYQTYLLSIIFGGGMSSRLFQSIREKLGLAYVVGSYNSAYFDSGVFTIYASTAHNKLELLYREIKNEIIKITETVSTEEIIRAKMQLRSNLQMAQEQNTYKSEEIGKNYSVFGKYILPEEIIEIITNIRADDIINTANKIFSGTTTLAIIGPNDLNGF

SEQ ID NO: 17012 - protein, 607 aa, Vitis vinifera
MYSHLFTLLLLFFYFPPAKPDLSSDRAALLAFRDSVRGSTLIWNGTDTCSWEGIQCDADRVTSLRLPADDLTGNIPPNTLGNLTQLRDLSLRGNSLTGNLPSDLGSCTQLQRLFLQDNQFSGQIPAGLFLLNNLVRLDLSRNNLSGEISQGFGNLTKLRTLYLERNQLSGSIPDLNLELRDFNVSYNRLSGSIPKGLRNFGSDAFQGNSLCGSPLASCPDSGNKLSGGAIAGIVIASVIGLVLIIIVVLIFFRKYRRTTRSGPEFEIPSNQPVDMGENGGGINGFPAEKAANGVEKIRNANGLVFLGNGLSVFDLEELLRASAEVLGKGTCGTTYKAMVGEGVEVVVKRLRNICVYEREFLEEVARLGGMVHENLASIRAYYYGRDEKLLIYDCLPMGNLSSLLHGDRGAWRAPLSWEVRGRIALGAARGIKYLHSHGPNVSHGNIKSSNILLTNSCDALVTEFGIVQLVSVTSAPKHSGYCAPETRGSYTVSQKADVYSFGVVLLELLTAKAPTYALSNEEEMELPRWVESVVEERGTIDVFDLELLRYDNIEEQVVQLLHLALLCTSKHPKRRPSMAEVTRQIELIFGSGLPEYEPQPNQIEDGS

SEQ ID NO: 17013 - protein, 150 aa, Colwellia psychrerythraea 34H
MTKYHKSTHVISALTKEQYRVTQESGTERAGSGEHLNNTSPGIYVDIVSGEPLFASSDKYESGCGWPSFTKPITSKNIQELSDSSHAMVRTEVRSSHGDSHLGHVFKDGPTSKGGLRYCINSASLRFIHRDEMVSNGYGDYIDQVEDLSI

SEQ ID NO: 17014 - protein, 340 aa, Oryza sativa Japonica Group
MASSSSAASGKSRPECINSSNPFHECSDYCLRKIAEAKERIEDEQRPPVDRTVHPDCINASNPYHVCSEYCFKRIADAKSGLERAEQEPPSADAGKSDAAQAEGGGGDDDAEQEDAGSDDGYPQMTEKQKKLFELRLKMNEARKANQQAMVAEKKRMEPRAESRGVSKQKWLEDRKKKIGKLLDSNGLDMTKSYMLDTQESAEAKYKKWEKEPAPYGWDVFNQKTLYDAYKKRTKNIEVDMEAYNKAKEADPEFYRDASSLQYGKVSKVPEENIDRMVNELKERDEKRKAFSRRRKFHEDKDIDSINDRNEHFNKKVERAFGKYTLEIKNNLERGTALPD

SEQ ID NO: 17015 - protein, 195 aa, Arabidopsis thaliana
MGIKYGFLAASVSLAVIGAYILFTGNGETFNFGQFLEDISPYAWADLGIGLCIGLSVVGAAWGIFITGSSIIGGGVRAPRIRTKNLISIIFCEVVAIYGVIMSIVFSAKLNVMERDSMNSASNYYTGFALFWAGLTVGMCNLICGISVGINGSGAALADASDASLFVKILVIEIFSSVLGLFGLIIGLLVAGKAA

SEQ ID NO: 17016 - protein, 201 aa, Vitis vinifera
MASSSSSSSDDCRPISNEGLGGDLSALQKHVAFFDQNKDGTVYPWETYRGFRAIGCGIFLSAGSAFLINLALSRKTRPGKFPSLLLPIEIKNIHMAKHGSDSGVYDSEGRFVPSKFEEIFTKHAGANSNALTSDELLAMLKYNRVPKDYSGWLASWTEWKILYFLCKDKNGLLHKETIRAVYDGSLFERMQEHRASARKKA

SEQ ID NO: 17017 - protein, 426 aa, Oryza sativa Japonica Group
MKPTTGTAAAAAVDRRWLLPLAIGSALSLLLLVLLTTFPLPFPFPSSAASRPPNPTLFVEHKLAPSPPSTASPPRFAYLISGSAGDAAALRRVLLALYHPRNLYILHLDAEAPDSDRANLAADLADHPVIAAAANVHVIQRANLVTYRGPTMVANTLHAAAAFLYTNQHPHLEWDWFINLSASDYPLLTQDDLIHVFSKLPRGLNFIDHTSNIGWKEYQRAKPVIIDPGLYMKKKADVFWIPQRRSVPTAFKLFTGSAWMALSKPFVEYCIWGWDNLPRTVLMYYANFISSPEGYFHTVVCNAEEFKNTTVNHDLHYISWDNPPKQHPHYLTIEDLDRMVASDAPFARKFHADDPVLDKIDAEILLRGPDMLTPGGWCGGTRENGSDPCSVIGNTTHLQPGRGAVRLQRLMTSLLSEEKFHPRQCK

SEQ ID NO: 17018 - protein, 449 aa, Streptococcus agalactiae NEM316
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLVRTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEATDEFGDSGNLVLGANIAGFLKVAQAMSAQGIV

SEQ ID NO: 17019 - protein, 429 aa, Kineococcus radiotolerans SRS30216
MVRAVPAIVRAPHLFLAEVTRRHGPVAAIPLPRTPVLVLADPDGVRRVLVENARGYGKATIQYSALATVTGPGLLAGDGEVWKQHRRTVQPAFHHGSLEDVAAHAVHAARGLVAEADALPPGTPLEVLGATSRAGLEVVGHTLAAADLSGDAPLLVEAVGRALELVVRRAASPVPAAWPTPARRRLAREVAVIDEVCARIVATRRARPLEDPRDVVGLMLAAGMDDRQVRDELVTFVVAGHETVASSLTWTLDLLARAPSVLARVHAELAGALGGREPGWDDLGKLPLLRAVVDESLRLYPPAWVVTRQALADDVVAGVAVPAGTLVIVCTWGLHRDPALWEAPEEFRPDRFLDAPRPAAGSYVPFGAGPRLCIGRDLALVEEVLVLATLLCERTVRPAGPAPRVDALVTLRPRGGLPLHVERLAPSAS

SEQ ID NO: 17020 - protein, 232 aa, delta proteobacterium MLMS-1
MEEIAQNLAAIKARIAAAARRAGRDPQTVRLVAVSKKVAPERIARAVAGGQRLFGESYLQEAEAKMARVDPEGRLHWHFIGHLQSNKAKAAATHFAMVESVDRLKLAGRLAHYAAAAGRLLPVLVQVNIAGEARKAGVAPAETRTLLQELDKLPALRVMGLMTMPPWASTAEASRGHFRQLRQLADAMAEAGLLGRHGPVELSMGMSGDFEVAVEEGATLVRVGTAIFGARD

SEQ ID NO: 17021 - protein, 431 aa, Rhodococcus sp. RHA1
MIDPMPSTTWADAQGLCTFVDASPSPFHVCATVSMLLTGNGFTELHETDSWPGEPGRYFLVRGGSLIAWSTDGLGRTAPFRIVGGHTDSPNLRVKQHPDLSSAGWQLVGLEPYGGAWLNSWLDRDLGISGRLSVRAGNAVEEKLVRVDEPILRVPQLAIHLSEDRKGVHLDPQRHLNGVWGVGSERRSFIDFVADRAEVPADAVLGWELMTHDLAPSTLVGTGQDLVSAPRLDNQGTCYAGTHALLAAAENPGDRVPVLALFDHEEVGSMSDRGAFSDLLSTVLERIVLGRGGGREEFLQTMAGSICASGDMAHATHPNYPERHEPAHHIAVNGGPVLKVNQNLRYATDAAGAGAFALACDQAGVPLQRYVHRADLPCGSTIGPITASRTGLSTVDVGAAQLGMHSSRELMGARDVRAYSDALAAFLTPTA

SEQ ID NO: 17022 - protein, 99 aa, Vigna radiata
MASRQQNKQELDERARQGETVVPGGTGGKRVEAQQHLAEGRSKGGQTRKEQLGTEGYKEMGRKGGLSTMDKSGEERAREEGIEIDESKFRTSANKDNDM

SEQ ID NO: 17023 - protein, 470 aa, Burkholderia sp. 383
MNLTIIGSGYVGLVTGACLADIGHDVFCLDVDQAKIDILNNGGVPIHEPGLKEVIARNRSAGRLRFSTDIEAAVAHGDVQFIAVGTPPDEDGSADLQYVLAAARNIGRYMTGFKVIVDKSTVPVGTAERVRAAVAEELAKRGGDQMFSVVSNPEFLKEGAAVDDFTRPDRIVIGCDDDVPGERARELMKKLYAPFNRNHERTLYMDVRSAEFTKYAANAMLATRISFMNELANLADRFGADIEAVRRGIGSDPRIGYHFLYAGCGYGGSCFPKDVEALIRTADEHGQALQILKAVSSVNATQKRVLAEKIVARFGEDLTGRTFAIWGLAFKPNTDDMREAPSRELIAELLSRGARIAAYDPVAQQEARRVIALDLADHPSWLERLSFVDDEAQAARDADALVIVTEWKIFKSPDFVALGRLWKSPVIFDGRNLYEPETMSEQGIEYHPIGRPGSRQAVAARVPGTAPASA

SEQ ID NO: 17024 - protein, 508 aa, Burkholderia sp. 383
MNAPAVAAETRHSSSTAPAAGTRVAVQPVILAGGSGTRLWPMSRERFPKQLIGLLGEHSLLQSTALRLDGLTADHPLNDDVLIVCGEDHRFTTAEQLRLTGKPASIMLEPIGRDTAPALTLAALRLVAGGNDAVMTVMPADHAVADLPRFHAAVAAGVHCAMQGKIATMGIVPTHAETGYGYIRVGAPLGDAATGKLDVRRLDRFVEKPHLELAQQYVASGEYWWNSGIFIVRASVWLKAIRQLEPAIYAACEQAVAQGKADGDFFRVDRDAFAASPSNSIDYAVMEPIASLPQLCESVVVPLDAGWSDVGSWDAIWQISPKDDADNVGRGHVLFEGAESTFAHSESRLVACLGTQNLVVVETPDAVLVADKSRVQDVKKIVGHIKAQRGAEATDHRKVHRPWGHYDSIDMGERFQVKRIVVKPGARLSLQMHHHRAEHWIVVRGTARITRGDETFLLSENESTYIPLGVSHRLENPGMMPLELIEVQSGAYLGEDDIVRFDDTYGRQ

SEQ ID NO: 17025 - protein, 411 aa, Brassica napus
MNALAATNRNFRHASRILGLDSKIEKSLMIPFREIKVECTIPKDDGTLVSYVGFRVQHDNARGPMKGGIRYHPEVDPDEVNALAQLMTWKTAVADIPYGGAKGGIGCNPRDLSLSELERLTHVFTQKIHDLIGIHTDVPAPDMGTNAQTMAWILDEYSKFHGHSPAVVTGKPIDLGGSLGREAATGRGVVYATEALLAEYGKSIKGLTFVVQGFGNVGTWAAKLIHEKGGKVVAVSDITGAVRNPEGLDIDALLSHKEATGSLVDFSGGDAMDSNELLIHECDVLIPCALGGVLNKENAGDVKAKFIIEAANHPTDPDADEILSKKGVIILPDIYANAGGVTVSYFEWVQNIQGFMWEEEKVNLELQKYMTRAFHNIKSMCHTHSCNLRMGAFTLGVNRVARATQLRGWEA

SEQ ID NO: 17026 - protein, 202 aa, Zea mays
MEYVNPLTGFRVDGRRPNEMRQLKGEVGVVVRADGSALFEMGNTRVIAAVYGPREVQNKGQQVNSKEALVRCEYRMAEFSTGDRRRKPKGDRRSTEISLVIRQTMEASILTHLMPHSQIDIYVQVLQADGGTRSACINAATLALADAGIPMRDIATSCSAGYLCSTPLLDLNYLEDSAGGSDVTVGILAKMDKVTLLQVERS

SEQ ID NO: 17027 - protein, 326 aa, Zymomonas mobilis subsp. mobilis ZM4
MPYHQPAEWMPHDAVWIGFPSDASLWLEDLEPAQAEVVAFAKAVAAQGEGEKVYLVAAHKEAADQAVKMAGSDIEVICHPFGDIWLRDNAPLFVKEGDKKALALFRFNGWGGKYNLDGDQTIGRDLAKDTALPVLEKNWVLEGGSIDGDGHGLVVTTEECLLNPNRNPELSRGDIARHLRNDLGYDRVLWLRKGLHNDHTDGHVDNLARFVGENHLVVPIATDQDDPNREVYDQAAQIATEFGVKVTRIPSTGRITIDDEVVPASYMNFYIGNKVVVVPVYGAKNDSAIVQAFEALFPSRKVVALPAGHILTGGGSFHCISQQWPA

SEQ ID NO: 17028 - protein, 270 aa, Pseudomonas aeruginosa UCBPP-PA14
MQVDEQRFGGIGRLYGREGLQRLADSHVAVVGIGGVGSWAAEALARSGVGEISLFDLDDVCVTNTNRQVHAIEGSVGKAKVEVMAARIRAINPACRVHAVADFVTRETMAEYIVDFDYLIDCIDSVAAKAALIAWCKRRKIPVITTGGAGGQVDPTQIQVADLNKTFNDPLAAKVRSTLRRDYNFSRTPGRTYSVPCVFSSEQLRYPKPDGTVCQSKSFVGEGVKLDCAGGFGAVMMVTATFGMVAAARAVERLAEGRALRPSRRTPGNA

SEQ ID NO: 17029 - protein, 392 aa, Desulfovibrio desulfuricans G20
MTQTRRVARRVQQIRISATKLMPMLAARIGGCVSLGQGVPSFSTPPHIVDAVCRVLRDDPSAGKYSLQPGMPALRQAIAEHLTAAKGFAADPDSEVAVTVGAMEALLMALLTVVDRGDEVIIPSPGYASHAEQVLMAEGVPVHVPLRPADWGLDVEAVRAAVTERTRAVIVCNPGNPTGTVYADEDVRALCRLALEHNLVLISDETYDYMVFGGHAAPLSPASLPEMRENVIVINSFSKKYALTGWRVGYAAASAGWMGEMLKVHDATAICAPTVSQHAALAALTGPQDCVEQMCAALEKRRSLTMDRMAALAPAFTCVPPRGAFYVMARYSCTPEPSPEVARRILEEARVITVPGASFGPAGENHLRLSFGADEAELTECFDRLQRWAERQ

SEQ ID NO: 17030 - protein, 290 aa, Oryza sativa Japonica Group
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 17031 - protein, 148 aa, Triticum aestivum
MEGKEEDVRLGANKYSERQPIGTAAQGSEDKDYKEPPPAPLFEPGELKSWSFYRAGIAEFMATFLFLYVTILAPLPIGFAVFLVHLATIPITGTGINPARSLGAAIIYNREHAWSDHWIFWVGPFIGAALAAVYHQVVIRAIPFKTKS

SEQ ID NO: 17032 - protein, 453 aa, Saccharomyces cerevisiae
MAKRRQKKRTHAQITPEQERDIPKSMVIRVGQTSLANHSLNQLVKDFRQIMQPHTAVKLKERKSNKLKDFVVMCGPLGVTHLFMFTQSEKTGNVSLKIARTPQGPTVTFQVLDYSLGRDIKKFLKRPKSLNNDDVLNPPLLVLNGFSTSKRSDEDDQDVNVEKVIVSMFQNIFPPLNPARTSLNSIKRIFMINKDRETGEISMRHYFIDIREVEISRNLKRLYKAKNNLSKTVPNLHRKEDISSLILDHDLGAYTSESEIEDDAIVRVVDNQDVKAKHSQTSLSQKTPVKMTDNEEREKGIEEEDVEMEEPKPSENSQPTPRKKAIKLTELGPRLTLKLVKIEDGICSGKVLHHEFVQKSSEEIKALEKRHAAKMRLKEQRRKEQEENIAKKKAVKDAKKQRKLERRKARAEEQGEGQGKDGAMSDDGSSSSEDEHYSDVPEDLDSDLFSEVE

SEQ ID NO: 17033 - protein, 1415 aa, Arabidopsis thaliana
MDVASARSISSHPSYYGKPICSSQSSLIRISRDKVCCFGRISNGMTSFTTSLHAVPSEKFMGETRRTGIQWSNRSLRHDPYRFLDKKSPRSSQLARDITVRADLSGAATPDSSFPEPEIKLSSRLRGIFFCVVAGISATFLIVLMIIGHPFVLLFDPYRRKFHHFIAKLWASISIYPFYKINIEGLENLPSSDTPAVYVSNHQSFLDIYTLLSLGKSFKFISKTGIFVIPIIGWAMSMMGVVPLKRMDPRSQVDCLKRCMELLKKGASVFFFPEGTRSKDGRLGSFKKGAFTVAAKTGVAVVPITLMGTGKIMPTGSEDDSRSSGYIYAELKALILVGGFGTRLRPLTLSMPKPLVDFGNKPMILHQIEALKGAGVTEVVLAINHQQPEVMLNFVKEYEKKLEIKITFSQETEPLGTAGPLALARDKLVDESGQPFFVLNSDVICEYPLLEMIEFHKTNRAEASIMVTEVDDPSKYGVVVTEEGTARVESFVEKPKHFVGNKINAGIYLLSPSVLDRIELRRTSIEKEIFPKIASEKKLYAMVLPGFWMDIGQPKDYITGQRMYLNSLREKTPQELATGDNIIGNVLVHESAVIGEGCLIGPDVVIGPGCVIDSGVRLFGCTVMRGVWIKEHACISNSIVGWDSTVGRWARVFNITVLGKDVNVADAEVYNSGVVIEEQGKSMLDCGKKAVKSQVISGRLEKFVRLDSMDSRYSQTSDTGLNRCTLNLQGPTRGGGAQGNNVSSGSFKKGFRKGSKGLWSIGRSIGLGVSRAVFPEDLKVSEKKIFDPQDKFLLLCNKLFVTSCILAVSVDPLFLYLPFVKDNEKCIGIDRKLAIIATTLRTVIDAFYLFHMALRFRTAFVAPSSRVFGRGELVIDPAQIAKRYLQQYFIIDFLSVLPLPQIVVWRFLYISKGASVLATKRALRSIILVQYIPRFIRLYPLSSELKRTAGVFAETAWAGAAYYLLLYMLASHIVGAIWYLLALERYNGCWTKVCSNSSLDCHRNFLFCGNEKMDGYAAWTTIKDSVLQLNCPVNTTDNPPFDFGIYLRALSSGIVSSKSFVSKYFFCLWWGLQNLSTLGQGLETSTYPGEVIFSIALAIAGLLLFALLIGNMQTYLQSLTIRLEEMRVKRRDSEQWMHHRMLPPELRERVRRYDQYKWLETRGVDEENLVQNLPKDLRRDIKRHLCLALVRRVPLFENMDERLLDAICERLKPCLYTESSYLVREGDPVNEMLFIIRGRLESVTTDGGRSGFFNRSLLKEGDFCGEELLTWALDPKSGSNLPSSTRTAKALTEVEAFALIADELKFVASQFRRLHSRQVQHTFRFYSQQWRTWAAIFIQAAWRRYVKKKKLEQLRKEEEEGEGSVTSIRATFLASKFAANALRKVHKNRIEAKSTIELVKYQKPSEPDFSADDTS

SEQ ID NO: 17034 - protein, 208 aa, Glycine max
LLGCGVSTGVGAAWRTAAAAPAPPPPIFGLGSIGLAVAEGARLCGATRIIGVDINPEKFEIGKKFGVTDFVNAGECGGKPVGQVIIEITDGGADYCFECVGMASLVHEAYASCRKGWGKTIVLGVDKPGARINLSSYEVLHDGKSLMGSLFGGLKPKSHVPILLKRYMDKELQLDKFVTHEVEFKDINKAFDLLSKGECLRCVIWMDK

SEQ ID NO: 17035 - protein, 514 aa, Bacillus anthracis str. Ames
MSILTVENLSHSYGEKTILYNACFRLLKGEHVGVVGGNGIGKSTLLRILTGELIHDDGNIEWFPHVKIGFLQQHMDLQEGMTIEGYLQSAFADLYAIECEMLKIAEEMNGAGEVEKLLVKYGELQTILESSNFYHIHAEVEEVAIGLGLFEIGLKKDVSKLSGGQRTKLLLGKLLLEKADVLLLDEPTNYLDTAHIEWLQSYLRLYEKAYVIISHDELFLNSITNVIFHLEGGKVKRYVGNYEKFVQSYQVQKKQLQSAYVKQQKEISQLETFIQKNKIRKAKQAKSREKVLEKMQRIEKIHPVPRSRFDFNVYEEPVSRILQAEKLRIGYSDPLCPELNLQVKKGEKIAIIGHNGIGKTTMLKTLLGQIKPLSGSISVGERVNPAYFAQEEFASETTPLEKVWAERPDMTKKEVRQALAKCGLKEEHVLKPIRLLSGGEQTKVRLCELIVTRSNVLILDEPTNHLDIETKKSLQEALQQYKGTVLLVSHEPSFYEAWITKVWNIEEWNAEQYE

SEQ ID NO: 17036 - protein, 547 aa, Listeria innocua Clip11262
MTLKSGFDYMNNPLLNKGTAFTSEERLNYKLDGLLPPIIETIEQQALRIENQLENLESPLHKHQFLTNLYNENRTLYYYVVTKNVSEYLPIIYTPTIGDAVIHYHTDYTAPDEALFIDAFTPEKLRASVENYAQNNPNIDMIVITDGEGVLGIGDWGVNGVKIAVGKLAVYTVAAGLSPDRVLPVVIDAGTNNKTLLEDSRYLGNKRPRLSESDYDTFIAQFVEVMSDVFPSAILHWEDFGRANASRILHNYRDKICTFNDDIQGTGAMVVAAALATINVSNIPLNKQKIIIFGAGTAGIGIADQLSGQLMRETGLPFESAKKHFYLLDRSGLVLDNMTDLTDGQKKYAHQASDWASVPTDTLEHLVEAIHPTMLIGCSGVTGAFKESIVKKMTEHTERPAILPLSNPTKLAEATAADLIKWTDGKALIVTGSPSKPVTYQNITYEIGQANNALLYPGLGLGALVTRSKFITDGMLAAASSAVSDQISTNELGAALLPHVRTLRETSRAVAIAVANQAIKENIHQVELASVTKAVEREMWQPTYKGV

SEQ ID NO: 17037 - protein, 501 aa, Mycobacterium smegmatis str. MC2 155
MSAPPTSMAGQMMRRRPVIGAPVAHGASDHLKRSIGTFQLTLFGVGATVGTGIFLVLQEAVPEAGPAVLVSFVLAGVAAGLSALCYAEMASAVPVSGSTYSYAYTTMGEFVAMGVAACLLLEYGVSMSATSIGWGGYLNQLLDDVFGFRIPQALTSAPWGENPGIMNLTATLLIVMCGLLLIRGASESALVNTIMVIIKLAVLALFVAVAFTAFTTDHFAGFWDKGFAGITAAAGSIFFTFIGLDAVSTAGDEVKNPQKTMPRAILGALVVVASVYILVAFAGLGTQSADEFGSEEQSEAGLAVILTNILHGQTWASTILSFGAVISIFSVTLVVMYGQTRILFAMGRDGLLPSMFARVNSHTMTPINNTIVVALVTGTLAGFVPLDYLWDLVSIGTLVAFIVVSAGVVLLRVREPDLPRSFKVPGYPVTPVLSIIACLFVLYGLPAVTWLWFSVWVGAVLLFYLLWGRRHSALNDGGDGYIPGAAAGEDDVMTGHPEDRA

SEQ ID NO: 17038 - protein, 211 aa, Corynebacterium efficiens YS-314
MPGRERRDGGRSADENKSNDRNERRGGGRRDDRRNQQQDERSQYIERVVTINRVSKVVKGGRRFSFTALVIVGDGQGMVGVGYGKAKEVPAAIQKGAEEARKNFFRVPMVGGTITHPVQGEAAAGIVMLKPAAPGTGVIAGGAARPVLECAGIQDILSKSLGSDNAINVVHATVDGLKQLVRPEEVAARRGKTVEEVAPARILRARAGQEA

SEQ ID NO: 17039 - protein, 201 aa, Bacteroides thetaiotaomicron VPI-5482
MNKRKIRDIGRLTFSLLFFGLYIPHIFLYLFKNSLRKSINADLERRKEKNEVRMNKCLMFLYYIHTDRYFRNLFYHRVGAVVGALIGWWRLGDRSFVISKTTKIGEGAYFAHPFACEINAKSIGKNFSCRHLTTLGNKADGDNDNRPVIGDNVTLGVNVTIIGGVIVGNNVIIGAGSVVVKDIPDNSVAVGNPCRVIKTIE

SEQ ID NO: 17040 - protein, 493 aa, Clostridium thermocellum ATCC 27405
MKTLENHNRIKVTVNGREIEVYDNLTILQALLQEDIHIPHLCYDIRLERSNGNCGLCVVTLISPDGERDVKACQTPIKEGMVICTNTPKLENYRKIRLEQLLSDHNADCVAPCVMTCPANIDIQSYLRHVGNGDFEAAIRVIKERNPFPIVCGRVCPHTCESQCRRNLVDAPVAINYVKRFAADWDMARPEPWTPEKKPPTGKKIAIVGAGPSGLSAAYYSAIKGHDVTVFERQPHPGGMMRYGIPEYRLPKAILDKEIEMIKKLGVKIMTEKALGIHIRLEDLSKDFDAVYLAIGSWQATPMHIEGEKLDGVWAGINYLEQVAKNVDIPLGDNVVVIGGGNTAIDCARTALRKGAKSVKLVYRCTREEMPAAPYEVEEAIHEGVEMIFLMAPTKIIVKDGKKKLVCIRMQLGEPDRSGRRRPVPIEGSEVEIDADTIIGAIGQSTNTQFLYNDLPVKLNKWGDIEVNGKTLQTSEYNIFAGGDCVTGPATVI

SEQ ID NO: 17041 - protein, 232 aa, Glycine max
MHSSHLLLEEPIRMVSILEPSKPNFFPAMTKIVGTLGPKSRSVEVISACLKAGMSVARFDFSWDDPEYHQETLENLKNAIKTTKKLCAVMLDTVGAEMQVVNKSEKAISLEADGQVVLTPDRGQEASSQILPINFDGLAKSMKKGDTIFIGQYLFTGSETTSVWLEVSEVKGQDVICTIKNSATLAGSLVTLHASQVHIDLPTLTDKDKEVISTWGVKNKIDFLSLSYTRHA

SEQ ID NO: 17042 - protein, 469 aa, Zymomonas mobilis subsp. mobilis ZM4
MPEKSPKLSKTLSSFHLWGIAVGLVISGEYFGWSYGWATAGTMGFLIATVIVAAIYTSFIFSFTELTCSIPQAGGPFAYSFRALGKWGGAIAGMATLVEFLFAPPAIALAIGSYLNVQFPSLSPKMAAACAYIVFMALNIVGVRIAATFELFITVAAIFELLVFMGVVAPAFSWEQFLHDGWGVASHFDIQAIGGIFAAVPFAIWFFLAIEGVAMAAEEAKNPRRSIPIAYTAGILTLVSLAFGVMVFAGGSMDWHQLANLNDPLPQAMKHVVGAHSGWLHMLVFLGLFGLVSSLHGIIMGYGRQIFALARAGFLPATLGKLHIKLQTPYAATIAGGLVGIAAIFADDVLSFGGHSLTAILVTMSVLGSLTMYVLSMVSLFRLRQTMPDLPRPYKAPLYPFLPALALIGAFFLLAAVIYYNAGISFIYALLMCIACPLCLYSYKRSQNKKTEENDITTSAILAAEGAEE

SEQ ID NO: 17043 - protein, 434 aa, Burkholderia thailandensis E264
MSSQSQSPSVAQSIPSYLHADDLGPWGNYLQQVDRVAPYLGSLSRWIETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQIMAWMMDTYSMNQGQTATGVVTGKPISLGGSLGRKEATGRGVFVVGCEAAKKKGVEIEGARIAVQGFGNVGGIAAKLFQEAGAKVIAVQDHTGTIHQPAGVDTAKLLDHVGRTGGVAGFEGAEPMPNDEFWTVETEILIPAALENQITEKNASKIRTKIIVEGANGPTTTAADDILSANGVLVIPDVIANAGGVTVSYFEWVQDFSSFFWTEDEINHRLERVMREAFAGVWAVAEEHKVSVRTAAFIVACKRILMAREMRGLYP

SEQ ID NO: 17044 - protein, 626 aa, Gibberella zeae PH-1
MSHDIKKTTDIKVEVALARDVEAIEMNDMSASSSQYKDDGNNNNTTKAWAVSVPSSEEQSREQSDWLDGFRRADRRKMKKGWDKQYQSEEPPQIPGDNRYFDIRAANAKTATSALARELKGRHLQMIAFGGAIGTGLFVTSGTALHEGGPGSVLISYIAIGALQYCTMQSLAELAVIFPIAGSFSAFSTRFLDPSWGFAMGWNYCLQWLFTLPLEIIAGAFTITYWNEGITKSVFVVIFLAAIFIINLFGVKAYGEAEFVFSTIKVTAIVAFILLGIVINIGGEPTGSYIGGRYWVDPGFFNNGFKGFCSVLVTSCFSFTGTELIGLAAAETANPRKSLPSAIKQVFWRITLFYIVSLMLVSLLVPHNDPRILDASSSNSAASPFVVAIESMGTTVLPSVMNAVILIAVISVGNSSVFGSSRTLAALADQSMAPAIFSYVDKQGRPLVAIIFASCVGLLAFIVDLKAQNVIFNWLLSVSSLATLFTWGSICLTHIRFRKSWAHASHTLEQLPFRARSGTAGSWFALCGYTLILLSQVWTAVSPVEMKADATTGDIVQNVFLRLMAVPIVLVMYVGHKLWYRTSFVKLEDIDIQTGRRYYRVHLMNEEDREARGAWPLWKKIYRQVC

SEQ ID NO: 17045 - protein, 398 aa, Arabidopsis thaliana
MMSDLPRDLLEERLSRVPVKSLREARFTCKNWKTLSKKRSFTKKHLAQEATSRESEFKVVMVLHCKVYLTSINLRGIHNGFDPSINRQAKLVSLNGTDQIDISEVYHCDGLLLCISKDYTRVVVWNPYRSQTLWLKPSSPDHRMDWYICAIGYEKRKSSLRYKVLRFVDFAEEEFVEYEIYELKSNSWRVLDVTSDWEVEFYARGVSLKGNTYWFATDKFPEISSNLIHSVYFLLCFNFTSERFGPRLHLPCYPMDVDTVSLSSVREEQLAVLFQRKDNLHMEIWVTTKIEPEEVMWSKLFLAVDMQPLTDFKFGIADASFIIDEEKKVVVVFAKDKDVMYPTHNTAYIIGEDGYYKEVDLGKTTDKIRDPLVCSYVPSSAQIKQGGKRKKKGKLITD

SEQ ID NO: 17046 - protein, 439 aa, Zymomonas mobilis subsp. mobilis ZM4
MDTNSFRDEHAAALDEATRSLTERRKDLLGASYRLFYRRPVHLVRGKGAYLWDANGDKYLDVYNNVASIGHCHPAVIEAVYEQMSRLNTHTRYLHETILDYSEAILATMPEEINRAMYMCTGSEANDLAMRIACEWSGGTGIIVTQESYHGTSFLTSGASPALGSGQNLSTNTRLVPAPDHYRLAGQDAGAWFAAEMQKQIDDMAAHGIKFAGFMADSIFSSDGVLPGEAGFLKEAIDVVHKNGGIFIADEVQPGFVRTGESFWGFGRHGLIPDVVTTGKPMGNGIPVSGLFARKEVMEAFSNHVPYFNTFGGNPVSMAAASAVLNVIKEENLQTHTQKVGAELLGELKKLQDKHESVGDVRGAGLFIGFELVKDRNSKEPDKELALDLIETLRDEHVLTSVAGPYGNVLKLRPPLAFQSGDIDWLTGALDRSLTKLGR

SEQ ID NO: 17047 - protein, 315 aa, Bacteroides fragilis NCTC 9343
MGKIAKKLTDLVGNTPLLELSNYNASNGLKARVVAKLEYFNPAGSVKDRISLAMVEDAEAKGTLKSGATIIEPTSGNTGVGLAFVAAAKGYKLILTMPDTMSMERRNLLKALGAELVLTPGANGMKGAIAKAEELRAATPGSVILQQFENPANPAVHVRTTGQEIWRDTDGKVDIFVAGVGTGGTVSGVGAALKEHNPAVRIVAVEPVDSPVLSGGAPGPHKIQGIGAGFIPKTYHAAVVDEIRQVGNDDAIRTSRELAAKEGLLVGISSGAAVYAATELAKLPENEGKLIVVLLPDTGERYLSTILYAFEEYPL

SEQ ID NO: 17048 - protein, 260 aa, Geobacter metallireducens GS-15
MMKEFLETAIRAARSAGAIQRQRLWEEHDIRFKGEIDLVTEVDRACEDLIVATIRGAHPGHGILAEEGTRDAGMSPHRWIVDPLDGTTNYAHGFPWFCVSIALEIDGEVRLGVIYHPVMDELFTAVKGEGAFVNGRPIRVSSRQPLKQCLLATGFPYDRTRDNENNFANFFSFQFAARAVRRAGAAALDLAYVAAGRLDGYWEVKLKPWDVAAGQLLVTEAGGWVTNHAGEPFAIDDHRILASNGLIHDEMLAVLSGKVM

SEQ ID NO: 17049 - protein, 367 aa, Bacteroides fragilis NCTC 9343
MALQCGIVGLPNVGKSTLFNCLSNAKAQAANFPFCTIEPNVGVITVPDERLNKLAELVHPNRIVPTTVEIVDIAGLVKGASKGEGLGNKFLANIRETDAIIHVLRCFDDDNVTHVDGSVNPVRDKEIIDYELQLKDLETIESRIQKVQKQAQTGGDKAAKQAYDVLVQFKDALEQGKSARTVTFETKDEQKIAKELFLLTSKPVMYVCNVDEASAVNGNKYVDMVREAVKDEDAEILVVAGKTEADIAELETYEDRQMFLAEIGLEESGVARLIKSAYKLLNLETYFTAGVQEVRAWTYEKGWKAPQCAGVIHTDFEKGFIRAEVIKYEDFLQYGSEAAVKEAGKLGVEGKEYVVQDGDIMHFRFNV

SEQ ID NO: 17050 - protein, 381 aa, Saccharomyces cerevisiae
MKSDSVEITTICPDVENSQFVVQSNCPETIPEILKSQNAAVNGSGIACQQRSLPRIKILGTGGTIASKAIDSSQTAGYHVDLTIQDLLDAIPDISKVCDIEYEQLCNVDSKDINEDILYKIYKGVSESLQAFDGIVITHGTDTLSETAFFIESTIDAGDVPIVFVGSMRPSTSVSADGPMNLYQAICIASNPKSRGRGVLVSLNDQISSGYYITKTNANSLDSFNVRQGYLGNFVNNEIHYYYPPVKPQGCHKFKLRVDGKHFKLPEVCILYAHQAFPPAIVNLVADKYDGIVLATMGAGSLPEEVNETCMKLSLPIVYSKRSMDGMVPIANVPKKGSKEDNLIASGYLSPEKSRILLQLCLAGNYTLEEIKHVFTGVYGG

SEQ ID NO: 17051 - protein, 457 aa, Saccharomyces cerevisiae YJM789
MLRTVTSKTVSNQFKRSLATAVATPKAEVTQLSNGIVVATEHNPSAHTASVGVVFGSGAANENPYNNGVSNLWKNIFLSKENSAVAAKEGLALSSNISRDFQSYIVSSLPGATDKSLDFLNQSFIQQKANLLSSSNFEATKKSVLKQVQDFEENDHPNRVLEHLHSTAFQNTPLSLPTRGTLESLENLVVADLESFANNHFLNSNAVVVGTGNIKHEDLVNSIESKNLSLQTGTKPVLKKKAAFLGSEVRLRDDTLPKAWISLAVEGEPVNSPNYFVAKLAAQIFGSYNAFEPASRLQGIKLLDNIQEYQLCDNFNHFSLSYKDSGLWGFSTATRNVTMIDDLIHFTLKQWNRLTISVTDTEVERAKSLLKLQLGQLYESGNPVNDANLLGAEVLIKGSKLSLGEAFKKIDAITVKDVKAWAGKRLWDQDIAIAGTGQIEGLLDYMRIRSDMSMMRW

SEQ ID NO: 17052 - protein, 317 aa, Mesorhizobium loti MAFF303099
MKKLVCAGEILVEIMAERIGQSFLAPGPLVGPFPSGAPAIFIDQAARLGQPAGLIAAVGDDDFGHLNIERLRADGADISAIKVHRGAATGTAFVTYETDGSRHFVYNIKHSAAGLIEIGAEARALLAGADHFHVMGTSLFSPEVIEVARKGIETVKARGGTVSFDPNIRKEMLDLPGLRDALHFVLSKTDVFLPSGPELFIFARATDEESAVREMLDRGISAVVIKKGAQGAVHYDKTGRTASPGFVVEEIDPTGAGDCFAAAFVSFWLRGAAPEKALRIANGCGALAVTRKGPMEGIASLAAVEAYVATARTGAPA

SEQ ID NO: 17053 - protein, 1142 aa, Oryza sativa Japonica Group
MDNPEAEPDDAVLFVGVSLVLGIASRHLLRGTRVPYTVALLVLGVALGSLEFGTKHGMGKLGAGIRIWANINPDLLLAVFLPALLFESSFSMEIHQIKKCMAQMVLLAGPGVLISTFFLGSALKLTFPYNWNWKTSLLLGGLLSATDPVAVVALLKELGASKKLSTIIEGESLMNDGTAIVVYQLFYRMVLGRTFDAGSIIKFLSEVSLGAVALGLAFGIASVLWLGFIFNDTIIEIALTLAVSYIAFFTAQDALEVSGVLTVMTLGMFYAAFAKTAFKGDSQQSLHHFWEMVAYIANTLIFILSGVVIADGVLENNVHFERHGASWGFLLLLYVFVQISRILVVVILYPLLRHFGYGLDLKEATILVWAGLRGAVALSLSLSVKRASDAVQTHLKPVDGTMFVFFTGGIVFLTLIFNGSTTQFLLHLLGMDRLAATKLRILNYTKYEMLNKALEAFGDLRDDEELGPPADWVTVKKYITCLNDLDDEPVHPHAVSDRNDRMHTMNLRDIRVRLLNGVQAAYWGMLEEGRITQTTANILMRSVDEAMDLVPTQELCDWKGLRSNVHFPNYYRFLQMSRLPRRLITYFTVERLESGCYICAAFLRAHRIARRQLHDFLGDSEVARIVIDESNAEGEEARKFLEDVRVTFPQVLRVLKTRQVTYSVLTHLSEYIQNLQKTGLLEEKEMAHLDDALQTDLKKFKRNPPLVKMPRVSDLLNTHPLVGALPAAMRDPLLSSTKETVKGHGTILYREGSRPTGIWLVSIGVVKWTSQRLSSRHSLDPILSHGSTLGLYEVLIGKPYICDMITDSVVHCFFIEAEKIEQLRQSDPSIEIFLWQESALVVARLLLPMMFEKMATHELRVLITERSTMNIYIKGEEIELEQNFIGILLEGFLKTKNQTLITPPGLLLPPNADLNLFGLESSAINRIDYCYTAPSYQVEARARILFVEIGRPEIEADLQRSASLISQTLELPRTQSKEHSESFRKSRGAQNGASLTEIRDHPASFSARALQLSMYGSMINDMKSGQGQGQRRQRHRHTKASSNKAHSSSYPRVPSRSSNTQRPLLSVQSEGANMTTARQAAAAGASLPPEPEEAGRRRRRQRKAIEEDEDNSSDESAGEEVIVRVDSPSMLTFRQPSSAADR

SEQ ID NO: 17054 - protein, 303 aa, Zea mays
LAFGYAYPAYECYKTVELNKPEIAQLIFWCQYWKGVSISYAVAILTSVNNLPNLGLFPVSRILVALLTVLERFGDFIISWLPFYSKAKSVFFVYLWYPKTKGTTYVYRTFFKPYISQHENEIDWNLLELRARATNTVVLYFHKAASAGQSTFFDILKYVVAQSPSQKSRQCLHQETKPVQSSPKIKCQTLARSGSVASTKPLVAASAPKPGGSPKKGEVKPTADLVQTPTTCADSPKPEPSAPSLPGAEGVDKMAINEASGDALEGAEELDPALEEETPMEETICVTRAKLRRRTATEVPAGN

SEQ ID NO: 17055 - protein, 473 aa, Physcomitrella patens subsp. patens
MGQGASTVVACSGNPSRVQEEEDEEEGEEERESQSRAVELQEGDDWTEYAPDECVASVFRKLCTADRNRCALVCKRWYRVEGQGRQRLTLHASAELGCALPGLLERFPHITKLVLKCDRRTVSIDDGALVLVGRLCQQLQKVKLKACKGLSDRGLEEFAELVSGSLRTFSCGSCQFGPRGINAVLQQCENLEELTVKRLRGFIMGNPGPAEHVLPGPCSIKRLCVKDLPNAQLLGPLIAGSKSLHTLILSRVPGNWDILLEIITEHTTSPVEFHMEKVCVTDRGLKAVARWSNLQVLYLVKPTECTNHGLSAVASGCPLLRKLHVDVMKSSRVGDEGLLMVARKCRHLQELVIIGVSATTASLSLVASECPGLERLAICTSETFGDPELSCIADKCLALKKLCIKGCPISDRGMEALVSGCPNLVKMKVKKCRMVTPASVACLHWNRVSLVVTLDAPSAVPIAAQVSCGYMQS

SEQ ID NO: 17056 - protein, 588 aa, Oryza sativa
  misc_feature (385)..(385): Xaa can be any naturally occurring amino acid
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISVSCNLPAVPHPTFSRDPVPYFLSPRLSNQASLHAALDATLAFLDKAVKPVLVAGPKLRVAKAGGAFVDLADASGHAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAXGEALRVNVLFKHIQRMIGGTEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 17057 - protein, 388 aa, Gluconobacter oxydans
MRIAALLLAAGRGRRFDASSQSGENSSKQFRMLRGKPVIRRAAEALLPHVDVLLPVGDDPLLADSLEGLDILPPVSGGAERHDSVRNGLEALAKLPEPPDLVLVHDGARPCVPAEVVQNVINALKTHEGVIPAVAVIDTIKKAKDGIIVDTVPRDGLWRAQTPQGFRFGTLLELHRTHRDARTDDAALLEQAGHPVAIVEGSEDNIKLTVAEDLMRLEGVIDRNLLPRVGLGYDVHAFEEGRKLILCGIEVPHTKGLAGHSDADVGIHTLCDAIYGALAEGDIGRHFPPSDNKWKDMDSARFLVHAGERIRERGGFLVNADVTLICERPKIGPHAEAMRNRLADLLKVSVSRISVKATTSERLGFTGREEGIAATATVSIMVPDNGEA

SEQ ID NO: 17058 - protein, 438 aa, Burkholderia sp. 383
MSLLPTTATAPFCPSEVKGSITIDAGAPRWLKLKRFFGPGLLVAIGYMDPGNWATDIQAGSQFGYSLLWVVAFSSLAAIFLQMLAARLGLVAGRDLAQASYDRYGRFGRIVQWVTAEVSIIACDIAEVLGCALAFKLLLGVPLAWGIVLTALDTVIVLGLQGKGFRQIEAIVLALIATMAFCFVAQVAITPPDWHAVVGGLVPGDPGHDRKDAIVLALGIVGATIMPHNLYLHSSVVQTRRVVGGARGMIRDTLALVRIDTFVSLFVAMLVNAAILVVAGAAFHATGQHNVTDIEQAYKLITPIAGGAAALLFGIALLASGQSSTLTGTIAGQVIMDGFLHTKIPCYQRRLITRGLALVPALIGVLWLGDGSVGQLLVWSQVLLSLQLPFAMWPLIRSVSDRNTMGEHTIGRGMQIAAWALFAVITGTNLLLITGVAG

SEQ ID NO: 17059 - protein, 140 aa, Bdellovibrio bacteriovorus HD100
MAKAKATKKATTKKAAPKKAVAKKAAPKAAKKAAPKAAAKKAAAPKKAAAPKKAKTARKPNAAFMKALTPSAALAAVVGASPLPRTEVVKKLWAYIKKNNLQDTKNKRNINADAKLKEVFGGKTQVSMFDMTKLVSKHLK

SEQ ID NO: 17060 - protein, 254 aa, Bdellovibrio bacteriovorus HD100
MGIKPLSLEEIKKMTVACRIAADTLTYLDKYIKIGMTTNEIDQLCFDFMATKGAKSACLGYHGYPKYTCTSINEVVCHGVPDDKTILKDGDIINVDVTAWIDGFFGDTSKMYMIGNVSEEAKDLVETARMARDIGIEAIRPNGYTGDIGFETNKLVTRKGYVAVKEIGGHGVGRKFHEEPFVPSYGKKGKGERLVPFHCITVEPMVNQGTDEIIEFDIPGSSIKYYHTADSLLSAQFEHTVLVTDTGYEILTLP

SEQ ID NO: 17061 - protein, 175 aa, Triticum aestivum
MAPTVMASSDTSVAPFQGLKSTAGLPVSRRSNGASLGSVSNGGRIRCMQVWPIKGIKKCETLSYLPPIITEALLKQVDYLIRSKWVPCLEFRKVGFIFREHNASPGYYDGRYWTMWKLPMFGCTDATQVINDVEEVNKEYPDAYVRIIGFDNMRQVQCVSFIAFKPPGCEESGKA

SEQ ID NO: 17062 - protein, 487 aa, Legionella pneumophila subsp. pneumophila str. Philadelphia 1
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLIITYINLAKVDTFGEIEFWLALIKIISLLAFVFLAILIFFGLIHGSEPPGIIGFKYLLGDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 17063 - protein, 588 aa, Zymomonas mobilis subsp. mobilis ZM4
MVSLRHRPFLTAFSALIAFSSSHLAMARQTQRPVTVTKEIDWSDVAHLPKKSTASHAMVAAANPLAVKAGYDVLKAGGSAVDAAVAIQAVLGLVEPQSSGIGGGAFMTYYDAKTHKVTAYNGRETAPADATPDMFLDDNKNPIPFKQAVVSGRATGVPGAVAMLELAQKEHGILPWRQLFTPAIALAEQGFTVSPRLASMINGHSPEAYTEDAIRYFVKANGERYQAGDILKNPDYANSLKAISEKGSAALLTGAIAQAIVDKVHQAPLAGSMTMADLAGYRPKESAALCKGYHLYVVCTPDAPSGGVGLQEALGLLSHTDIDRRNADDPKAWLEFAEASRLAYADRDYFVGDPDFVKVPVTGLLDPHYIAERAKLIGDKANPQAPSHGNPKGAPSYSMDATAEPGGTTHLVIVDSKGNAVSMTTTVENIFGSGRMVGGFFLNNQLTDFSFSPQAYDNTPAANAVAGDKRPRSTMAPTLVFNQKGQFVAALGSPGGSSIQAYNLKAIVALLDWHMPVDQALALPNLVAHGTLFLSDPFPAKVSQGLKDLGVTLTPAEHEESGLQAIIKRGNYYEGGADIRREGTAVGF

SEQ ID NO: 17064 - protein, 312 aa, Manihot esculenta
METFPVIDLSKLSGEERKPTMEMIQDACENWGFFELVNHGISHELMDTVERLTKEHYKKCMEQRFKEMVASKGLEAVQSEISDLDWESTFFLRHLPVSNMAEIPDLDEEYRKTMKEFAEELEKLAEQLLEVLCENLGLEKGYLKKAFYGSKGPTFGTKVSNYPPCPKPDLIKGLRAHTDAGGIILLFQDDKVSGLQLLKDGQWFDVPPMKHSIVINIGDQLEVITNGKYKSVMHRVIAQTDGTRMSLASFYNPGSDAVIYPAPALVEKEAEKSQVYPKFVFEDYMKLYAGLKFQAKEPRFEAMKAMGPIATA

SEQ ID NO: 17065 - protein, 552 aa, Pisum sativum
MNQAMATPLSLSCCSPTLTRSTLFFTKTFPFSRSFSTPLPLSTKTLISLSPPHRTFAVRAESQNGADPARQYDFDLFTIGAGSGGVRASRFASNFGASSAVCELPFSTISSDTTGGVGGTCVIRGCVPKKLLVYASKFSHEFEESNGFGWRYDSEPKHDWSSLIANKNAELQRLTGIYKNTLKNAGVKLIEGRGKIVDAHTVDVDGKLYSAKHILVSVGGRPFIPDIPGKEYAIDSDAALDLPSKPQKIAIVGGGYIALEFAGIFNGLKSEVHVFIRQKKVLRGFDEEIRDFVAENMALRGIEFHTEESPVAITKAADGSLSLKTNKGTEEGFSHIMFATGRSPNTKDLGLESVGVKVAKDGSIEVDEYSQTSVPSIWAIGDATNRVNLTPVALMEGVALAKTLFQNEPTKPDYRAIPSAVFSQPPIGGVGLTEEQAAEQYGDIDVFTANFRPMKATLSGLPDRVFMKLIVSAETNVVLGLHMCGEDAAEIAQGFAVGIKAGLTKADFDATVGIHPTAAEEFVTMRTPTRKVRKNQASQGKSDSKAKAVAGS

SEQ ID NO: 17066 - protein, 194 aa, Saccharomyces cerevisiae
MVTSNVVLVSGEGERFTVDKKIAERSLLLKNYLNDMHDSNLQNNSDSESDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 17067 - protein, 315 aa, Burkholderia thailandensis E264
MNAAATTLHPKVAPAGASWFEASARQRLAGLVDAGSFDEFAGPPARLASPHLPLFDLPQQFDDGMIVGRATLASEPVFVAAQEGRFMGGAFGEVHGAKLVGLLRAARELRSTPVLILFDTGGVRLQEANAGEIAVSEIVRAVIDARAAGVPVVGLVGGRAGCFGGGGIIAACCSALAVSEPGRIGVSGPEVIESRRGVDEFDSRDRALVWRTMGGKHRRLVGGAERFVDDAIDAFRDAAVALLARVRAGVTFGAATLEAEHARLAGRVARFRGCDDALDVWRALGAPEANAIPALDAAAFAALADRLTEVRDDAR

SEQ ID NO: 17068 - protein, 189 aa, Physcomitrella patens subsp. patens
SSSSGLTFKLHPLLIVSISDHHTRIMAQIGDASCPPRVYGCVLGVLVGRTVGIFNSFELLYDLVAGELCREFLEVKHLQYKKVFPKYDILGCYSTGSDVLDSYMHIHKAFMDIDESPVYVLLSPAINHAQKDLLISTFESELPVIDESPSLIFVNANYTIEVRLFSVHQIPVDHVAHVKPSDGSSAATQ

SEQ ID NO: 17069 - protein, 257 aa, Saccharomyces cerevisiae YJM789
MSTGITYDEDRKTQLIAQYESVREVVNAEAKNVHVNENASKILLLVVSKLKPASDIQILYDHGVREFGENYVQELIEKAKLLPDDIKWHFIGGLQTNKCKDLAKVPNLYSVETIDSLKKAKKLNESRAKFQPDCNPILCNVQINTSREDQKSGLNNEAEIFEVIDFFLSEECKYIKLNGLMTIGSWNVSHEDSKENRDFATLVEWKKKIDAKFGTSLKLSMGMSADFREAIRQGTAEVRIGTDIFGARPPKNEARII

SEQ ID NO: 17070 - protein, 101 aa, Physcomitrella patens subsp. patens
TDTDWTTGLCGCLEDVPNCVFTMFCPCLAFGRVAEHLDEGNTSCITAAVVWYVIQQLTSFGCVYSYSYRKKLRHKYNLPSRPLPDWFIHYFCWFCAICQVH

SEQ ID NO: 17071 - protein, 147 aa, Triticum aestivum
MAVAALKVQLNALLSNMFATGMVDEQFQQLQSLEEGGTASGFVAEVATLFIEDADRIIADIAALLDQPVVDFDKVDAHVHQLKGSSSSVGAQKVKLACMHFRQFYEAKSKEGCLMALALVRSEFCDVRNKFQTMMQLEQQIEACSPK

SEQ ID NO: 17072 - protein, 240 aa, Mesorhizobium loti MAFF303099
MTSKPLSGPAAIAALPRDRLIAEFSLWSANLANFESDLRRIEPHVDLHHIDVADGHFAPSFLFFPDLVARIAGLTAKPIHVHLMVDAAIVEAQTRQFIEAGADMISVHAENGEAGLRAVRLARELGAEAGVVLRLETPVEAVKPFVSEVAFVTLLGTAIGVKGQSLSDKACDRLGAARAILRGAGREAEVALAADGGIRHETVPLLRAAGAETVVLGSLAFGDKDLAGRIGWLHGLKVAA

SEQ ID NO: 17073 - protein, 585 aa, Oryza sativa Japonica Group
MAGRGEGNGAATMAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQNYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKEVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 17074 - protein, 510 aa, Burkholderia thailandensis E264
MTQQNRYDLLVVGGGINGAGIARDAAGRGLSVLLCEQDDLASHTSSSSTKLIHGGLRYLEYKEFGLVRKALQERETLLRAAPHIIWPLRFVMPHMPNLRPAWLIRIGLFLYDHLAKRELLPGSRGIDMRRHPAGAPLVDSIKRGFVYSDGWVDDARLVVLNALDAQERGARILTRTKLVSAERRDGQWHARLQRADGSTLDVCARAVANAAGPWVGDVLHGALGRGAQHSVRLVKGSHIVTRRLFDHDHAYIFQNPDKRIIFAIPYERDFTLIGTTDVEYRDDPSRVAIDRDETRYLCESINRYFKRKISPADVCWTYSGVRPLLEDENADNPSAVTRDYRLELDGGDGAPLLSVFGGKITTFRKLAEEATDMLGGALGASRGAWTAGVPLPGGDIADARFAPFAEAFAKRHPWLPAALARRYARAYGTRAERVIGGAKSLAELGAELAPGLYEAELRYLRDAEWASCADDVLWRRSKLGLHVAPGTLDAVTAALDAWFGAAREAASAAH

SEQ ID NO: 17075 - protein, 518 aa, Physcomitrella patens subsp. patens
MKETRGHNTIDSMFASRYVQCELPKFTIPERATPKDAAYQIISDELMLDGNPRLNLASFVTTWMEPECDKLIMSALNKNYIDMDEYPITTELQDRCVNMVARLFNAPIEEGEQAIGAGTVGSSEAIMLAGLAFKRKWQNERKAAGKPWDKPNLVTGANVQVCWEKFARYFEVELREVKLKEDYYVMDPYKAVELVDENTICVCAILGSTYNGEFEDVQLLNDLLEEKNREKGLHVPIHVDAASGGFIAPFLYPDIVWDFRLPLVKSINVSGHKYGLVYAGIGWVVWRSKEDLPEELVFHVNYLGADQPTFTLNFSKGASQVIAQYYQLIRLGFEGYKNIMANCAMNAKILTKAIESTGRFKILSKEVGVPVVAFSLLDNSDHNEYEISHQLRHYGWTVPAYTMAADAQHVTLLRVVVREDFSRSLSDRLLTDIKRVLAYFDARPSKLIEAVTAAVVEENKEQHLEMPTTPDAVKATQAFNTVILEHVACKKKHNGHHHSRSRGGHGKKHASPKANGVC

SEQ ID NO: 17076 - protein, 236 aa, Zea mays
  misc_feature (215)..(215): Xaa can be any naturally occurring amino acid
MVRLSNTVIGILNAVTFLLSVPILAGGIWLRARADGTECERYLAAPVIAVGVFLMLVSIAGLVGACCRVTCLLWFYLVAMFLLIVVLLGLTVFAFVVTHKGTGEAVSGRGFKEYRLGDYSNWLQKRVENDKNWNRIKGCLQDAKVCKSLEDKTVDQFMSSDLSPIQSGCCKPPISCGFTYVNSTQWTGPAKSTEPDCGAWSNDGALCYGCQSCKXAGVVATLKRNWKRSAIITSSS

SEQ ID NO: 17077 - protein, 645 aa, Xylella fastidiosa 9a5c
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFLTQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAVRMEREFRITFAPPTKLPHSLITLRQVNCGYSVLSPSAPSDPPPVDTHAAAPSQQAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEANQPQAAVTAKSPASQLPVKKPVNQQKLLAAEKHVSELETLLAELDRKLADPANYANGEVMMRLGDEREQAARRLAEAEQAWLLLMDGG

SEQ ID NO: 17078 - protein, 393 aa, Exiguobacterium sibiricum 255-15
MLSKRVQQLTPSTTLAITAKAKALREEGQDIIGLGAGEPDFNTPEFIIQAAFAAAEAGDTKYTPSGGTVALKDAIIEKTRRDLWVSYDRSEVMVASGAKHALSTLFQAILDPGDEVIVPAPYWVSYPEQIKLSDGVPVILETTEASRFKVTRDLLEQHITPKTKALVLNSPSNPTGMVYTKEELEMVAEVAIAHNLLVISDEIYEKLLYNGVTHLSIATLPDMRERTVIINGVSKSHAMTGWRIGYAIGPKDIISAMTNLASHSTSNPTSIAQAASVAAYAEGDAPVEAMRVVFEERLEQIYDRLIQIPGLTCLKPEGAFYLFPHALQAAKMCGFSNVDDWCTAVLSEAKVALIPGSGFGAPEYVRLSYATDPKRVLEALDRIEGFITAHTAV

SEQ ID NO: 17079 - protein, 70 aa, Glycine max
  misc_feature (28)..(28): Xaa can be any naturally occurring amino acid
  misc_feature (37)..(37): Xaa can be any naturally occurring amino acid
  misc_feature (43)..(43): Xaa can be any naturally occurring amino acid
NQLHAAAAIVIFTTPPLRSIRLVKRAKXNTAALAGLXGRGKTXIFYQLRDGTTPQGTVTPMEPNEGTLIL

SEQ ID NO: 17080 - protein, 327 aa, Streptococcus thermophilus CNRZ1066
MRSLFGELREHISGKGVRIVFPEGNDDRVVRAAARLKFEELVDPIILGDPTEVHKILNDLGFVDFNCTIINPETYEGFEEMKEKFVEVRKGKATIEDADKLLRDVNYFGVMLVKLGLADGMVSGAIHSTADTVRPALQIIKTKPGISCTSGVFLMNREDTNHRLMFADCAINIEPNSQELAEIAINTAETAKVFGIDPKVAMLSFSTKGSAKSPKVDRVVQATNIAKEMRPDLAIDGELQFDAAFVPATAAIKAPDSDVAGQANVFVFPCLQAGNIGYKIAQRLGMFEAIGPILQGLNKPVNDLSRGASAEDIYNLAIITAAQALNN

SEQ ID NO: 17081 - protein, 351 aa, Geobacter metallireducens GS-15
MITRLPAEWEEQDGVLLAWPHAESDWLPWLPMVELVFAQIVKEIAHFEAVLLVAAEGERTSAILSAAGASMERVRIVEIPTNDTWARDFGPLTVERDGNPVLLDFGFNGWGLKFAADRDNLITGRLHRTGAFGNAALETVGLILEGGSIESDGNGTILTTAECLLNPNRNPHLSQEQIEISLKEQFGADRILWLENGWLAGDDTDSHIDTLARLAPDDTIVYVRCDDAADEHYPALFLMEKELKAMRTSEGSPYRLIPLPWPRPCHDEDGERLPATYANYLVINGAVLVPTYGDPGDDAALAAIGQAFPGREIIGIDCRPLILQHGSLHCVTMQLPKGTLAPEPRNVTREV

SEQ ID NO: 17082 - protein, 404 aa, Oryza sativa
PAPASGSRRDHAAASRRLGDRAPTRPTRRLRGHALLPYPYPRHLLVVSPDHSHSPATVTVPPVFYICPPTSRSFATNTSIIHHLLITCIMQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTRGLLQAGVQGELWRLRDGNGKAAGMIGWLPEKAVTFVDNHDTGSTQKLWPFPSDKVMQGYAYILTHPGVPCI

SEQ ID NO: 17083 - protein, 659 aa, Skeletonema costatum
MASYESDLLSTWDEDPSLQKGFDWEIEKLRRYFAGLRQTPDGRWVRKSTLFEFLVTNSPSKVVGVGPDGERYESPPKPVNIFDVGVLVGKNTLTWLGFGPNLGMAAVPDAVIQKYEGSFFTFIKGALGGDLQTLAGGPLFLLLAKYYTDHGPIFNLSFGPKSFLVISDPVMARHILRDSSPEQYCKGMLAEILEPIMGDGLIPADPKIWKVRRRAVVPGFHKKWLNSMIGLFGDCGDRLVDDLEKRSTSDKPVIDMEERFCSVTLDIIGKAVFNYDFGSVTKESPIVKAVYRVLREAEHRSSSFIPYWNLPYAEKWMVGQVEFRKDMGMLDDILAKLINRAVETRQEATVEELEERETSDDPSLLRFLVDMRGEDLTSKVLRDDLMTMLIAGHETTAAMLTWTMFGLVSNDPGMMKEIQAEVRTVMGNKSRPDYDDVVAMKKLRYALIEALRLYPEPPVLIRRARQEDTLPPGGTGLSGGVKVLRGTDIFISTWNLHRAPEYWENADKYDPTRWERPFKNPGVKGWNGYDPEKQSSQSLYPNEITSDYAFLPFGAGKRKCIGDQFAMLEASVTLSMIMNKFDFTLVGTPEDVGMKTGATIHTMNGLNMMVSPRSETNPIPGTNEWWTKQHLMRGLSSTGRPYTSDEDAAWTTSANGMRP

SEQ ID NO: 17084 - protein, 527 aa, Burkholderia sp. 383
MSPVSAFKLVLLSFLAIVALECIAKRLRLPPAAALLIGGIGIAFIPGLPPINLDPELVLLVFLPPLLMDGAYFSVWEEFKRNVGGILLLAIGAVVFTTFAVGFAVHWVAPSLPWAACFALGAIVSPPDAVAAKAVLERVALPRRLMVLLEGESLLNDAAGLVLFRFAVVAALSGTFSLGHAVVGFAELGLGGVVVGIVVGKLVVWFLKLLDDDYLVITVAVIAGWIAYIAGEMVEVSGVIATVTAGMIVGWHQHEVFSAAVRTRGTAFWQVIVFLLEAMVFVLIGLSLRGAIHRLGGFEQVLATMVSPMFAVLAAVIVSRFVWIYAVEALKWPVRGIARRGEAPDWKAATIMSWAGMRGVVTLAIALSLPEAMPGRDVILVASFAVILVTVLLQGTTIGPLIRLLRLPQREERAAHHLTEPQTWAYIEAAQLAAIQPLVRDENGVVIHPRLLEQYTYRAELTERAKNEPTYPAEVRAAHYDVVLAAIKAGRTELLRLHRSGHIHDEMLHALERDLDLQEVSAQHARG

SEQ ID NO: 17085 - protein, 345 aa, Saccharomyces cerevisiae YJM789
MTIDNYDNSKQDSSKYEVSGTGDGRNGDGGLPLVQCVARARIPTTQGPDIFLHLYSNNRDNKEHLAIVFGEDIRSRSLFRRRQCETQQDRMIRGAYIGKLYPGRTVADEDDRLGLALEFDDSTGELLASKSTTWDAHNDTLVRIHSECYTGENAWSARCDCGEQFDRAGRLIACDHEPTSNIKGGNGHGVIVYLRQEGRGIGLGEKLKAYNLQDLGADTVQANLMLKHPVDARDFSLGKAILLDLGIGNVRLLTNNPEKIKQVDHAPYLKCVERVPMVPIHWTNSSEGIDSKEIEGYLRTKIERMGHLLTEPLKLHTNPQPTETSEAQNQNRMNSALSSTSTLAI

SEQ ID NO: 17086 - protein, 1565 aa, Gibberella zeae PH-1
MRETIQSYIVRISPPGSDKASPPVKGRDKGKAPRKRVGLTQVYPEPGSKRNHQKLKNDIIALHGLDATSPETWIGWKVDGDPNSGDVNWLEDKHMLPRFMPDSRILTYQWNANYDAYASSDRFSGHATSLLQDLHADRFSECRSNCPIIFIVSCFGGLLLAQALVIASHPTEPGHRQHSSILRHTIGAAFLGTPFGGSPLDDLANQFGNLIHSDKYKFPVMCVYETRHTDLSAYKRRLGANFSSMGLDENYHGIVVDSKSATISGMEAYGFDVRHNMLHKFNDSNDVNFKKIRHWLVKTADIAGETLGCKASNDRPVNDLYDDRSHSGSKSDTRLFDLPGSRVRKNPRKPEAREKLYNKLHFKTLGERYKNIWPAHRATCKWLLKNKEYQAWLDKGKLEDHHGVLWLKGNPGTGKSTLMKFAVSKLSMENPKDIHIFFFFNARGDALEQSTVGMYQSLLHQLFSQIPRLKYVFDDFAQFDLPETDIYESWALQTLESLLMHAISELGSHKLWVFVDALDEGNEKEVRKMITFFGGLGKEAKDANVDMRVLFASRHYPQITISHKVEIILESEKEHYLDIKRYVQSELYIKDGMTAQGIQDEVINRASGFFLWVVLVVEILNETAAKGMNQKEKLKELPDHLSTLFEGILTRDRENMKGTLLCIQWVLFSRKPLTREELYYAILHGANEKETRSWAADYVTIEIMDAFILTCSKGLVQFSGETAQFIHETVRDFLIHDNGMQLIASDATKSIKGAAHDTLKSCCLNCISSTLKIIWGSGRPVRFDNLDRLRGIYDSIVESGRKNYSKSKPLYKTPFLHYALFHLLHHANAAEAGGVSQVSFIQAFQLRSWVYLRKVFLELGTFNSLRSTFLYTLAEEGLGSLIMAMLHADPGKTPHLLVEELLRHEDVELNFRDAEKGRTPMWCDAEEGYEAIVKLLLERQGVDVESKDTEYGQTPLCVAARFGHREVVRLMLYGSSLAGSLKLFSSPRPISHPSHSLRCWNRDAEFNMAYQREFEMQAIPPPSPKTLPSTEPSSNTPTPDPDPDSTSPGALHRLLTSFTRAPPPSHSEDEYSLSSYNTSYATNGRLFNMSKANYNSANTALARELKNRHLQMIAFGGSIGTGLFVASGVALFRGGPASLLIAFITMGTMQFFTMQALGELSVAFPVGVLPLEIIAGAFTTNYWNPDASKSIFIILFFFLILGINLLGVKGYGEAEFIFSAVKITAVMGFILLGIIINIAGEPEGGYIGFSHWQNPGAFNNGFKGFASVLVTATFSFAGTEMVGLAAAETSNPKKSLPAAVKQVFWRISLFYILSILLIGLLVPYNEPRLLGAKYGSDAAASPFVIAIEMSGSDILPDIMNAVILISLISVGNTAVYASSRTIAALAEQSLAPKIFAYIDRAGRPLIAIICCGTVGLLAFVANSDIHNEIFNWLLAISGLSTLFTWASICVCHIRFRKAWRLSGYKLSQLAFKSQVGVWGSWVALAAYTTVLLLQFWVAISPIQPTDQAPFTTPERIKNFFLQVLTVPVILIFYIVHKLWMRTKIVRDKDIDIHTGRRYLQEYAAY

SEQ ID NO: 17087 - protein, 160 aa, Zea mays
EGLTSVFQGSQTSLDVIKAAKHYKLFQRATHVYSEARRVYAFRDTVSSKLSEEGKLKKLGDLMNESHYSCSVLYECSCPELEELVKVCRDNGALGARLTGAGWGGCAVALVKEPIVPQFILKLKEMYYKSRIDRGVIKQGDVGLYVFASKPSSGAAILRL

SEQ ID NO: 17088 - protein, 314 aa, Saccharomyces cerevisiae
MEQLCKRYVHTPAAFIQNIVANTKRTTLATQLSVEKAKKKVPKTALKKKLNSRPKERLPNWLKLNDVFNIHYEKPSNSDINKVNRFFNKAKVEFEWCAASFDDIPENPFLNKKSHKDILKDHGECGTTLIDTLPEVIFLGGTNVGKSSILNNITTSHVSRDLGSLARVSKTTGFTKTLNCYNVGNRLRMIDSPGYGFNSSKEQGKVTLQYLLERKQLVRCFLLLAGDKEINNTDNMIIQYIHEHGVPFEVVFTKMDKVKDLNKFKKKVMSSGLMDLPTLPRLVLTNSLTSSTSPKRFGIDLLRYVIFQSCGLIL

SEQ ID NO: 17089 - protein, 112 aa, Solanum lycopersicum
MAGKMSIVLFVLLVVFLTQNQVSRANIMRDEQQQQQRNNQLYGVSEGRLHPQDCQPKCTYRCSKTSYKKPCMFFCQKCCAKCLCVPAGTYGNKQSCPCYNNWKTKRGGPKCP

SEQ ID NO: 17090 - protein, 378 aa, Streptomyces coelicolor A3(2)
MATDYYAVLGVRRDASQDEIKKAFRRLARELHPDVNPDPKTQERFKEINAAYEVLSDPQKKQVYDLGGDPLSQAAGGGAGGFGAGGFGNFSDIMDAFFGTASQRGPRSRTRRGQDAMIRIEVELDEAAFGTTKDIQVDTAVVCNTCNGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHSTFQRRGDDLHCTVTIPMTAAALGTKVPLETLDGMEEVDIRPGTQSGQSIPKHGRGVTHLRGGGRGDLIVHVEVTTPGKLDPEQERLLRELAKLRGEERPTGQFQPGQQGLFSRLKDAFNGR

SEQ ID NO: 17091 - protein, 189 aa, Saccharomyces cerevisiae
MGKAKKTRKFGLVKRTLNTKKDQRLKKNQENIKTKEDPELTRNIPQVSSALFFQYNQAIKPPYQVLIDTNFINFSIQKKVDIVRGMMDCLLAKCNPLITDCVMAELEKLGPKYRIALKLARDPRIKRLSCSHKGTYADDCLVHRVLQHKCYIVATNDAGLKQRIRKIPGIPLMSVGGHAYVIEKLPDVF

SEQ ID NO: 17092 - protein, 289 aa, Bradyrhizobium sp. ORS278
MDVMARIEKSLVAAVALAGRPGCPPRLSAAMQAAVFPKGARVRPRLCHAVAAACGDDEPAATDAAGSAIELLHCASLVHDDLPCFDNAKLRRGRPSVHAAFGEPLAVLAGDALIVLAFQTLAKSRCSPLRLARLIETIGDAVGVPHGIAAGQAWECEPEIDLSHYHRSKTGALFAAATISGAAAAGHADPEAWRSLGEKIGEAYQVADDIRDAASDEEEAGKPVGQDAALGRPNAVLRYGLAGAVSYLHDLVADGIRTMPPCAHAHELRALMEQEAKRLVPRRLAASAA

SEQ ID NO: 17093 - protein, 538 aa, Triticum aestivum
MGYQVVAAQLARLSGALGTSDHASVVSITLFVALLCACIVLGHLLEENRWLNESITALIIGLCTGVVILMTTKGKSSHVLVFSEDLFFIYLLPPIIFNAGFQVKKKQFFRNFMAITLFGAVGTMMSFFTISLAAIAIFSRMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 17094 - protein, 275 aa, Zea mays
MSKEVSQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRALFYMVAQCLGAICGVGLVKAFMKHSYNSLGGGANSVSAGYNKGSALGAEIIGTFVLVYTVFSATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTN

SEQ ID NO: 17095 - protein, 718 aa, Idiomarina baltica OS145
MIYQGESIRVDFIEPGFAELQFDAKGSVNKFDQKTLQEFSDALTQLAQTDDLRGVIVTSSKPTFIVGADITEFLNMFADPENTREWVAKASRVFDQLEDLPVPTVGAVKGFALGGGCEALLACDYRVADSTATIGLPEVKLGLIPGFGGTMRLPRVIGPDNALEWITTGKNNSALDALKVGAVDAVVEPDNLTEAALNLAKAAAAGEQDWKAKRQPKLEPLKANDTELTMTLVTAKGMVAAKAGKHYPAPHKAIEAIENGAREAREGALNAENQAFFDLTQTDACHAQVGIFLADQAVKGKSKKYAKSASKEINTAAVLGAGIMGGGIAYQSALKGVPAVMKDIKQDALDLGMKEAGKILKKGVERGKVSSEKMIKVLSSITPTLLNDAVKDVDIVVEAVVENPKVKGSVLAEVEGVISDDAILTSNTSTISITELAKNLKRPEKFCGMHFFNPVHKMPLVEIIRGEKTSDETVAAVVAYALKLGKTPIVVNDCPGFYVNRVLFPYLAGFAGMVDEGIDFVGIDKVMEKMFGWPMGPAYLSDVVGIDTADHCTVVMADGFPSRMARNESSAIAQLAKAERYGQKNGKGFYVYGTDKKGKPTKEADPETYKLIGAEPGKQADKDEVIARCMIPMVNEVVRCLEEGIIGSAAEADIALLYGLGFPPFRGGPFRYLETVGIENFVKLADKYAHLGEIYQVTDGMREMAKAGKSYFDTTSAK

SEQ ID NO: 17096 - protein, 196 aa, Campylobacter upsaliensis RM3195
MISSATFLTSLAKFDPNFEANCAEVAFLGRSNVGKSSLINTLCKQKKLAKSSSTPGKTQLINFFEIKCKKNEEEFKIHFIDLPGFGYAKVSKNLKEIWNKNLDEFLKLRTSIKLFLHLIDARHTNLEIDLDVDVYLKSFLRGDQQILKVFTKADKLNQSQKTKLKNDFENSLLISNLNKSGLTLLENIILEKTLGL

SEQ ID NO: 17097 - protein, 513 aa, Physcomitrella patens subsp. patens
MRASFSSGSVVAFVIIATLSYLWIFRWRQRHRIEPKEWPIIGGALETIQHFDVMHDWILSYFNKGLKTFHVKYPGITYTYTIDPNNIEYILKTNFANFPKGELYHRHMETLLGDGIFNSDGEAWRQQRKTASFEFTSRVLRDYSTVVFRENALKVGDILSSVCQKHQPIDMQQDLFMRFTLEGICKVGFGVEIGTLSESLPAVPFATNFDNANEAVTYRFFDPFWPLKQMFNIGNEAVLSRSVKVVDDFTYKVIKIRRAEMDLATSEGHDKKADLLSRFILLGKDPEQNFTDKTLRDVILNFIIAGRDTTAATLSWFVYLLSIYPHVADKIYDELHALEKDANINASQTLNQKMREYSSILSYDVLTKVQYLHAAITETIRLYPAVPQDPKGILADDVLPDGTVLKKGGLVSYVPYAQGRAKVIWGDDAESFRPERWIKDGVFIPLSPFRFSAFQAGPRICLGKDSAYLQMKMVTALLCRFFKFDLMPGHQVKYRTMATLAMENGVKMFVTRR

SEQ ID NO: 17098 - protein, 1088 aa, Nocardia farcinica IFM 10152
MIVGETGPMRVVVVNRGEIAVRIVRAARAHGYRTLVVHTPAEAATLPVRLADDAVELPREGAAAYLDIPAVVAAARTAGAGALVHPGYGFLSENAEFARACAAAGLVFVGPDPRVLATFGDKVAARAAAERAGVPVPPGTPVGADATAVAALLSEHPDGVMIKAAAGGGGRGMRAVRDPDELADAYAQCRAEANAAFGDDRVFAEALVDGARHIEIQVVADGVHARAVGDRDCSVQRRRQKLVEIAPAPELAETVREGLHRAAAALAESVGCRGVITVEFLVRGAEAWFLEVNPRLQVEHTVTEEVTGLDLVGIQFALARGRTLAELALPDTTPRGHAVQARVNAETVTAGGDVLPGSGIVTRFDAPTGAGVRVDTAVFAGLRHTVQFDSLLAKVIARADTHAAAVRRCADALAETVVVGVDTNVAVLRAILDALAEAGPVDTGWFERHVDGILAAAAELAPVVPPEAVPDGSGPDRTGPELGPDEQALATPMGATVVALADTGAVVAAGAEVAVLEAMKMQHMLRAERPLRVLRHLVAPGDVVDPHTALLVWAPAEHDGEDTERATVDLDAIRPDLAEVLERHRGVLDEARPDAVAKRHRLGRRTARRNIDDLVDAGSFVEYGALAVAAQRLRRSQEDLIANTPADGLIGGVATVNADRFGPDATRTVVLSYDYTVLAGTQGMRNHAKTDRMLELAHEQRLPVVFFTEGGGGRPGDTDYPGISGLDVTTFRAMGALSGRVPLIGIVSGRCFAGNAALLGMCDVVIATPDANIGMGGPAMIEGGGLGVFRPEDIGPIEVQRRNGVVHVVAADEAEAVDIARRYLAYFQGADKQWQAPDPRLARHVVPENRLRAFDIRAAIEAVVDVGSVLELRRDWGVGVVTALVRVEGKPYGLVANDCHHLGGAIDAPAADKLSAFLRLCDAHGLPIVALCDTPGFMVGPEAEKHATVTKFSRLFVDAANMRVPWGTIILRKGYGLGAQAMAAGSFRAPRFVVAWPTGEIGGMGLEGAVRLGFAKELAAIADPDERAEAFDALVAAAYANGKALTAATVLELDDVIDPADTRRWIGLLTGPERARGQRFIDNNVREH

SEQ ID NO: 17099 - protein, 449 aa, Streptococcus agalactiae NEM316
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKTDEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 17100 - protein, 253 aa, Brassica napus
MASNFWTSTHYKELKDPEEINVVHPLDAQRGISLEDFRLIKLHMSNYISKLAQHIKIRQRVVATAVTYMRRVYTRKSLTEYEPRLVAPTCLYLACKAEESVVHAKILVFYIKKLYADEKFRYEIKDILEMEMKVLEALNFYLVVFHPYRSLPEYLQDSGLNDTSMTHLTWGLVNDTYKMDLILTHPPHLITIACIYVASVYKERDIKTWFEELSADMNIVKNIAMEILDFYENHRMFTEERVHAAFNKLATSP

SEQ ID NO: 17101 - protein, 470 aa, Solibacter usitatus Ellin6076
MSTGISIHIGLNGVDASAYNGWAGTLSGCVNDANAMKAIADSLGYSSTLLLDSDATSSTVIQQIGSAARQLVAGDILLLTYSGHGGIIDDATGGDPGDDGKDETWVLYDRMVLDDELEQMWTQFSPGVRVVVLSDSCHSGTVTRDIPPDAIPAAGAGKVKPAGIAPSSKKEMLYSKIVQSGALDSHYKGAGSKPVVFRTIPTDVQAAVYQKNKDVYSTRQYGALSKNAGTGATVLLISGCQDNQLSSDGDGNGLFTGTLLQVWSNGSFMGTYHDFHSQIVSQMPPTQTPNYFMTGPDNAAFESQNPFTVQNPSSTDTSSVTDDSDKGMASPSVKGPASVSRTGPTPSFQVSAGNKYYVFEITNDASLFDTQQNSGKRTQRNFYGSWSDDGNKHIPGTQQTYVLPASVWSNLKDADTLYFRIVSTSSQSNWDNYKYSTYDNEVQNAPHLSITGQRGSKDVPSAAYAATQSC

SEQ ID NO: 17102 - protein, 296 aa, Oryza sativa Japonica Group
MDRYQRVERPRPESAIEENEIRITAQGLIRNYVSYATSLLQDRRIKEIVLKAMGQAISKSVAVAEIIKKRVPGLYQDTNISSVSITDVWEPIEEGLVPLEMTRHVSMISITLSPRDLDKNSPGYQTPVYVEQPRQQPRLQQAPPPPQRQVRQPPPDYEDSYVRGRGRGRGRGRGRGWGRGGYGGYGGYGNNQGGYNQGGGYYDNQGGYGGYDNQGGYGGYDNQGGYGGGGYGYNQGRYGNYQENGGYNRGRGGMRGRGNWNYRGGYERGRGGGFPGGRGYGGRGRGRMGGRGGRGN

SEQ ID NO: 17103 - protein, 354 aa, Bacillus anthracis str. Ames
MESMFNKIFLIVALIGVPLSVLGKTLHWPQTIMFAVYCITIIALAGFMGRATESLAIVSGPRIGGLLNATFGNAVELIISIFALQAGLIEVVLASLTGSVLGNLLLVGGLSFFIGGLKYKRQSFNVYDARHNSALLIFAVVVAFVIPEIFSMKMDAGKTYQLSIGVSIIMIIMYLAALLFKLVTHRGVYQHKSDEVAHEEEPEWSKGKALLILAIATIAVAYVSEALVHTFETVAKSFGWSELFIGVIIVAIVGNAAEHASAIIMAYKNKVNIAVEIAVGSTLQIAMFVAPVLVLLSMFFAQRMPLVFTIPELVSMITAVFLTIAISNDGDTNWFEGGTLLAAYVIMGIGFYLL

SEQ ID NO: 17104 - protein, 362 aa, Rhodococcus sp. RHA1
MQVTAALSRGPDSPFTLETVELDEPRADEVLVRIVATGLCHTDLFTKASLPHALGPAVLGHEGAGIVVDVGSRVNGVTPGDHVILSYRHCGDCDQCRSAGPAYCVDAHRLNSSGRRADGSATITQNGEPVRAAFFGQSSFAEHVLATADNVVVVDKSVDLAAAAPLGCGFQTGAGAVLNVLRPGNDSSLVVFGAGSVGFAALLAARSVGVATLLAVDPVPARRALAEEFGAVAIDPGSQDVVAAIRAATGGGATHTLDTTGIPAVIGQALSSLMARGSAVVVGLGAPEVTVNIQDLMLSGKTLRGCVEGDSSVQQFIPQLLALHADGKFPFDRLVTEYRFDDINRAVADQAAGTVIKPVLVW

SEQ ID NO: 17105 - protein, 337 aa, Streptococcus thermophilus CNRZ1066
MGFASYFFKGATIVMVHQKANPKLKLFSLSSNPEIAEKIAENTGLPLGKVSSRQFSDGEIMINIEESVRGDDIYIIQSTSNPVNDHLWELLIMIDACKRASANSVNVVMPYFGYARQDRIAASREPITAKLIANMLVKAGVNRVLTLDLHAVQVQGFFDIPVDNLFTIPLFAEYYNEKGLTGADVVVVSPKNSGVKRARSLAEYLDAPIAIIDYAQDDTGREEGYIIGEVEGKTAILVDDILNTGKTFAEAAKILERGGVNDIYAVASHGLFAGGAGEVLNASPIKEILVTDSVATKENVPTSVKYLSASELIANAITRIFERQPLSPLFAYTANEE

SEQ ID NO: 17106 - protein, 358 aa, Medicago sativa subsp. x varia
MENGKVHVVKPQSEARLAILELAHIMSVPTSLVAVLKMKVPEAIWQGGKNTPLSASQILSIVRPNGGGDAENLQRILRLLTTYAIFAEDLSSNGKRKYSLTDIGKALVPDDDGLSYATYVLQHYQDQYLRAWPLVGDAVEDASVEPFEKLHGEGAYAYCMKRPDEMSLFYASMSGLSMPHMNEMLEKYDGFKGVETLVDVGGNSGVILNMIMNKYPNILKGINFDLPDMISSAPQLPGITHVGGDALESVPAGDAIFTKWTMLTWTDEECKKVLQNCYKALPVNGKLIVCEPVSPELTDESQRTRALLSGDIFIMTMYRTKGKHRTEEQFKQLGISTGFLRFRAFHIDPYFPVLEFQK

SEQ ID NO: 17107 - protein, 178 aa, Streptomyces coelicolor A3(2)
MTQKALITGIGGKDPKVDAEVFVAPTASVVGDVTLHAGASVWYGAVLRGDVERISVGADSNVQDNCTLHADPGFPVTVGERVSIGHNAVVHGATVEDDCLIGMGATVLNGAVIGAGSLVAAQALVPQGMRVPPGSLVAGVPAKVKRELTEEERQGVTLNGTMYAALAGQHRDAVGEVR

SEQ ID NO: 17108 - protein, 319 aa, Coxiella burnetii RSA 493
MPNVDDIRIFHGSANPSLAENVAKELNTTIGNALISRFSDGEIRFEIEENVRGRDIYLIQSTGHPTNEHVMELILMGDAFRRASAASITAVVPYFGYARQDRRVRSSRVPISAKVVADMMQKVGFSRLITVDLHADQIQGFFYMPVDNIYASITALEEYRLLDKLETPMIVSPDVGGVVRARAIAKRLNDSDLAIIDKRRPAPNQAEVMNVIGNVQNRHCVIVDDIVDTAGTLCHAASALKEKGALTVSSYCTHPVLSGNAVKNIMDSDIDELIVTDTIPLHEEAAKCRKITQISLSRLIAETISRINQKESVSSMFLD

SEQ ID NO: 17109 - protein, 124 aa, Zea mays
  misc_feature (60)..(60): Xaa can be any naturally occurring amino acid
RILAEQAQTRAGGLTHARRAAALASKHGYSYYKEVMQKNKQYVPQPPTADKCQELFKQLXHTRLESVPTRYESFPKELDGVKHVWHNRKDLTGADLGLASLLGVELYAWICIGQIVCRGFTLTG

SEQ ID NO: 17110 - protein, 394 aa, Burkholderia sp. 383
MDITAIRADTPLTASTIYLDTAAASLPPEPVLDTVNDYLRDTGRVGIYLPAFRKATYARVDAVRTQLATFLGAQADEIAFTKNATEAISLVAQGLRWQPGDEVLVADTEMLSNLLPWKRLEATHGIVVKMIAANDEGLLAPDAFAQAITPRTRLLTFSHVPNSSGALQDAAALCAVARANGVLSLVNASQSVGMVQTDVRTLGCDFLAGCGRKALRATEGSGFLYVQRDQIDTLEPVLAGWWNGAYDRTTGALSFVAGAKRFEAGCPIVPAILGLGAALDYAQRIGVAQIEARVRDLTAYAVERFATLPGFELYGPRDAARRIGIVPFNLRGIDPATIVAALEAQHCIIEAGNFMADAILARYGVSTMARVSLHYFNTREEIDRVAELIRAAAC

SEQ ID NO: 17111 - protein, 143 aa, Erythrobacter sp. NAP1
MTISKIIGDRDATDIISCEVTTPVAEAVSLLAGKRIGALPVMRDGKIAGIISERDVVYRLAESGHDALDMTVGDIMTSPAVTVEPTTLIDDALALMTKRRFRHFPVVDNDKLVAFISIGDLVKHKIDEVEHEAAALRDYIQHA

SEQ ID NO: 17112 - protein, 239 aa, Oryza sativa
  misc_feature (226)..(226): Xaa can be any naturally occurring amino acid
MERALDSLTYKGSIPDAILQSRRDNKLFVVYISGEDETSSSLEQSTLVNESVAEVIGNCCVFLHLKQGNVDASQFSAIYPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRMVQERQNSENAXQVKGSLPGTSQGA

SEQ ID NO: 17113 - protein, 496 aa, Arabidopsis thaliana
MESEAAATVQATRPRRAPRTPVTAILTDKRRRKPKSNNESQLPFLLQQSQKATVDDTYSQWKTLLPILYDSFVNHTLVWPSLSCRWGPQLEQAGSKTQRLYLSEQTNGSVPNTLVIANCETVNRQVISFSLPKLLNEKAHSPFVKKYKTIIHPGEVNRIRELPQNSKIVATHTDSPDILIWNTETQPDRYAVLGAPDSRPDLLLIGHQDDAEFALAMCPTEPFVLSGGKDKSVILWNIQDHITMAGSDSKSPGSSFKQTGEGSDKTGGPSVGPRGIYNGHKDTVEDVAFCPSSAQEFCSVGDDSCLMLWDARTGTSPAMKVEKAHDADLHCVDWNPHDNNLILTGSADNTVRVFDRRNLTSNGVGSPVYKFEGHRAAVLCVQWSPDKSSVFGSSAEDGLLNIWDCDRVGKKSERATKTPDGLFFQHAGHRDKVVDFHWSLLNPWTIVSVSDNCESIGGGGTLQIWRMSDLIYRPEDEVLTELEKFKSHVFTCTSKS

SEQ ID NO: 17114 - protein, 351 aa, Aspergillus nidulans FGSC A4
MSFNPNSVDLDTADPRDVICYMNAGENDYDGRLGARISAIFVIFVVSTAVTFFPMLAKRNPRLHIPHYVYLFARYFGAGVIVATAFIHLLDPAYDEIGPASCVGMTGHWADYSWCPAIVLASVMGIFLLDFGAERYVEIKYGVCREDPEQFMTSTANNEEAVSRQATSTGKKAGDTLEAQSIDSGYIERSFRQQIAAFLILEFGIIFHSVIIGLNLGTTGEEFPTLYPVLVFHQSFEGLGIGARMSAIPFRKGSWLPWALCLLYGLTTPIAIAIGLGVRTTYNAGSFTANVVSGIFDAISAGVLIYTGLVELLARDFLFDPHRTQDSKRLTFMVISLLWGAGIMALIGKWA

SEQ ID NO: 17115 - protein, 700 aa, Chlamydomonas reinhardtii
MRPLQILVLLVALVLASKAVQAGYSIETAGLKVIFPPDNKKTVQMAMADFGKPRYGATMIGNLIYPSSQPGYGGSSGYTCFPEDCQYGCQNFNASKPVFKIDRQPGQFYIMLLDRGPRNQEGHTACYFLDKVFNAQAAGADAVLVANDAPGELSTAVAPEDDDTAKELQSLTISAAMISLDDANLLRKLMLANPQVTVMLNWTSVVPKSSVVSWEFWTNSNDDCGFSCREQLKFIADMKDKAQALETAGKVKFSPHYLLWNCPAAFINTTECQTECIMNGTYCVPDPDDDPTKGYSGRDVLAINMRQLCFHRLASAAGKAQLWWDYATRFAANCSMAAKTYTVDCAVGVFESLGGADLAPGQTGRAVWDACAGFNESAALAAAATNPAALKIPVLEVRINGRQYRGSLDVGGVMRAICSGFPAGQEPAVCNQGWVSEDECAPGGVGYLACMSGDGGVAGKTKCVNTFQGYSCECKDGMYKYVNPMTGEERCEDVNEAELNWGGCWSGTVKGETFTSCSPSLSLRCECPKCFRATATNTCEPVCDLDQCDRNTGYCSPKAGVSVGGIIGIALASAALTGGLVLAANRYLMKQRMGDEIRDIMAQYMPLQERERNALLAARAGGGGRAGRGPGGGIRPDEDSDDDGNGVGAYGWPGAPHSTAAAPPGGSLGPLGPPAPAAPTLAAAGRGQPVPLRAHTRHRF

SEQ ID NO: 17116 - protein, 385 aa, Geobacter metallireducens GS-15
MNIHEYQAKEILSSYSIPVPRGRVALTSDQVERAAKEMGGRCVIKAQIYAGGRGKAGGVKLVHHPEQAQDYGKELFGKRLVTPQTGPEGLKVRRILVEEAVEIAREFYLSITLDRATSRYCLIASAEGGVDIEEVAQKSPEKIHVLTIDPYTGLRPYLARKIALALGLTGSLCEDCVELMLNLYKVVLDKDCSLVEINPLVVTRAGWLMAMDAKINFDDNAVFRHREYPDMMDYSQLDTLEINAGKYDLSYIKLSGNIGCMVNGAGLAMATLDVLKEYGGEPANFLDVGGGATREKVAEAFKIILEDADVKGVFVNIFGGIMRCDVIAQGIIEAASEVHCTLPIVVRMDGSKVLEGKQLLVDSGLNVQTADSLGEGAERIVQMLG

SEQ ID NO: 17117 - protein, 539 aa, Enterococcus faecalis V583
MAYQFKLPDIGEGIAEGEIVKWFVKPGDTINEDDTLLEVQNDKSVEEIPSPVTGTVKNIVVPEGTVANVGDVLIEIDAPGHEDNDAAPAAPAQEQTPAQPAAVPTTEAAGGFFQFKLPDIGEGIAEGEIVKWFVKAGDTINEDDSLLEVQNDKSVEEIPSPVTGTVKNIVVPEGTVANVGDVLVEIDAPGHNSAAPSVAAPATDAPKAEASAPAASTGVVAAADPNKRVLAMPSVRQYAREKDVDITQVTATGKGGRVIKADIDAFVSGGSQAAPATEAAATEAAPKAEAAAPKAAPKAFTSDLGEMETREKMTPTRKAIAKAMVNSKHTAPHVTLHDEVEVSKLWDHRKKFKDVAAANGTKLTFLPYVVKALTSTVQKFPILNASIDDAAQEIVYKNYFNIGIATDTDHGLYVPNVKNANTKSMFAIADEINEKAALAIEGKLTAQDMRDGTITISNIGSVGGGWFTPVINYPEVAILGVGTIAQEPVVNADGEIVVGRMMKLSLSFDHRIVDGATAQKAMNNIKRLLADPELLLMEG

SEQ ID NO: 17118 - protein, 468 aa, Enterococcus faecalis V583
MVVGDFAIELDTVVIGAGPGGYVAAIRAAEMGQKVAIIEREYIGGVCLNVGCIPSKALIAAGHHYQEAQDSSTFGVTAKGVELDFAKTQDWKDNTVVKSLTGGVGMLLKKHKVEIIEGEAFFVDENTLRVIHPDSAQTYSFNNAIVATGSRPIEIPGFKFGGRVLDSTGGLNLKEVPKKFVIIGGGVIGAELGGAYANLGSEVTILEGSPSILPTYEKDMVKVVTDHFKKKNVTIVTSAMAKEAVDNGDSVTVKYEVNGKEESVEADYVMVTVGRRPNTDDLGLEQAGVEIGERGLIPVDNQGRTNVKNIFAIGDIVPGAALAHKASYEAKIAAEAISGKKVAVDYKAMPAVAFTDPELASVGMTVAEAKEAGIEAKGYKFPFAGNGRAISLDKTEGFMRLVTTVEDNVIIGAQIAGVGASDMISELALAIESGMNAEDIALTIHPHPSLGEITMDTAELALGLPIHI

SEQ ID NO: 17119 - protein, 451 aa, Mesorhizobium loti MAFF303099
MSDAIADVLSWLESRSDIQSLRAAVCDLNGVMRGKRIPVEQARKALEGKLRMPYSLIGLDIWGEDIEGNSLVFSTGDADGLCQWTGRGILPVDWTAHPTALVPLWLADESGAPYLGDPRRALARILDRYKALGLTPVAATELEFYLVDPQSQRPVGPVSPVTGRRLDSDAALSIDEIDDFEAFIHDVYEACRAQGIPVDTAIAENGVGQFEINLNHVADALRAADDAVLFKRTVKGIARKHGFAACFMAKPYGDRAGNGFHVHFSLVDAEGRNVFDDGTDQGSQTMRHAVGGLLAAMAESTLVFAPHFNSYRRLRPRSYAPTAVAWGYENRMVAIRIPGGPAGARRIEHRVSGADANPYLVLAAILGAALIGIERQMSPGEPTGSDGQGAVPAKLPPDWASAIATFESGTHVAEIFPAILRDSFVACKRQELNTFALNVSDFEIETYLESV

SEQ ID NO: 17120 - protein, 385 aa, Streptococcus agalactiae NEM316
MNKLKVNSVVERKIKSGAQLLEKKDFDTSLVNQLVQLFSQSNQFLGMAYLSPQNKGIGWLLSRQVFDFNHDYFVSLFEKSREKRQKFEKFSQTTAYRLFNQDGDNFGGLTIDFYSDYALFSWYNEFVYTNRQMIVAAFKQVYPNIKGAYEKIRFKGLDFESAHLYGQEAPESFLILENNIKYSVFLNDGLMTGIFLDQHDVRKALATNLSEGKKVLNMFSYTAAFSVAAAVGGALETTSVDLAKRSRELSKAHFDANQIVTDNHRFIVMDVFEYYKYAKRKHLSYDVIVIDPPSFARNKKQTFSVTKDYYKLIEQALDILTPGGTIIASTNAANLTVSQFKKQLEKGFGKASHNYISLQQLPEDFTVNDKDQQSNYLKVFTIKVK

SEQ ID NO: 17121 - protein, 412 aa, Medicago sativa subsp. x varia
MTELDPSKKVADRYLKREVLGEGTYGVVYKAIDTQTGQTVAIKKIRIGKQKEGVNFTALREIKLLKELKDPNIIELIDCFPHKGNLHLVFEFMETDLEAVIRDRNIFLAPGDIKSYLQMTLKGLAHCHKKWILHRDMKPNNLLIGPNGQLKLADFGLARIFGSPDRRFTHQVFARWYRAPELLFGTKQYGPGVDVWAAACIFAELLLRRPFLQGSSDIDQLGKIFAAFGTPSPSQWPDMVYLPDYVEYQFVPAPPLRSLFPMATDDALDLLSKMFTYDPKDRISVQQALEHRYFTCPPQPTDPVKLPRPAPKKEIKPSDLNPPEGPTVLSPPRKTRRVMPGRDGLEGNSLQGDRVDDNHGNLKQTGGDNTGKNEPAPMSLDFSVFGLKPPNRPTINSADRSHLKRKLDLEFQ

SEQ ID NO: 17122 - protein, 243 aa, Burkholderia thailandensis E264
MAFFRIATLPTRFPLMTQFRIAPSILSADFARLGEEVRNVVAAGADWIHFDVMDNHYVPNLTIGPLVCEAIRPHVQVPIDVHLMVRPVDRIVPDFAKAGANLISFHPEASDHIDRTLGLIRDHGCKAGLVFNPATPLNYLDHVMDRVDLVLIMSVNPGFGGQSFIPEALNKLRAARARIDAYTARTGREIHLEIDGGVKADNIAEIAAAGADTFVAGSAIFGKPDYRQVIGEMRDALAAVKRA

SEQ ID NO: 17123 - protein, 302 aa, Escherichia coli
MTNLKAVIPVAGLGMHMLPATKAIPKEMLPIPVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFLKGIEKLLSEVTNS

SEQ ID NO: 17124 - protein, 123 aa, Triticum aestivum
MACPTTAAAAVGPGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAA

SEQ ID NO: 17125 - protein, 496 aa, Physcomitrella patens subsp. patens
MAAIANLPSLTPGGLVQESAVVGGKKKTWTRTDFAVAAAAASSLSSSLSASLKWRGRRNYGSGNSSLQGDRAVPFMIQELACVCNRDRKLLQLVCNAADKGSEISGSQVHGEAQRTEEQPYGIPDKEVPKRWDVVGLGQAMVDFSGTVGDDFLEELGLVKGTRKVVGHEERGKVLRALDGRHYKLSAGGSLSNTLVALARLGFGSSQNSAQNVAMTGSVGSDALGDFYRTKLLRANVHFLSQPVVEGTTGTVIVLTTPDAQRTMLSYQGMSSIVNFDSALANAISKSRVLVVEGYLWEINQTIEAIAQACEAARQQGVLVALTASDVSCVTRHRQQFWDVMCQSTDILFANADEARALCAFGDDSTPEQATKHLNQFCPLVSVTDGPRGSYIGLRGEVVFIPPAPCVPVDTCGAGDAYAAGVLYGLLRGVPDVKGMGDLAARVAAVVVGQQGTRLKEEAALELAESVNSLSDLLDNRIMELMGMKDEVVSERISSV

SEQ ID NO: 17126 - protein, 188 aa, Legionella pneumophila str. Paris
MNKIICLLSNLLLTVGIMSAHAETAIIKTSEGNITCELFTKEAPNTVANFVGLATGTKEFKDVKTGEMVKRPFYNGLIFHRVIAGFMIQGGDPLGNGTGGPGYTFDNENTNASFNKPGVLAMANAGPNTNGSQFFITVAPTPELQGNYNVFGQVISGQEVVDKISKMPTDPQDKPIKPVVIENITIQK

SEQ ID NO: 17127 - protein, 374 aa, Arabidopsis thaliana
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQLEQEVLEKEIGRLRALYQQQQQTQKPSASRGRATSKDLDSQFSSLSLNTKDSNCRRDSVSVMGQFNF

SEQ ID NO: 17128 - protein, 117 aa, Medicago sativa subsp. x varia
MGIPSELRDMWIANKNTSLLIASPAEEQKMLRSSQCTAEGVRAGFKAAGIGCVASTVPTLVAVRMIPWAKANLNYTAQALIISAVSVVSFFVAADKTILACARKQSLLLEESLKHER

SEQ ID NO: 17129 - protein, 175 aa, Bdellovibrio bacteriovorus HD100
MKHWIFVMVFVFSAAISAKEKEYVKPSDAELKKTLTPMQYQCTQQSATEKPFDNAYWNNKREGIYVDIVSGEPLFSSTDKYDSGTGWPSFTKPIDDSSLVTKPDYEMSVERTELRSKKADSHLGHLFDDGPKDKGGKRYCINSAALKFIPVEEMQAKGYGQYLSLFPKYKKEKKK

SEQ ID NO: 17130 - protein, 79 aa, Chlamydomonas reinhardtii
MIIPVRCFTCGKVIGNKWDTYLDLLQAGYSEQEALDGLGLSRYCCRRMLMTHVDLIEKLLNYNTLERAAQAQGAQRTGQ

SEQ ID NO: 17131 - protein, 504 aa, Chlamydomonas reinhardtii
MGNLCSCVGEGQTNAAAASAQNGQAAPAKQAAPKKEPGPMDIIEQALAEAQRELDKNKGHDFNDKYKVSKLVGHGAFAKVMICSHKDTHEKFAVKTVQKNQEDPGKQREGILKEIAIMRMLCDHPNTIKLYEVFEDKESYHLILELCSGGELFDQIIAKGHFSEKDASEKMHCLLDFIAYAHSKNIIHRDLKPENILLSDKTQHAILKVIDFGTSDFCLDGQRLSQKFGTPYYVAPEVLKKDYDKSADIWSAGVIMFILLCGYPPFGGKTDAKILQRVQAGQYSFDGKEWEVVTEAAKDMIAHMLVMDIAKRATAKQLLQHRWFQVAATAPAAALGAHMVKRLRAFAGMSRMKRLALVVLARTLTDNDVKRLRELFVAMDTNNDGRIDSNDLHKALEKVGAAIDESEMQDLFHASDIDGSGQIDYEEFIAAMLDSNRVARRKEAVRKSFEELDKDGDGFITAEDLVKVMPRGSSIELAREMVNEVDKNNDGRVDYAEFEKMMQS

SEQ ID NO: 17132 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 17133 - protein, 336 aa, Gibberella zeae PH-1
MSRYTAAHANLQGPGDARPTALQIVKDEDLVGKLTDKVILVTGGNSGLGLETAKTLHATGATVYITARTSEKLEEAIKDIKAWPEAESSAPVYGIELQLDSLASVRAAAKKFLEKSEKLNILILNAGVMATPEGRTEDGFETQFGTNHLGHFLFFELLKPALIASSTPSFHSRVVSLSSKGHRYGGVRFDDFNFEKEPYIPWIAYAQSKTANIYFASELERRYGSQGLHGLSVHPGFIFTNLARHIDVSQIDVKGDTKNYVKNIEQGSATTVYAALSKDWEGRGGRYLADCDEEPPLKPGIDPASSAPGYASWIYNEEAEGRLWAESLRLVGLKKD

SEQ ID NO: 17134 - protein, 299 aa, Campylobacter coli RM2228
MRVYKKVNELIGNTPIIQLEKFGANLFAKCEFLNPSHSIKDRAAFAMIQSALNEGKIDSKTVIVEATSGNTGIALAMICADLGLQFVATMPESMSIERRKMITLFGAQLELTPASLGMKGAVDKANEILKNTPNSFMPSQFDNLANKNAHRKTTALEILKDLDNDLDIFVAGFGTGGTISGVGEILKEKLGKIHVVAVEPLASPLLSKGEAGSHKIQGIGANFIPAILNKDVIDEIITVSNEDAINTAKELAKNGLMVGISSGANVFAASVLAKKFPDKKILTMLNDTAERYLSTDLFA

SEQ ID NO: 17135 - protein, 363 aa, Coxiella burnetii RSA 493
MGFKCGIVGLPNVGKSTLFNALTKAGIEASNYPFCTIEPNVGVVSVPDKRLEKIAQIVNPKQIIPTTVNFVDIAGLVAGASKGEGLGNQFLANIRETQAIAHVVRCFQDENVTHVAGSINPIADIEVVNTELALADLETLDKILVKLAKDVKRGDKKARDTYALLEKFKKLLDEGTPIRSVNLTEEEEILLRPYQLLTSKPVLYVANVAEDGFTDNSYLSQVYEFAAKEKAKVVPVCAAIESEIADLSASDQQDFLQSLGLEEPGLHRVIQAGYQLLGLITFFTAGPKELRAWTCPKNSTAPQAAGVIHTDFEKRFIRAEVISYNDYTQFGGEQGAKDAGKWRLEGKEYLVQDGDIMYFRAGN

SEQ ID NO: 17136 - protein, 330 aa, Gibberella zeae PH-1
MPCHPTEPEFEVRDIPSLRGYVAIVTGETDYSGNSGIGYETTLQLALKGARVYIASRSNDRVNKAIAEMHKNSPDLDLHFLKLDLQDMQSIKDTTADFMSRENRLDILINNAGIMSSPWELTKDGHEIQWQTCFLSHHALTMSLMPLLVTAAQVSGRMDRVRIINVASDMALRMGPEAIHYDDPNLTNETGKLAPWRRYGHCKEASIIAAKAITDRYQSLGVTAYSLHPGLVKSNLQSHNPTMLGAMSRMMFKVGPSSTPLEGAMNSLFCATSHKVYEHAGRYYVPVQKLDDRANKWLDDAQAVNKLWDLATRQCREHGFIIDDIPGYYN

SEQ ID NO: 17137 - protein, 309 aa, Campylobacter coli RM2228
MRGYKIFSGSANVEFAKQISKYLSLPLSDAGVKRFSDGEISVQIDESVRGKDVFIIQSTCVPTNDNLMELLILTDALRRSSANSITAIIPYFGYARQDRKANPRVPITAKLVANLIEAAGIDRVATIDLHAGQIQGFFDIPVDNLYGSIVFNDYIKTKHFKNAIVGSPDIGGVARARSVAKNLGLDIVIVDKRREKANESEVMNIIGDVKDKEVILVDDIIDTAGTIVKAAEALKNKGAKSVMACCTHAVLSGKAYERIASGALDELVVTDTIPLREQLPNIKVLSVAPVFAEVIRRVYHNESVNSLFI

SEQ ID NO: 17138 - protein, 165 aa, Brachypodium sylvaticum
MSTPSDPAASVQPTSTASTAASSSSGLTFKLHPLVIVNVSDHHTRVKAQAACSGEGSSAQKQEPPRVFGCVIGVQRGRTVEIFNSFELVLDPVTGTLERAFLEKKQELYKKVFPDFYVLGWYSTGSDVQDSDMLIHKAVSTLDHGALDLLFKFPNLILWTDNVPV

SEQ ID NO: 17139 - protein, 506 aa, Shewanella sp. ANA-3
MIYAQPGTAGAIVNFKEKYANFIGGKWVAPVNGDYFENRSPVNGQNFCKIPRSDYRDIELALDAAHAAKDAWGKTSVTERANLLLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGILNVVNGFGAEAGQALATSKRIAKLAFTGSTEVGYHILKCAAESLIPSTVELGGKSPNLYFADVMDHEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGDQSKGYYISPTIMKGHNKMRIFQEEIFGPVISVTTFKDEAEALAIANDTEYGLGAGVWTRDMNRAQRLGRGIQAGRVWINCYHAYPAHAAFGGYKKSGIGRETHKMMLNHYQNTKNLLVSYDINPLGFF

SEQ ID NO: 17140 - protein, 289 aa, Brachypodium sylvaticum
MLSLGAIRKLCAAFDAVALTVIAAGLSHPRSRPFSTRAHSTPPDFPTIASCRAAVARSKNHRRRPPDAPAGAEDKGSRDSETPLLVRIKNERNPKRLYELFRANAHNRLLVENRFAFQDAVARLSGARRNDLVEEILEQHKALPQGRREGFVVRIIGLYGKARMPEHALRTFQEMEMYGCTCTNKSFNATLKVLMQAQLFDKALQLFEEGPGKYGVELDDISYNTVVKMMCDMGQLRAAYRVMQEMEKEGIQPDVITYTTLMAAFYKNGQREVGDGLWNLMRLRGCMPT

SEQ ID NO: 17141 - protein, 1462 aa, Aspergillus nidulans FGSC A4
MDPITDSRPKAVDRDSTATSCNSTLDENQIENDREVTNLARVLSERSKHSHHQLPFNFGKDPSLDPQNAQFNARAWAKAFYNVRYSSTDAPPPRVAGVAFKNLNVAGYGSPVDYQMSVGNALLKLPTLAWQWLGGKKQRTEILQDVDGLLLPGEQLCVLGPPGSGCSTLLKTIAQETHGFEVDPSSYVNYQGITPKQMSKKFRGEAIYTAEVDAHFPQLVVGDTLYFAALARTPRHVPGGMSREEYAVHLRDVIMSTFGISHTINTKVGNDFVRGVSGGERKRVTIAEAALSYAPLQCWDNSTRGLDSANAVEFCKTLRTQGDVFGITSCVAIYQAPQAAYELFDKVTVLYEGRQIYFGPAKEAKDYFIRLGFVCPEAQTTPDFLTSMSSPVERVIRPGFENLVPRTADDFAQRWKESPERQALLRDIDRYNTEHPFNATDLDLFSSSRDAEKSKNQRPKSPYTLSYWGQIRICLWRDFQRLKNDPSVTLAMLILNFFEALIISSVFYNLPGNTSSFFSRGALLFMMVLLSAFSSVLEIITLYEKRTIVEKHSRYALYHPSAEAISSMIMDMPYKIVNSLLNSLVLYFMGNLRREAGAFFFLYLISFAMMMGMSMFFRFFASLTKSIEQALAPSSIILLALVLYTGFAIPVSYMRGWASWIRWLNPVSYGFEAVMVNEFNGREFPCVSFVPSGPGYENVSPQERVCSTVGAVPGSDVVQGADFVRSSYGYEYSHRWRNFGIIVALTVFLTMCHLVTSELVSSQRSKGEVLVFRRGKAQKMREKRHHTDEEQIAAPAAQNEKVIQEEPGLVSGVEQQSSIFHWEDVTYDIKIKGETRRILDRVDGWIRPGTLTALMGVSGAGKTTLLDVLASRTTIGVVGGNMLVDGRSRDESFQRKTGYVQQQDLHLHTSTVREALKFSALLRQPPQYSRAERLAYVETVIDLLNMREYADAIVGVPGEGLNVEQRKRLTIGVELAARPKLLLFLDEPTSGLDSQTSWSICNLMETLTKNGQAILCTIHQPSAMLFQRFDRLLLLAKGGKTVYFGEVGQGARTLMDYFVRNGGSACPPGANPAEHMLEVIGAAPGAQTDIDWPEVWRSSPEYQQVRSELARLRELANRPSPVSDPNDKSSYAEFAAPFSEQLLQVGRRVFQQYWRSPSYIYSKALLTVGCSLFIGFSFFKADNTRQGLQNQMFGVFVFLFVVVQLVMQVIPSFVTQRTLYESRERQSKTYAWQAFVLSNIIVEFVWNTIMAIFCYLVWFYPVGLYQNARYTDTIHSRSTLTLLIIWAVFLFASSFAHMLIAGVDSAEMASALSNIFFIMMYAFCGILAGPNALPGFWIFMYRVNPLTYLVSSLLSATLGDAPMHCANNEVLTFFAPPGLTCREYMEDYRSVNGGYLLNPDAQGSDQCQFCSLEYTNQYLSSLSIDFNNRWRDFGLLWVYVIVNTVGAIVFYKLFRVPRAKKD

SEQ ID NO: 17142 - protein, 231 aa, Triticum aestivum
  misc_feature (193)..(193): Xaa can be any naturally occurring amino acid
MAAAAAAAAKIAPSMLSSDFANLASEAERMVRLGADWLHMDVMDGHFVPNLTIGAPVIESLRKHTKAYLDCHLMVTNPSDYVEAFGKAGASGFTFHIEVTRDNWKELIQSIKAKGMRPGVSLKPGTPVEDVFPLVEAETPVELVLVMTVEPGFGGQKFMPEMMDKVRTLRKKHPSLDIEVDGGLGPSTIDAGXRSAGANCIVAGSSVFGAPDPGEVISALRKSVEASQIKS

SEQ ID NO: 17143 - protein, 505 aa, Mesorhizobium loti MAFF303099
MNGGPEIVDLFVIGGGVNGAGIARDAAGRGLSVILCEKDDLAEGTSSRSGKLVHGGLRYLEYYEFRLVREALIEREVLLESAPHIIWPMRFVLPHSPDDRPAWLVRLGLFLYDHLGGRKRLPATRTLNLRTAPEGAPIKDAFRRGFEYSDCWVDDARLVVINALDAAERGARVFTRTACTAARRESGLWVVEMRDGRTGIRTVVRARALINAGGPWVNDIVNRVAGQNSTRNVRLVKGSHIVVPKFWEGRQAYLIQNSDKRVIFINPYQNDLALIGTTDIPYDGRPEDVAADESEIDYLIAVVNRYFKRGLARGDVVYSFSGVRPLYDDNADNPSAVTRDYIFELDAPDAQAPLLSVFGGKITTFRKLAEHALDRIAPFFPHMGKPWTAKAHLPGGDIANADFEQFLGDLGGEYPWMPASLLKHYGRLYGTRTRALVGPARSLDELGRCFGKDFFEREANYLFDREWAATSADILERRTKHGLHLSAEERAAFEHWCANRLARAG

SEQ ID NO: 17144 - protein, 161 aa, Pyrococcus furiosus DSM 3638
MNEVERTLVIIKPDAVVRGLIGEIISRFEKKGLKIVGMKMIWIDRELAEKHYEEHKGKPFFEALIDYITKAPVVVMVVEGRYAVEVVRKMAGATDPKDAAPGTIRGDYGLDIGDAIYNVIHASDSKESAEREISLYFKPEEIYEYCKAADWFYREKKQAKC

SEQ ID NO: 17145 - protein, 218 aa, Physcomitrella patens subsp. patens
KPLEGYGALLLDVGGTLLETAQPVPEVYARIGAKHGVKTAPANIKKGFKKAFAEPWPERLRYEGDGRPFWRYAVATATGCSDEKYFEELYQHFARGDAWKIASGAPEALRRLHNAGVKLAVVSNFDSRLRPVLRDLQIDTLFDALIISAEVGYEKPSREIFQAALNELDVDASAAVHVGDDPTNDKQGALAAGLESWLWKVDVKSFEELADRVLQPAR

SEQ ID NO: 17146 - protein, 200 aa, Brassica napus
MATEDVNEALAAAEVTAIESTEKQQPPHKLERKWSFWFDNQLKPKQGAAWGASLRKACTFDTVEDFWGLHETIFVPSRLTPNADIHMFKAGVEPKWEDPECANGGKWTYVVTNNRKQAFDKAWLETLMALVGEQFDEADEICGVVASVRQKQDKLSLWTRTKSNEAVLMGIGKKWKEILDVTDKIAFTNHDDARRSRFSV

SEQ ID NO: 17147 - protein, 445 aa, Idiomarina baltica OS145
MTDTLTDYFASLKKRVKPAPVLVSGYLTRVVGLMFEAVGVRAPIGATCAVESAHGDIEAEVVGFEGQTSYLMPMDDAHGVVPGAKVKPLTRTEQLPLGLELLGRVIDARGHPLDAKGPILTDNQNAYRSLPINPLNRRPVKVPLDVGVNAINACITVGQGQRMGLFAGSGVGKSVLLGMMTKGTNADVIVVGLIGERGREVKEFIDEILGEEGLEKAVVVAAPADQSPLLRLRGCETASKVAEYFRDQGMNVLLLMDSLTRYAMAQREIALAVGEPPATKGYPPSVFARLPALVERAGNGGGAQGSITAFYTVLTEGDDLQDPIADSARAILDGHIVLNRELADSGHYPAIDIEASISRVMPQVVSDEHLQRATKVRQWYSSFRRNRDLISIGAYSKGSDAKIDEAIAMQPQVEGFLTQRMNEVISYDESLMKLQQLTQRAFASR

SEQ ID NO: 17148 - protein, 347 aa, Euphorbia characias
MASKLVLVSCLLVAFWFCAIEAQTKPPIVNGLSWTFYKSSCPKVESIIQKELKKLFKKDVEQAAGLLRLHFHDCFVLGCDGSVLLNGSAGGPSEQSELPNLSLRKQAFKIVNDLRALVHKECGPVVSCSDIVAIAARDSVVLTGGPKYDVPLGRRDGVKFAEVNATFEHLVGPTANVTTILAKLARKGLDTTDAVSLSGGHTIGIGHCTSFTERLYPSQDPTLDKTFANNLKRTCPNVNTENSTFLDLRTPNEFDNRYYVDLMNRQGLFTSDQDLYTDKRTRQIVIDFAVNQTLFYEKFIIGMIKMGQLEVVTGNQGEIRNDCSFRNSDNYLVSVTDEESGSSSELR

SEQ ID NO: 17149 - protein, 437 aa, Solibacter usitatus Ellin6076
MIPGNLERFPDLHPAFDSQAAVAEANRCLYCFDAPCAAACPTHIDVPRFIKKISTANLRGSALAILDANILGLSCSRVCPVDVLCEGSCVMHGYNKNPIEIGRLQRYAMDAFYANGARLPVANGNKAASAKVACVGGGPASLACAAELRRLGAAVTIFDNRPLPGGLNTYGVAEYKLRPADSLREVELVRGMGVEFRQAEIGEALPLEILERDFDFIFIGVGLGAMERLGIPGDQLPGVIDALRFIERYKTQPDFETGKTVIVIGAGNTAIDAANAAVRLGAKDVHLFYRRSEKEMPAFPFEYDHAKVEGVRFHWLAQPVAIIEEDGRAAAVKFARTTLGEPDASGRRHAHVIPGSEYEVSCDMVVPALGQTRLTGQLKVEIERGSIVVDRPTGRTSNPKYYAGGDCVNGGREVVDAVADGKRAALAMVRELEARRG

SEQ ID NO: 17150 - protein, 311 aa, Glycine max
  misc_feature (239)..(239): Xaa can be any naturally occurring amino acid
PRVRDVRAKLAKDLPSISGVESHDANVAERQEGTEVVQPSMSVMAGPLLSMQDSMKSDEILRSPNKDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKXFLQFLPSLIAASAVLLARWTLNQSEHPWNSTMEHYTNYKVSELKTTVLALADLQHDMKGCSLNSWPRGPNSL

SEQ ID NO: 17151 - protein, 343 aa, Oryza sativa Japonica Group
MLLAKPHLSSSSFLPSTRVSSPAPGPNHAKPIAASPAPRRCLRLAVTSAAAPAASSAEAAAALSRVDVLSEALPFIQRFKGKTVVVKYGGAAMKSPELQASVIRDLVLLSCVGLHPVLVHGGGPEINSWLLRVGVEPQFRNGLRVTDALTMEVVEMVLVGKVNKHLVSLINLAGGTAVGLCGKDARLLTARPSPNAAALGFVGEVSRVDATVLHPIIASGHIPVIATVAADETGQAYNINADTAAGEIAAAVGAEKLLLLTDVSGILADRNDPGSLVKEIDIAGVRQMVADGQVAGGMIPKVECCVRALAQGVHTASIIDGRVPHSLLLEILTDEGTGTMITG

SEQ ID NO: 17152 - protein, 509 aa, Arabidopsis thaliana
MLDISNYVFFFFTLVTILLSCLVYILTRHSHNPKCANLPPGPKGWPVVGNLLQFARSGKQFFEYVDEMRNIYGPIFTLKMGIRTMIIISDANLAHQALIERGAQFATRPAETPTRKIFSSSDITVHSAMYGPVWRSLRRNMVQNMLCSNRLKEFGSIRKSAIDKLVEKIKSEAKENDGLVWVLRNARFAAFCILLDMCFGVKMEEESIEKMDQMMTEILTAVDPRIHDYLPILTPFYFKERKNSLELRRKLVQFVVGFIEKRRLAIRNLGSDKTASSFAYLDTLFDLRVDGRETSPSDEDLVTLCSEFLNAGTDTTGTAIEWGIAELISNPKIQSRLYDEIKSTVGDDRTVEEKDLNKMVFLQAFVKELLRRHPPTYFTLTHGVTEPTNLAGYDIPVGANVEFYLPGISEDPKIWSKPEKFDPDRFITGGEDADLTGVAGVKMMPFGIGRRICPGLGMAVVHVELMLSRMVQEFEWSSYPPESQVDFTGKLVFAVVMKNPLRARVKARV

SEQ ID NO: 17153 - protein, 848 aa, Oryza sativa
MRASPMAGASHHLVVFLAALLALLPGSSQLQYSQTWTLFKIQQMLNHPPVLSHWRRTTDFCGGGGTAAPSAAVVCYGDTVTQLHIAGVRGAPPLPMNFSIGALVMALSRLPDLKVLTLSGLGLWGPLPDKIGRLAALEIVNMSGNYLYGGVPGGLSQLTGLQTLILDDNLLAGELPAWIGELPQLAVLSLRNNSLGGAVPASVGRMESLRSLVLASNNLTGNLPDMSGLTNLQVIDVGDNWLGPAFPALGRKVVTVVLSRNRFTGGLPGEITSFYLLERLDVSWNRFVGPFMPALLSLPAIRYLNVAGNRFTGVLSDKVACGDNLQFVDLSSNLLTGSEPACLRPDKKPATVVLVNANCLEATGGDASQHPSPFCQNQALAVGITHGGKVRKKLTHHAGFLAGIAMAALAAASAIAVVAVVAVRRKNKKGVMVRPPAMLGEDNSSSTSGYPSKMFADARYISQTVKLGALGIPPYRTFSLVELEAATDNFENSLLLGQDSFGEMYRGRLGNGTLVAIRSLKVKRNQSSLSFSRHIETISRLRHRNLVSALGHCFEYDLDDSTVTQLYLVFEYVQNGNLRSRISQGTEGRKLTWAQRISAAIGIANGIQFLHAGMMPGLFGNNLKINNILLDQNHVAKISSYNIPILGEAMKSEKCYDVCQSKKGGPGGKHHTESPLLNDKTDIFDFGVILLEIVSGKPITSLYEVEIMKELMLWAVADEDLVRRRSFADQEVSKGCSDESLRTIMQICLRCLAKEAVQRPSIEDVLWNLQFAAQVQDDWEGDNRSSDGSMVSSSSRITKSSRFQNEQTRSGREKECEDSSARGSVWLQAATEDGNFETGRRQAEDERY

SEQ ID NO: 17154 - protein, 200 aa, Glycine max
  misc_feature (39)..(39): Xaa can be any naturally occurring amino acid
  misc_feature (107)..(107): Xaa can be any naturally occurring amino acid
LPLTSSAQDEEKLVVEPSHTKTSLPQLPAKDINNKISLXSTLAALGLFLSTRLDFGVSLKDLSAIAMPYEEALSNGKPTVVEFYADWCEVCREFAPDVYKVEQQFKXDQVNFVMLNVDNTKWEQELDEFGMEGIPHFAFLDKEGNEEGNVVGRLPRQYLLENVDALARGEASVPHARVVGQYSSAEARKVHQVADPRRHG

SEQ ID NO: 17155 - protein, 727 aa, Oryza sativa Japonica Group
MAQHTAAAAGGDEEVAEAEAAAAAAAGSTLRHRHAGKGAEEHEAAGGGGGGRNGGADDPDATSVERVFADKAVPSWREQLTLRAFVVSALLAVMFSVIVMKLNLTTGIIPSLNVSAGLLGFFFVRLWTSAVERIGLLKQPFTRQENTVIQTCVVSAYGIAFSGGFGSYLFGMSETIAKQATEAKDAQNIKDPHLGWMIGFLFLVSFIGLFALVPLRKIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLQAYRVFISIALILGDGLYNFLKVLIRTIAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 17156 - protein, 441 aa, Chlamydomonas reinhardtii
MSRLAQLLPGYACNTFDYANRSASIEDGLPTYRDWIEVFRKSIPTFKSHALTDKTVPEDQREAAAERFAADFNAALDALLAHPSQPAPGYPASQPLNCFNLCRLREDVLHAAGFTDIFADVKAAESARALVLLPGVCAELDSHGSLAEQFGLALRGVFAGNIFDLGAAASAELHAAGGVSFAATRDQLLPRPWAVDDYDRVLALVAAAEQRTGTAAATAADSSAPAASEAAASASSASPAASFVPPGRPLLWRKAALFVDNAGPDVMLGMVPLARLLVKMGAEVLLMANRGATINDITAAELGPLLEAAAAAEPAGPLGWAVGSGRLRVVCSGSDMPVIDLAQLSEEAVAATADCDLIVLEGMGRAIETNLNCRLACDSLKLGMIKHPEVAALLGGRMYDCVCRYHPGATASAGEAMAQAVEVEVEVAGQGSGAGAAAGAV

SEQ ID NO: 17157 - protein, 308 aa, Burkholderia thailandensis E264
MPAAFPDVLALGEAMVEFNQARPGEPNYLQGVGGDTSNFCIAAARQGARAGFVSAVGDDHFGRLLLDLWRGEHVDTSYVRIDDGAPTGVYFVSHGEHGHAFDYLRAGSAASRYAIRDLPLDALAAARFVHLSGVSLAISTSACDAAFAAIGHARANGARVSFDTNLRLKLWPLPRARAVMTEALRHTDVCLPSWDDVTALTGLVERDAIVDALLGLGPSVVALKLGREGAYVATPGERRVVPGFAVDALDATGAGDCFGGAFVARLAAGDDPFSAARYANAAAALSTRGFGAVAPIPSRDAVERLLNG

SEQ ID NO: 17158 - protein, 203 aa, Brassica napus
MLKGMTAQFLLRRCFKVERGHTILVHAAAGGVGSLLCQWANALGATVIGTVSTNEKAAQAKEDGCHHVIMYKDEDFVSRVKDITSGKGVDVVYDSVGKDTFKGSLACLKSRGYMVSFGQSSGSPDPVPLSDLAPKSLFLTRPSMMQHNETRDELLECAGEVFANVASGVIKARVNHKYPLSRVADAHADLENRITSGSVVLLP

SEQ ID NO: 17159 - protein, 857 aa, Arabidopsis thaliana
MKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 17160 - protein, 768 aa, Oryza sativa Japonica Group
MVKLAFGSCGDSFSASSIKAYVAEFIATLLFVFAGVGSAIAYGQLTKGGALDPAGLVAIAIAHAFALFVGVSMAANISGGHLNPVVTFGLAVGGHITILTGIFYWVAQLLGASVACLLCSSPPTDRLAIPTHAIAGISEIEGMVMEIVITFALVYTVYATAADPKKGSLGTVAPMAIGFIVGANILAAGPFSGSSMNPARSFGPAVAAGNFAGNWVYWVGPLIGGGLAGLVYDDVFIASYQPVMIGFTVILCDRSDQAVYAGQTSGDRAVTRCLGRVFAVMDRESAWCRMQSYIMAENYDIWRKVSLPYVIPEVINTAAEKIAFELNCKARNILLSGISCSDYDRVAHLQTAHEIWVALNNFHQGTNNIKEFRRDLFKKEYIKFEMKPGEALDDYLSRFNKILSDLRSVDSSYDANYPQSEISRHFLNGLDMSIWEMKVTSIQESVNMSTLTLDSLYTKLKTHEMNILSRKGDSKSSALVSSSTSLDVGASSSKSSVLALFNAMSDDQLEQFEEEDLVLLSNKFSRAMKNVRNRKRGEPNHCFECGALDHLRSHCPKLGRGKKEDDGRVKEDDVNKKKNMKEKEKKKHCIKWLIQKLIKVFDESEDEDESKGKQVVDLVFIARNASSDVDESDDDNEEKLSYDQLEYAAYKFGKKLQTCSIVLDEKDHTIEILNAEIARLKFLIPNDDNCQSCEVLFSEISALRYVNSVNCKKLEFEIEKSKKLESSFALGFALLARVVDELILTKNVLKKIQSGFLCKFFSQCFMCK

SEQ ID NO: 17161 - protein, 414 aa, Brachypodium sylvaticum
EDERRRRKIGSLRRKAIHALKKRGRRRVDFRFPAAISIEDVRDAEEERAVAAFRDRLAAHGLLPDKHDDYHMILRFLKARKFDAEKAMQMWGDMLRWRKEFDVDTILEDFEFHELDEVLCYYPQGYHGVDREGRPVYIERLGKVDPNKLMQITSVERYIKYHVQEFERAFRERFPACTLAAKRHIDSTTTILDVQGVGFKNFSKIARELVHRMQKIDSDYYPETLHQMFVVNGGSGFKLIWNSVKGFLDPKTSSKIHVLGSNYQSRLLEVIDPRLLPEFLGGSCSCADKGGCLGSNKGPWNDPFILKLIHNLEAGCARDIKPISDGEEQSNSSLRLEQLKWQGMICDTSNAESGSDVDDLVSSFVPKGTEYGCLTPVHEEVKGIDSSTYFICDDQNFLDISLQTGRGARRMEII

SEQ ID NO: 17162 - protein, 585 aa, Erythrobacter sp. NAP1
MLKHFSIIAPIALLATACADMDAPVASPASAAQITTPGAVSAADPRAAAAGEAILAKGGSAADAAIAVMLALTVVEPQSSGIGGGGFMIHAGSDGIESFDGRETAPATATGTRFLDADGERLPRETRVTSGLSVGVPGNIALAALAHKEHGNLAWAELFEPAIALAREGFVMNRRLHQSLSGQQSRAGKTEAARAIFFGEDGEPLPVGAMVKVPELADTLERIAAGGPEVFYRESAAEFAQYVAAETPQDGKMSASDVRAYTAKMRDPVCAPYRTYKVCGMGPPSSGGVAVAQMLGQLEGFDLSALGPQSAEFWHLFLESQRIAYADRELYLGDADFVEVPVDGLVNPDYMASRGALIDRSTAIAEVQPGTPPGAPMARADGDEPPENGTTHFSVVDGEGNAVSYTSTIEGAFGSGLHWGGFYLNNELTDFSSSPDVNGVPVANRVEGSKRPRSSMAPTIVFDADGEIVLVIGAAGGPTIPVQVARSIIGVIDFGMSAEEALALPLLMSFGSVAITEEGSVAAAVADQLTAMGHGEIRVISPRGKTNALLRTENGWESAGDPRIADLLRYEPLSASEGNRGAEQP

SEQ ID NO: 17163 - protein, 800 aa, Burkholderia xenovorans LB400
MTNAVTVAKDKAYVVPFEQLRMTDVEIVGGKNASLGEMISQLAEAGVRVPTGFATTALAFRDFLQHNNLTERIAKRLETLDVDDVKSLAEAGKEIRQWIVEAPLQPQLEADIRAGFDTLQNSSPEELSFAVRSSATAEDLPDASFAGQQESYLNVVGIDDVLDRMKHVFASLYNDRAISYRVHKGFTHAEVALSAGVQRMVRSDVGAAGVMFTLDTESGFKDAVFITSSYGLGETVVQGAVNPDEFYVYKTTLAQGKYPIIRRSIGSKLIKMEFTKAGEEGRVKTVDVSHEQRNRFSITDEDVIELAKYAVIIEKHYERPMDIEWGKDGRDGKIFILQARPETVKSQAAGKAEQRFKLKGQSNVLATGRAIGQKIGAGPVRVIHDPSEMDRVQPGDVLVADMTDPNWEPVMKRASAIVTNRGGRTCHAAIIARELGVPAVVGCGDATDVLKEGALVTVSCAEGDEGKIYDGLLETEITEVQRGELPPIPVKIMMNVGNPQLAFDFSQLPNAGVGLARLEFIINNNIGVHPKAILEYPNIDQDLKKAVESVARGHASPRAFYVDKLTEGIATIAAAFYPKPVIVRLSDFKSNEYKKLIGGSRYEPDEENPMLGFRGASRYIADDFAEAFQMECIALKKVREEMGLDNVEIMVPFVRTLKQAERVVGLLAKYGLKRGENGLRLIMMCEVPSNAILAEEFLQFFDGFSIGSNDLTQLTLGLDRDSGMELLAVDFDERDPAVKFLLKRAIDTCLRLDKYVGICGQGPSDHPDFAQWLTDEGIKSISLNPDTIIETWQQLAKSTK

SEQ ID NO: 17164 - protein, 216 aa, Brachypodium sylvaticum
  misc_feature (49)..(49): Xaa can be any naturally occurring amino acid
  misc_feature (55)..(55): Xaa can be any naturally occurring amino acid
  misc_feature (84)..(84): Xaa can be any naturally occurring amino acid
MTVGAGIAVQEDGTLAALGATVLTEVRDNVLVTPAAGAGVLDGAFLGVXAAPAAXRGVFPVGKLRPPGENNVLKPGTLGGGRDXRFMCTFRFKMWWMTQRMGSSGHEVPVETQFMLVEAAGAGDEEPSSAAPVYTVFLPILEGSFRAVLQGNADDELEICLESDPAVESFEGTHLVFVGAGSDPFEVITNAVKYMPDMLNWFGWCTWDAFYTDVSK

SEQ ID NO: 17165 - protein, 182 aa, Campylobacter coli RM2228
MTKLTQNEQQFLSESIRVIPNFPKEGIIFRDITTLLNNQKALSFLLDHLSKRYQTMNLDFIAGTESRGFIFAAMICAKLNLPFVPIRKPNKLPSNTYSCEYELEYGTDRVEIHQDAFRNIKNAKILLVDDLIATGGTALASFELIKKAGGECIEACFLMNLKNLGGEEKLQKHCSVYSVLEF

SEQ ID NO: 17166 - protein, 367 aa, Campylobacter coli RM2228
MSLSVGIVGLPNVGKSTTFNALTKAQNAQSANYPFCTIEPNKAMVEVPDLRLNELAKIVKPERIMHSLIEFVDIAGLVKGASKGEGLGNKFLSNIRETEVILHIVRCFDEENITHVEGGVDPLRDVEIINTELILADIEQLGKKIEKLNKEARANTKGAKESLEMANSLLEHLNKGLPASTYLQKEDEIFQALNKELRLLSAKEVIYGANVDENGISEDNEYVKILKDYANKNNHEVIKLCAKIEEELVGLSNEESAEFLSSLGVNESGLDQIIRTAFSKLGLISYFTAGVLEVRSWTIKKGWKAPKAASVIHNDFEKGFIKAEVISYEDFITYKGENGAKEAGKLRLEGKDYIVLDGDVMHFRFNV

SEQ ID NO: 17167 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 17168 - protein, 812 aa, Burkholderia thailandensis E264
MTYQVLARKWRPKDFASLVGQEHVVRALTHALDGGRLHHAYLFTGTRGVGKTTLSRIFAKALNCETGVTSQPCGVCRACREIDEGRFVDYVEMDAASNRGVDEMAALLERAVYAPVDARFKVYMIDEVHMLTNHAFNAMLKTLEEPPPHVKFILATTDPQKIPVTVLSRCLQFNLKQMPAGHIVSHLERILGEERIAFEPQALRLLARAAQGSMRDALSLTDQAIAYSANEVTETAVSGMLGTLDQTYMVRLLDALAAADGPQILAVADEMALRSLSFSAALQDLASLLHRIAWAQFAPASVLDEWPEAADLRRFAELLSPEQVQLYYQIATVGRGELGLAPDEYAGFTMTLLRMLAFEPATTGGGAPGGGVPAQVSGAAPKPGARTAIAVGASAAPAVAAAPTPKAAVARAATRAEPPPSQAEPATTETVGGASADVRAPADAGPGERDAAPCVESVAPPSTREDAARESAARAAVSFESTSVAERDAITPAAASTGEVAAMPASVATESRAPAPTADASASRATGAAAALDVLRNAGMRVSSDRGRNAGAARPAAPAAAPAAPAAPTAKAAPRVPVPVPTPRGRASGSDARPNGAARAEARSESRGAPPPWEDIPPDDYVPLSMDDGFIPPDDGFVPVFDSGPDDVRVAPKPAPAPSVDTRPLPEPIPLDTIGYAGEWATLAASLPLKGVAYQLAFNSELTSADGGALKLAVPVPQYADAAQVAKLKAALADALGKPVDVMVEVGPARRTAAALAAAERAKRQREAEQEMNADPFVQQLLREFGASIVEGSIRPVGPEAGAADGASPTLH

SEQ ID NO: 17169 - protein, 326 aa, Prosthecochloris aestuarii DSM 271
MKAIIPVAGVGTRLRPHTFSQPKVLVNVAGKPIIGHIMDKLIASGIDEAIVVVGYLGDMIESYLKKTYPIKFTFVTQKQMLGLAHAIWICKKHVQNDEPLFIILGDTIFDVDLSGVFNSQSSTLGVREVEDPRRFGIAITEGSHITKLIEKPDTPIGNQAIVGLYYLKNAGTLFSSLDHLISNEIKTKGEYQLTDALQHMIESGETFTTFPVKNWYDCGKPETLLATNRVLLQTMNSDASLFAGCVINEPVYIAASATVQNAIIGPDSTIGENAVITDAIIKDSIIGNNAKVEKVMLSRSIVGSNAHISGSHQEINIGDSSEIRLR

SEQ ID NO: 17170 - protein, 254 aa, Mesorhizobium loti MAFF303099
MRVVYWVGTSWKMNKTLAEALDFAERLAGFIPGFDDRIQPFVIPPFTAVREVKRALSSTRIKVGAQNMHWADAGAWTGEISPPMLRDCGLDLVELGHSERREHFGETDRTVGLKTAAAVKHGMIPLICVGETLAERESGQADAVLSAQVEGALQFLEGEAKTAKILFAYEPVWAIGDKGIPASADYADKQQALIKTVAGALLPSVPPVLYGGSVNPGNAAELVGQPNIDGLFIGRSAWQADGYIDILGRASAAI

SEQ ID NO: 17171 - protein, 449 aa, Marinobacter sp. ELB17
MRNADLVARDLKSVWHPCTQMKDHETLPLIPIKKGKGVWLEDFENNRYIDAVSSWWVNLFGHSNDRINNAIIEQIGQLEHVILAGFSHEPVVNLSERLIEVTPEGLNKCFYADNGSSAIEAALKMSFHYWKNQGQPNKKYFVNLANSYHGETLGALALGDVAIYKDTYQPLLMEVITAPSPDAYLKEPGETDEAFALRQFEAMEALLAERHHEISAVVVEPLIQCAGGMRMHHPIYHTKLREACDRYGVHLIADEIAVGFGRTGTLFACEQAGITPDFMCLSKGLTAGYLPLSVVLTTDTVYNGFYDDYETMRAFLHSHSYTGNPIGCAVALATLDIFRDDRVIENNRRLSACMAESVAHLADHPNVGDIRQHGMTLAIEMVKNKADKTPFHWKERRGLKVYQHSLTRQALLRPLGNVVYFMPPYVITEDQIQHLARVATEGINIAVRD

SEQ ID NO: 17172 - protein, 355 aa, Pyrococcus furiosus DSM 3638
MIKIAVIPGDGIGKEVVAEGLKVLRKIEELSNVKFDFQEYPFGAEHYLKTGETLPDWALEEFRHFDAIYFGAIGDPRVKPGILEHGILLKLRFSLDLYVNLRPVKLYHPKLTPLKGKEKIDMVFIRENTEGLYAGAGGFLRKGTPHEVAIQEMINTRFGVERTIRFAFEYAKTKGRKKVTLVDKANVLTYAHDLWQRVFKEVASEYQEIETDHYYVDAMAMKMIRSPEIFEVVVTPNMFGDILTDLGAEIVGGLGLAASGNINPRGVSMFEPVHGSAPDIAGKGIANPLAAILTAALMLEHLGLDREASLVEKAVAKTIEENKVTPDLGGELKTSEVGNEVVKNLEVLWDEGEES

SEQ ID NO: 17173 - protein, 461 aa, Idiomarina baltica OS145
MVSPIILIVEDDAALREAITDTLELAHYQCLHADNGESALLQLKKHRIDLVVSDVQMPGMNGLQLLRNIKHLKIDVPVVMMTAYAKVDDAVVAMREGAVDYLSKPFSIDELTQLVQRHAPIEPAAGHGVVAKDSASLALLELAKKVARTEATVLITGPSGTGKEVLARYIHQQSKRDKQPFVAVNCAAIPETMLESLLFGYEKGAFTGATQSSPGKFELAQGGTLLLDEVTEMDIALQAKLLRVIQERQVERLGARQAIRLDVRIIATSNRDIKAAVAEGIFREDLMYRLNVFPLRWLPLAERTEDIGPLAEALIARHRQRLGIREAVTLSDEALQHLKQYAWPGNVRELENVVQRALVLQQGGKIRPSDLMLDDALMDHVLPEQVSQDSQLLASQPEHENLDNEPAEELGESLFMQEYRIIKQALARHHGKRKPVAEELGISPRTLRYKLAKIRDNGLSV

SEQ ID NO: 17174 - protein, 436 aa, Solibacter usitatus Ellin6076
MTKEEIILANKEFLFPAVFHFYKEPLVIARAKDQYVWDADGNQYLDFLGGIVTVSVGHCNDQVNAKVHKQLDTLQHVSTLFANEPQAALAKKIASITPGGKLTKSFFTNSGTEANETAILTARCYTGSTEIVALRHSYHGRSAMAMTLTGQGTWRLGPAQSGVIHAHNAYCYRCPFGLTYPTCDVRCAQDMEELIRSTTGGQIAGFIAEPIQGVGGFITPPKEYFQIVEKIVRNHGGLFISDEVQTGWGRTGGKWFGIEQWGVTPDIMTGAKGLGNGSPVGLTVAKPEVADGLKGVTLSTFGGNPVTATAAKAVIDYIEEQRLMDNCTQTGGYLRARLEELKEKHEIIGDVRGMGLMQAIELVDDRASKTPATAATARLIESTKEHGLIVGKGGMYGNVIRVTPPMNIAKTDVDNFIELLDKSLVACGAMAAGGVK

SEQ ID NO: 17175 - protein, 454 aa, Prochlorococcus marinus str. MIT 9301
MEFEFDLIVVGAGSGGLAAAKRAASYGAKVAIIEANQIGGTCVIRGCVPKKLMVYAAKSKKNMDSSEGYGLKNEGINFESNILLKNVREEVSRLSNLHRNSLKKLNITIFEGLGRFITQNELEIICSNTKKIKNKISSKKILISVGGKPKKLNIPGIDLAWTSDDIFELEKFPKSLLIVGGGYIACEFASIFRNLGTEVTQLIRGKHLLNGFDEDLSLCLEESPTFTDIKIISNAQLKSIDRVNGNLESTLESGDKLLTNNILIATGREPNLLPLNLDFLNLKMDGQYLDVDELNQTSNANIFAVGDIINKPNLTPVAIEQGRVFSDNFFNDQKRKVNYEYIPKAVFTIPEISTVGLSEKRAKEIYSEKNIKIFKCKFTPMSNTFKKNKSKCMLKIVVHKLTDKVLGCHMFGETSSEIIQMVSVSLNAGITKKDFDITMALHPTISEEFVTMYG

SEQ ID NO: 17176 - protein, 333 aa, Yarrowia lipolytica
MLNLPSLSTCIKFMQDFFISNIFKKFVLQRIGHHSTLQDTMGTVKRDIRIANKEKRKKVFAEMKHKLNKERHEMRRERAKEEAKNPELKEKRLAENVPDTIEAKRVYDETIAQEMEGEDEFKEYFEEGKPPKVLITTSKRARGQAYDFADLLYDIIPGSEFKKRVGDFTMTQIAKMCAERDYTDLVVINEDKKKVNGLTFIHLPEGPTMYFSVSSLKMPKEIKGHGRSTTHIPELILNNFSTRLGKTVGRLFQSMFPQQPEFVGRQVVTLHNQRDWIFFRRHRYVFKNEERVGLQELGPQFTLRLRRLQRGIRGEVEWEHRSAMDKDKKKFHL

SEQ ID NO: 17177 - protein, 178 aa, Xylella fastidiosa 9a5c
MGLELVNAGNNLPEEINVIIEIPKDSEPVKYEVDKASGAIFVDRILSTPMRYPCNYGYVPNTLCGDGDPVDVMVVLPLPLVPGSVVRCRPVGVLQMKDEAGNDEKLLAVPVSKIFSGYSHIEDINQVSAHWLERIGHFFEHYKDLEKGKWVEIDGWGNATTAKQILTNAVQRYKDTLP

SEQ ID NO: 17178 - protein, 276 aa, Zea mays
  misc_feature (244)..(244): Xaa can be any naturally occurring amino acid
  misc_feature (260)..(260): Xaa can be any naturally occurring amino acid
  misc_feature (268)..(268): Xaa can be any naturally occurring amino acid
RPRVHSKDIVRLNGVYQRILTSAGVTMIEGAGSLVDAHTVEVSQPDGSKQRYTAKHILIATGSRAQRVNIPGKDLAITSDEALSLEELPKRAVILGGGYIAVEFASIWRGMGAEVDLFYRKDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAXTVFGGQQVKPDHRDVXCAVFSFPXLSVVGLSE

SEQ ID NO: 17179 - protein, 451 aa, Shewanella oneidensis MR-1
MNKLIAFLKERKITEVECVICDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYDEKGWEPVIAPEMEFYLTSRSDDHDLPLKPPIGRSGRPEAGRQSFSIDAANEYDPLFEDMYDWCEIQGLDIDTLIHEDGPAQMEINFSHGNPLSLADQVFVFKRTLREAALKHNVCATFMAKPVTDEPGSAMHIHQSVINKETGKNIFTNEDGTQSALFLSYIAGLQKYIPEFLPLMAPNANSFRRFLPGTSAPVNLEWGIENRTCGLRIPESSPQNRRIENRIPGADANCYLAFAAGLLCGYIGMVEGLKPSTPVQGKANESRSNNPHCLPLTLEEALVAMEESDACKEYLGESFTTGFVAVKQAELENFRRVVSSWEREFLLLSV

SEQ ID NO: 17180 - protein, 303 aa, Legionella pneumophila subsp. pneumophila str. Philadelphia 1
MKPLLFSLFDSSEIAGRLQESLQVEVGDVTFHRFPDTEWYLKINSEVNNRSLMVVDSLNQPDEKILPLLFFAKTAKELGARKVGLIAPYLSYLRQDKRFHEGEGITSRYFADILSTSFDWLMTIDPHLHRYHSLDEIYSIPTFVLHATSMIATWIKHHVPKPILIGPDMESEQWVADIAEKGSFSYAILEKIRRGDKEVTISVPTIPELESSTLVLVDDIISTARTMVETVKHLHQAGGKSIVCIGVHALFAEDAYSLLSEMKGVQVITCNTIHHITNAIDVSDLAVDVLVQNKLAALKSKRK

SEQ ID NO: 17181 - protein, 306 aa, Saccharomyces cerevisiae
MNQIWSTGPPNFYFNSEWKENKRNDRTIEDSLRELDGLIHSLERTHIEVQTNPKLKNDVTALNDINKKENKEEITHENYTHQINSIPLTSSNLNRHFSFSRDYNQSDNSNNNYYREYLSKPRYLQQSTKEQTFNEINKRKSAAIIPPWLNIPENSRFFVIKSSSLKHVKRSFYNGIWSSTHFGNKRLSEAYKKLNSGAKVFLFFSINTSGRFCGVAEMVSDLKMDLDTSIWEDEQKYGKAFKVRWVIVRDINNRSLKRFLIPSNEMKPITHSRDTQEIPYSIGISIINLFKTQDSDIFSFLDETYE

SEQ ID NO: 17182 - protein, 456 aa, Saccharomyces cerevisiae
MSDKPIDIQYDKQATPNLSGVITPPTNETGNDSVREKLSKLVGDAMSNNPYFAAGGGLMILGTGLAVARSGIIKASRVLYRQMIVDLEIQSKDKSYAWFLTWMAKHPQRVSRHLSVRTNYIQHDNGSVSTKFSLVPGPGNHWIRYKGAFILIKRERSAKMIDIANGSPFETVTLTTLYRDKHLFDDILNEAKDIALKTTEGKTVIYTSFGPEWRKFGQPKAKRMLPSVILDSGIKEGILDDVYDFMKNGKWYSDRGIPYRRGYLLYGPPGSGKTSFIQALAGELDYNICILNLSENNLTDDRLNHLMNNMPERSILLLEDIDAAFNKRSQTGEQGFHSSVTFSGLLNALDGVTSSEETITFMTTNHPEKLDAAIMRPGRIDYKVFVGNATPYQVEKMFMKFYPGETDICKKFVNSVKELDITVSTAQLQGLFVMNKDAPHDALKMVSSLRNANHIF

SEQ ID NO: 17183 - protein, 408 aa, Erythrobacter sp. NAP1
MNAPTALTRDLRGDFPGLVTRDGEPWHYLDTAATSQKPRAVINAMARAMGEDYATVHRGVYSRSADMTLAYEAARRRIAELIGGAENEIVFTRGATEAINLVANSWGRANLKAGDRILLSQLEHHSNIVPWQMVAEATGAKIDVVPLTDDHQIDLDAAEAMISGEHKLVALAHVSNVLGSVLDAKRAADMAHKVGAKILLDGCQAVPHMPVNVAALDCDFYVFSAHKLYGPTGIGALWARGELLEAMPPWEGGGSMIDRVTFEKTTYDAPPQRFEAGTPAITEAIAFAAAADYVSEVGLAKMHEDESKLVTRLRRELTAMNDVTVFGPDNSAGIVSFAIDGIHPHDLGTILDEANVAIRAGHHCAQPLMDYLGVPATARASFGLYSTEADVDALLEGIARTRRIFGKD

SEQ ID NO: 17184 - protein, 635 aa, Saccharomyces cerevisiae
MAPVTIEKFVNQEERHLVSNRSATIPFGEYIFKRLLSIDTKSVFGVPGDFNLSLLEYLYSPSVESAGLRWVGTCNELNAAYAADGYSRYSNKIGCLITTYGVGELSALNGIAGSFAENVKVLHIVGVAKSIDSRSSNFSDRNLHHLVPQLHDSNFKGPNHKVYHDMVKDRVACSVAYLEDIETACDQVDNVIRDIYKYSKPGYIFVPADFADMSVTCDNLVNVPRISQQDCIVYPSENQLSDIINKITSWIYSSKTPAILGDVLTDRYGVSNFLNKLICKTGIWNFSTVMGKSVIDESNPTYMGQYNGKEGLKQVYEHFELCDLVLHFGVDINEINNGHYTFTYKPNAKIIQFHPNYIRLVDTRQGNEQMFKGINFAPILKELYKRIDVSKLSLQYDSNVTQYTNETMRLEDPTNGQSSIITQVHLQKTMPKFLNPGDVVVCETGSFQFSVRDFAFPSQLKYISQGFFLSIGMALPAALGVGIAMQDHSNAHINGGNVKEDYKPRLILFEGDGAAQMTIQELSTILKCNIPLEVIIWNNNGYTIERAIMGPTRSYNDVMSWKWTKLFEAFGDFDGKYTNSTLIQCPSKLALKLEELKNSNKRSGIELLEVKLGELDFPEQLKCMVEAAALKRNKK

SEQ ID NO: 17185 - protein, 589 aa, Burkholderia thailandensis E264
MSLIEVKVPDIGDFSGVDVIEVNVKPGDVIEKEQTLLTLESDKASMEVPSDVAGTVKEIKVKAGDKVSQGTVIALVEASAGAAAPAKAAEPAKPAVPAPAAAPAAAPASAPQAGSYAGAADIECDMLVLGAGPGGYSAAFRAADLGMKTVLVERYSTLGGVCLNVGCIPSKALLHTALVVEEAEALASHGISFGKPQVDLDKLRDFKGGVVKKLTTGLAGMAKARKVEVVTGVGAFVDPYHMEVQGEGGKKVVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAQAKEDGIYVKFEGEKAPAEAQRYDLVLVAVGRSPNGKKIGAEKAGVAVTERGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLIFDEQTHRVIGGGIVGLNAGDLISEVCLAVEMGADAQDIGKTIHPHPTLGESVGMAAELYEGVCTDLPPQRKK

SEQ ID NO: 17186 - protein, 387 aa, Aspergillus nidulans FGSC A4
MATETSPRALVSYGPHKSGGWKLKNVALRPLREKELLVEMVASGICQTDLHFAGMETGYGVHYPRVMGHEGAGYVRAVGPDTTVARVGDPVILSFSACKDCEPCKGGHPAHCSNFNAINFEAVAEDYVFRDASSPEPASGGDIYGRFFGQSSFASLSIVQQDSIVNVAGVVKSRQDLALLSPLGCGIQTGSGAIINAAGARPADRVAIMGLGGVGLSAVMGAKIAGCTQIIGIDRHGSRLELAKELGATHVVQVAEGMPLDEVTAAVKAITGGLGSNITLDTTGVPALIAEGVKMTAFKGKILQVGTAPETATLSIPIHEFMVSGKQFIGVVEGDVVPQEYLPKLLNWVNEGKLPLDRIVKFYQAEAFETAIRDMQSGVTVKPVILW

SEQ ID NO: 17187 - protein, 91 aa, Glycine max
MSMVKVEEEEEQQATTPIHTSSPSSYVLLLQIMSKRRTWVCIFVLVYGLLFTSSWNFLKSMISWYKLQADQSSTTSWWPALYASVLLGGFS

SEQ ID NO: 17188 - protein, 530 aa, Burkholderia thailandensis E264
MIDLATNTPSAAPRDAVPRILPVILAGGSGTRLWPLSREHHPKQLIDLIADESPLSATARRLTGISNAELADTLLLVCGEQHRFTSAAQVSARGLRARILLEPAARNTAPALTLAALEALAHHGDPVLAAMPADHAVSDTRAFQDTVAQAARYAQDGAIVTLGVLPRRAETGYGYIKVGAPLADSNGVEGGHAIDSFVEKPHQELAQQYLQSGDYWWNSGIFVVRASTWLAAIRALQPDMYAACEAAWRDGTDEGQFFKADAQRFAACPCDSIDYAVMERLTGARALGIPGVIVPLAAGWSDVGSWDAIWELLPKDEAGNVARGEVLFEGTEDSFARSEGRLVACVGLKDVVVVETPDAVLVANKHRVQDVKTVVARLKSGQREQVRDHRKVQRPWGYYDSIDRGERFQVKRIVVDPGKQLSLQMHYHRAEHWIVVRGTAKVTRGDETFLLSENESTYIAVGAVHRLENPGKIPLEIIEVQSGDYLGEDDIVRFDDRYGRASAQPAPDAAKPADAEPAPSAEPARALGGH

SEQ ID NO: 17189 - protein, 257 aa, Coccidioides immitis RS
MAPFENVSKTARTKDGAIAGDCEWCELPAAGSSPIPRLLLTLLPLMTSYLLDLAVSDPCPQFRTDNLPCILTPPIQSGELRQMLMSDYEVTLVNDNSRNSTSALKVRKRVRRPSPFAGGLWKVHVELPDQYPYKSPSIGFVNRIYHPNIDELSGSVCLDVINQTWSPMYDMINIFEVFLPQLLRYPNPSDPLNGDAAAVLLRDPSKYEAKVREYVAKYASKDAADDAGEDTGEEDEMSSVGSYESGGEEPAGEMDDV

SEQ ID NO: 17190 - protein, 202 aa, Triticum aestivum
PRVREFRRQQSVFRDCIEADANAKFAAEPDRYHLYISWACPWAHRTAIVRQLKGLDKIIGMSVVDYLMLDKGWKFSTEQECPGAIPDTVNKSSYIRDLYFKVNPNYEGRFTVPVLWDKKLQTIVNNESSEIIRMFNTAFNSFLSKEQAELNYYPESLQKEIDETNEWIYDTVNNGVYKSGFATTQQAYENNVYNVFKSLDRI

SEQ ID NO: 17191 - protein, 553 aa, Salinibacter ruber DSM 13855
MYTLLTNRVCVPSRPWAAHRGGAARTNATEPPKKFRSERTWKRLRFGVVPAFISTPRPFLQAVSSFPMEGSNATPQANGQAESSDGFFGEVNQMFDEAAARTDHPRGVLHQIRACDNIIRFEFPIERDDGSIQVIRGYRGEHSHHMQPTKGGIRYAPSVNVDEVMALSALMSYKCAIVDVPFGGAKGGVCIDARNYSTTELERITRRYTFELERKDFIGPGTDVPAPDYGTGPQEMAWIMDTYNQIGDEDLNALACVTGKPVGQGGVRGRTEATGRGVYYGIREACAYPKDMKRLGLEMGLEGKSVVIQGLGNVGYHAARFLEDGGAKIVGIAEIEGAIHDPDGLDVDDVVAHREETGSILGFADAENIETSAAALELPCDILIPAALEGVITTENAPDIQASIIAEAANGPVTSEADEILQEKNAMIIPDVYLNAGGVTVSYFEWLRNLSHVRHGRMSRRFEERNAERILRAVDELTAEDFSEDLLESLIEQVGFGAGERDLVHSGLEDTMSHAYDEIRAIREKKGVDMRTAAFVSAIDKIAGSYDQMGIFP

SEQ ID NO: 17192 - protein, 523 aa, Corynebacterium efficiens YS-314
MSLTPNHRPVLVVDYGAQYAQLIARRVREAGIYSEVIPHTATPQEIQEKNPVALVLSGGPSSVYAEDAPGIDPDILKLGLPVFGICYGFQAMTHALGGKVAATGKREYGRTDLEVKGGVLHDGLELSHKVWMSHGDAVSEAPEGFTVTASSEAAPVAAFENVEAKMAGVQYHPEVLHSPHGQQVLTRFLTEIAGLEQNWTAANIAEELVEKIREQVGPEGRAICGLSGGVDSAVAAALVQRAIGDRLTCVFVDHGLLRAGEREQVEKDFVAATGAKLVTVDERKAFLDKLAGVTEPEAKRKAIGAEFIRSFERAVAGVLEDSPEGSTVDFLVQGTLYPDVVESGGGAGTANIKSHHNVGGLPDDVEFELVEPLRLLFKDEVRAVGRELGLPEVIVARQPFPGPGLGIRIIGEVTEERLETLRHADLIARTELTAAGLDGIIWQCPVVLLADVRSVGVQGDGRTYGHPIVLRPVSSEDAMTADWTRLPYEVLERISTRITNEVADVNRVVLDVTSKPPGTIEWE

SEQ ID NO: 17193 - protein, 353 aa, Nostoc sp. PCC 7120
MQLFETVREMGHEQVLYCHGKNPDIRAIIAIHDTTLGPAMGATRLYPYINEEAALRDALRLSRGMTYKAACANIPAGGGKAVIIANPEDKTDEMLRAYGRFVESLKGRFITGQDVNITPQDVRTIKQETNYVVGVEEKSGGPAPITALGVFLGIKAAVEFRWQTKNIEGMTVAVQGLGNVGQNLCRHLHENGIKLIVADFSSEKTAEIKHLFGATVVEPDEIYSQNVDIFSPCAMGGIINSQTIPQLQAKIIAGAANNQLDNERLHGQRLVEKDILYCPDYVINAGGIINVYNEMIGYEEDKAFKQVNNIYDTLLAIFNIAQQQSITTNDASKRLADERIMKARINKNQLIAA

SEQ ID NO: 17194 - protein, 319 aa, Corynebacterium efficiens YS-314
MVTAHTDSAHSTPLRTVVVPAAGLGTRFLPATKTVPKELLPVVDTPGIELVAEEAAEAGAQRLAVITAPAKDGILAHFGDFTELRDHLVTKGKTAEAAKVARAVEIITVQGVVQEEPLGLGHAVSLAEGALDDNEEIFAVMLPDDLVLPIGVTSQMIRVQEQFGGTVLCAMDVPLEEVSKYGVFDIADIPGQPGVKQVLGMVEKPSQEKAPSTFVATGRYVFDRHIFDALRRTTPGKGGEIQLTDAIDLLIREGHPVHILVHEGQRHDLGNPGGYIIACMELGMEHPVYGASIREAVTRAAAALAPATLASVQPLTSSS

SEQ ID NO: 17195 - protein, 565 aa, Shigella flexneri 2a str. 2457T
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 17196 - protein, 482 aa, Shewanella oneidensis MR-1
MLLNDPSLLRQQCYINGQWCDANSKETVAITNPATGAVIACVPVMGQAETQAAIAAAEAALPAWRALTAKERGAKLRRWFELLNENSDDLALLMTSEQGKPLTEAKGEVTYAASFIEWFAEEAKRIYGDTIPGHQGDKRIMVIKQPVGVTAAITPWNFPAAMITRKAAPALAAGCTMVVKPAPQTPFTALALAVLAERAGIPAGVFSVITGDAIAIGNEMCTNPIVRKLSFTGSTNVGIKLMAQCAPTLKKLSLELGGNAPFIVFDDANIDAAVEGAMIAKYRNAGQTCVCANRIYVQAGVYDEFAEKLSMAVAKLKVGEGIIAGVTTGPLINAAAVEKVQSHLEDAIKKGATVLAGGKVHELGGNFFEPTVLTNADKSMRVAREETFGPLAPLFKFNDVDDVIKQANDTEFGLAAYFYGRDISLVWKVAESLEYGMVGVNTGLISTEVAPFGGMKSSGLGREGSKYGIEEYLEIKYICMSV

SEQ ID NO: 17197 - protein, 425 aa, Shewanella oneidensis MR-1
MSTTNDSLMARRQAAVAGGVGQIHPIFTARAENASVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSDIAAIILEPVQGEGGFYAVSPAFMQRLRALCDREGIMLIADEVQTGAGRTGTFFAMEQMGVSADITTFAKSIAGGFPLSGITGRAQVMDAIGPGGLGGTYGGNPLACAAALAVLEVFEEEKLLERANAIGDRIKSALNTMQVEHPQIADVRGLGAMNAIELMEDGKPAPQYCAQILAEARNRGLILLSCGTYGNVLRILVPLTVSDTQLDAGLGILKTSFNAVLKG

SEQ ID NO: 17198 - protein, 318 aa, Arabidopsis thaliana
MAPSSSSGLTFKLHPLVMLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQVAAHLTGIHSAIKMLNSRIRVLYQHIVAMQKGCDKPCENSVLRQVSSLLRSLPAAESEKFNENFLMEYNDKLLMSYLAMITNCTSNMNEVVDKFNTAYDKHSRRGGRTAFM

SEQ ID NO: 17199 - protein, 201 aa, Coxiella burnetii RSA 493
MLLMIDNYDSFTYNLARYFEELGAAVSVYFNDKISLADIAALNPKQIVISPGPGRPEEAGITLPMIKAFSGKIPLLGICLGHQAIAQAFGAKIVLAEKIMHGKTSIIHHSGKGVFNGINDSFVATRYHSLIIERESLPAEFEITAWTNPNQEIMGIRHAHHSLEGVQFHPESVLTQHGHRLLKNFLNPISQRGHHLCLKSH

SEQ ID NO: 17200 - protein, 314 aa, Capsicum annuum
MGSKYSKATNSINDALNSSYLVPFESYRFPLVDLEEATNNFDGKGGFGKVYRGVLRDGTKVALKRHNRDSGQSIEPFRTEIEILSRRSHPHLVSLIGFCDERNEMILIYDYMENGNLKSHLYGSDLPTMSWEQRLEICIGAARGLHYLHTSAVIHRDVKSTNILLDENFVAKITDFGISKKGTELDQTHVSTDVKGTFGYLDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 17201 - protein, 362 aa, Haloarcula marismortui ATCC 43049
MWYRHTIRMRAAVLEEYEEPLAIRDVERPDPDPDGVVAKVDACGVCRSDWHGWVGNWDWFDYKPPRGHILGHEPSGTVVEVGENVDTVKEGDTVAIPFNFACGHCHECRVGYENLCENHLGLGFQPGAPGAFAEEVPIPNADINAVKLPDGVDPVEVAGMGCRFMTSYRGMAHQADVSRGEYVVVQGLGGIGLSAVHIADALGGNVIGVDLMDEKLEMAEELGAIDTVNAAEEDDVVQAVRDITDGGAHVSLDALGIEETCQNAIESLRTRGRHVQIGLTTKEQRGYNSLPTDTIVMNEIQVQGSSGLPPSKYGEMFRMVENGKLDPGAVITDKIGLEGVSDELAAMTDYETIGIPVVNEFA

SEQ ID NO: 17202 - protein, 503 aa, Haloarcula marismortui ATCC 43049
MPDSETRTAMRERHLQAHEDALADIVIEPWIGGTSVSGSEPIPTRDPVIDEPITAVPVCDDELVNQAVQVAWDGFETWSDRTPTDRSQRLSEWVDVLEEHLDELALLECLDTGKPLSEARGEVEGALRTLEYYAAVARTQQGSQIPAQGDLHMYTRMEPYGVVGQITPWNFPAWAAAWKFGPALAAGNCSVLKPSAYTPLTTVRMAQLSDGIFPDGVINVVTGGGSTTGATLTEHEDVRKLSFTGSGSVGQEVMQTAAARIAPVTLELGGKSPLLVFPDADMQTAVDAAAAGVYYSTGEICDALSRAIVHEDVHDEFVDRLVARAESYTLGDPLDDETTLGPLTNEDQFETVSDYVTIGRNEGATLATGGTAPDDRALADGHYVEPAVFTDVEPDMRIAREEIFGPVQTVQSFETYDEAIALANDTEFGLAGGVATESTDIAHQAAADIDAGVVYINAYGPIRPEGPYGGFKESGIGHDLGRAAVEQYQQPKTVYVNLDSPEI

SEQ ID NO: 17203 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIIRRAQNAQDLLPSGSVYSLPSNADIEISFPATAAPPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 17204 - protein, 222 aa, Coxiella burnetii RSA 493
MNKKIISASILSADFSRLGEEVKSVIQAGADNIHFDVMDHHFVPNLSFGAVVCKALRDAKITAPIDVHLMVKNPNEFIKPFAEAGANLITFHPETVKDVEDTIARIKKAGMQVGMAFNPEKSLSLFTSFLTKIDLVLLMSVNPGFAGQSFMAESLKKIAATRQLLDTLQSKAFLGIDGGIKINNIADVSRAGADFFVVGSGLFHSSNYEEKLKEMRHAINDR

SEQ ID NO: 17205 - protein, 2362 aa, Arabidopsis thaliana
MGSLSSEEDDEVSSERCGSYSPSADISESESSSSFSCHRFDGEGASSSIPSSPRVVAGRGFYFPAPVMLPVIGGKDVVWDDKQPDNDLSEIEMMKERFAKLLLGEDMSGGGKGVCTALAISNAITNLSATVFGELWRLEPLAPQKKAMWRRELEWLLCVSDSIVELIPSIQQFPGGGTYEIMETRPRSDLYANLPALKKLDAMLIDMLDAFSDTEFWYTDRGIVLGDCDKDSYNSPASVRQEDKWWLPCPKVPPNGLSEEARKKLQQCRDFANQILKAALAINSGVLAEMEIPDPYLETLPKSGKECLGEIIYQYLTANKFSPECLLDCLDLSSEHQTLEIANRIEAAVHVWRQKNGRRHKKQAKLKLSSWGGKVKGLVNDNERNDFLVQRAETLLQSLRIRFPGLPQTTLDMNKIQYNKDVGQSILESYSRVMESMAFNITARIDDVLYVDDAMRRSISVTESLSLFSINGLNPQKAFSVQSSPHGSPFATPALSVASRSPRRAPPLESEFKKSNGSDAGKRLRLKIEECKSMVVETVVVSCLSDYEDECAIGTTRSFKEFSVLLSGGERGFRVMEQSSGRVNPEQPNNVLASLVGSIVEKGISENKPPSKPLPPRPSLLSFPVARHRSHGPHLAPVGSSIAQPKDYNDDQEEEEAEERFMNADSIAAFAKPLQRKEKKDMDLGRWKDMVSGDDPASTHVPQQSRKLKIIETRPPYVASADAATTSSNTLLAARASDQREFVSDKAPFIKNLGTKERVPLNASPPLAVSNGLGTRHASSSLESDIDVENHAKLQTMSPDEIAEAQAELLDKMDPALLSILKKRGEAKLKKRKHSVQGVSITDETAKNSRTEGHFVTPKVMAIPKEKSVVQKPGIAQGFVWDAWTERVEAARDLRFSFDGNVVEEDVVSPAETGGKWSGVESAAERDFLRTEGDPGAAGYTIKEAIALARSVIPGQRCLALHLLASVLDKALNKLCQSRIGYAREEKDKSTDWEAIWAYALGPEPELVLALRMALDDNHASVVIACVKVIQCLLSCSLNENFFNILENMGPHGKDIFTASVFRSKPEIDLGFLRGCYWKYSAKPSNIVAFREEILDDGTEDTDTIQKDVFVAGQDVAAGLVRMDILPRIYHLLETEPTAALEDSIISVTIAIARHSPKCTTAILKYPKFVQTIVKRFQLNKRMDVLSSQINSVRLLKVLARYDQSTCMEFVKNGTFNAVTWHLFQFTSSLDSWVKLGKQNCKLSSTLMVEQLRFWKVCIHSGCCVSRFPELFPALCLWLSCPSFEKLREKNLISEFTSVSNEAYLVLEAFAETLPNMYSQNIPRNESGTWDWSYVSPMIDSALSWITLAPQLLKWEKGIESVSVSTTTLLWLYSGVMRTISKVLEKISAEGEEEPLPWLPEFVPKIGLAIIKHKLLSFSVADVSRFGKDSSRCSSFMEYLCFLRERSQDDELALASVNCLHGLTRTIVSIQNLIESARSKMKAPHQVSISTGDESVLANGILAESLAELTSVSCSFRDSVSSEWPIVQSIELHKRGGLAPGVGLGWGASGGGFWSTRVLLAQAGAGLLSLFLNISLSDSQNDQGSVGFMDKVNSALAMCLIAGPRDYLLVERAFEYVLRPHALEHLACCIKSNKKNISFEWECSEGDYHRMSSMLASHFRHRWLQQKGRSIAEEGVSGVRKGTVGLETIHEDGEMSNSSTQDKKSDSSTIEWAHQRMPLPPHWFLSAISAVHSGKTSTGPPESTELLEVAKAGVFFLAGLESSSGFGSLPSPVVSVPLVWKFHALSTVLLVGMDIIEDKNTRNLYNYLQELYGQFLDEARLNHRDTELLRFKSDIHENYSTFLEMVVEQYAAVSYGDVVYGRQVSVYLHQCVEHSVRLSAWTVLSNARVLELLPSLDKCLGEADGYLEPVEENEAVLEAYLKSWTCGALDRAATRGSVAYTLVVHHFSSLVFCNQAKDKVSLRNKIVKTLVRDLSRKRHREGMMLDLLRYKKGSANAMEEEVIAAETEKRMEVLKEGCEGNSTLLLELEKLKSAALCGRSGSAIPLSSFCSLPEKPHTLPMKLSPAAIRSSSSSAPGSLNFDLRTYWTTLITEINQKLDEAIPVKHPAGIYEAMRYSVLAQGAKRAPPVMCVAACELFGGDRLAAFPTACALEMVHAASLIHDDLPCMDDDPVRRGKPSNHTVYGSGMAILAGDALFPLAFQHIVSHTPPDLVPRATILRLITEIARTVGSTGMAAGQYVDLEGGPFPLSFVQEKKFGAMGECSAVCGGLLGGATEDELQSLRRYGRAVGMLYQVVDDITEDKKKSYDGGAEKGMMEMAEELKEKAKKELQVFDNKYGGGDTLVPLYTFVDYAAHRHFLLPL

SEQ ID NO: 17206 - protein, 314 aa, Capsicum annuum
MGSKYSKATNSINDALNPSYLVPFESYRFPLVDLEEATNNFDGKGGFGKVYRGVLRDGTKVALKRHNRDSGQSIEPFRTEIEILSHRSHPHLVSLIGFCDERNEMILIYDYMENGNLKSHLYGSDLPTMSWEQRLEICIGAARGLHYLHTSAVIHRDVKSTNILLDENFVAKITDFGISKKGTELDQTHVSTDVKGTFGYLDPEYFIKGRLTEKSDVYSFGVVLFEVFCARSAIVQSLPREMVNLAAWAVESHNNGQLEQIIDPNLAAKIRPESLGKFGETAVKCLAPSSEDRPSMGDVLWKLEYALRLQESVI

SEQ ID NO: 17207 - protein, 269 aa, Burkholderia xenovorans LB400
MAITLKNEHDIAQMRVACKLASEVLDYITPFVTAGITTGELDRLCHEYMLKEQGTVPAPLNYQPPGYPPYPKATCISVNDVICHGIPGDKTLKNGDALNIDVTVIKEGYFGDTSRMFIVGEGSIMARRLVQTTFECMWLGIDQVRPGAHLGDIGYAIQKHAEGQGYSVVREYCGHGIGTVFHEDPQILHYGRPGTGLELQTGMIFTIEPMINAGRRDIRTMPDQWTVKTKDRSLSAQWEHTVLVTETGYDVLTVSAGTPARPPIVAATA

SEQ ID NO: 17208 - protein, 248 aa, Bacteroides fragilis YCH46
MKKIVLLRHGESAWNKENRFTGWTDVDLTEKGIAEACKAGELLKENGFNFDKAYTSYLKRAVKTLNCVLDRMDQDWIPVEKSWRLNEKHYGDLQGLNKSETAAKYGDEQVLIWRRSYDIAPNALSEDDPRNPRFENRYQEVPDAELPRTESLKDTIERIMPYWKCIIFPNLKTADEILVVAHGNSLRGIIKHLKHISDEEIVKLNLPTAVPYVFEFSDELNLEKDYFLGDPEEIRKLMEAVANQGKKK

SEQ ID NO: 17209 - protein, 123 aa, Triticum aestivum
  misc_feature (101)..(101): Xaa can be any naturally occurring amino acid
MSEPEFEQARKEGGSTLEASSLFSKNPEYKKALEVVSVPERIIQFRVVWENDKGECQVQKGYRVQFNSALGPYKGGLRFHPTVNLSILKFLDFEQIFKNAXTGPQHGAVVKGGMRTSDPKGKS

SEQ ID NO: 17210 - protein, 80 aa, Synechococcus sp. CC9605
MSQEAILEKVRSIVAEQLSVDSGEVKPESNFQNDLGADSLDTVELVMALEEAFDIEIPDEAAEGITTVGDAVKYIEDKQA

SEQ ID NO: 17211 - protein, 322 aa, Zea mays
  misc_feature (65)..(65): Xaa can be any naturally occurring amino acid
MSAFFLRGEVSRRGQRREEMTSSPKISTPGVSSPPPPPSPNVPSPSPRRHYRCCRALPPHSASLXADPNDERCLTHLHQSLSDSSGRLNWTKAAISAPCDGFFSHLQGVTCNNGRVYKLALPDLSLGGTVPPELSNCTNLQSLDLSANALSGAIPTELSALLNLAVLNLSANALSGAIPRELASCAYLNVIDLHGNQLSGPIPEELGLLVRLSTFDVSYNRLSGPIPVLLANRSGAGTAAVGTARFNASSFVGNKGLYGYPLPPMRTRGLSVLAIVGIGLGSGLLSLVLSFSAVCLWLRATDRRTPTTPGEEGKISQPMPNY

SEQ ID NO: 17212 - protein, 318 aa, Halobacterium sp. NRC-1
MDVVTFGETMLRLSPPGHERVEAADRMDVRVAGAESNVAVTAGRLGAETAWLSKLPASPLGRKVAATLRAQGTTPEVTWTDRDDLRQGLYFLEQGGEPRGTTVHYDRQDAAVTTATADELAPAFVERAGYLHTSGITPALSETLAATTADLLELAQETGTTATLDVNYRRGLWSHEEARDTLEALFPDVDVLFVAERDARGVLDRTGDADAIARGLADEFAFGTVVLTRGEAGALAVRNATTVTQPVFETETHDPIGTGDAFVGGYLAARVDGGDVEDALAWGAATAALKRTIPGDVALVTRADVESVLADEHSGIDR

SEQ ID NO: 17213 - protein, 387 aa, Campylobacter upsaliensis RM3195
MNIHEYQAKAIFAENGVATLKGKVAFSVDEAVANAKELGGSVWAVKAQIHAGGRGLGGGVKIAKSLDEVKNYAEQILGMTLVTHQTGPEGKLVQKLYIESGANIVKEYYLAILFNRMAEQITIIASSEGGMDIEKVAKQSPEKIAKVGIDPQIGFKLFHALEVAKVLGLDKDESKKLAVMIEKLYKLYMDKDMNMLEINPLIKTAEGDFYALDAKCSFDDSSLYRHSDIAALRDITEENDAEREAGEFGLSYVKLDGDVACMVNGAGLAMATMDIINYSGAKPANFLDVGGGASPETVAKAFEIILRDKNVKVIFINIFGGIVRCDRIANGILEATKNVEVNVPIVVRLDGTNAAEAKSILDNSNLKNIKAATSLKEGAELVKSLVG

SEQ ID NO: 17214 - protein, 429 aa, Halobacterium sp. NRC-1
MAQTPPPESAPSTDSEPETALETARRQLQAAAEHVDIADGVIERLTHPTRVVQVSVPVERDDGTVTVYDGYRAQHDDVRGPYKGGLRYHPGVSAEECVGLSMWMTWKCAVMDLPFGGAKGGVVVDPKTLSADEHERLTRRFAAELRDEVGPSQDIPAPDMGTDAQTMAWFMDAYSMQQGETVPGVVTGKPPVAGGSHGRAEAPGRSVAIATREAINYYDIPIDDATVAVQGYGSVGANAALLLDDWGARVVAVSDVNGGVLDTDGLDTHAIPSHGNQPAAVMRHDAPNTLTNEELLELDVDVVIPAAVGNVITAANADRIQADIVVEGANGPTTSAADRILEERAVPVIPDILANAGGVTVSYFEWLQDINRRTWSPERVRDELESEMLSAWNAVRSEVDDGDLSWRDAAYVVALQRIGRAKEARGLWP

SEQ ID NO: 17215 - protein, 271 aa, Zea mays
  misc_feature (229)..(229): Xaa can be any naturally occurring amino acid
MGGALLLTLLLAAVPLSLGGGGGAHPGYSDDDESACTVDAGAELLRRMEERGPDRRIIDITHAVVPDLPAFATGAVAGPMLRLRESMADGSEYNLSELRMECHTGTHVDAPGHINQAHFAAGLDVDTLDLHVLNGPALLVDVPRNTNITAEAMEFLNIPRGVRRVLFRTLNTDRKLMWRKGGDMSYVGFTEDGAQWLVDNTDIKLVGVDGLSVASFDHLISAHVVFFKXRNIIPVESLNLDDMEAGIYMLHCLPLRLVGAEGAPTRCILIK

SEQ ID NO: 17216 - protein, 240 aa, Saccharomyces cerevisiae
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAV

SEQ ID NO: 17217 - protein, 594 aa, Hortaea acidophila
MAAHLLLGALMLGSALAISYHKPAWIPLGDSLSPRLGQDVTNGNGVLGTLDAPRLAKFLPDTHASRHRRKGYSPTDIGIGDVPVTGVTRYYNFTITEQNIAPDGVVRSGMVVNGGYPGPTIEANWGDYFEISVVNALPNEGTSIHWHGLIQHETPYMDGVPGIVQCPIAPGGNFTYRFRADLYGTSFYHSHYSAQYTGGIYGAMIIHGPTENAQYDEDIGPVLLNDWYHLPPPQSNNNLINGKMNVSRQRCTPNAGISKFTFQSGKTYRLRLINAGAEGMQKFSIDGHTMTVIANDFVPLKPYQTDVVTLGIGQRSDIIVTATGKAGQSYWMRSDLGLNALSNPAGCTNNDGVSPLALAAIYYEGADTNSVPTTNSTVPESSIQSCMNDPLNMTVPYYSLTPSTTPAMSQNIDITFASNGTNYLFYMNNSTFRADYNDPILLEAKLGQTVFPAEENVISTGNASSVRFVLYNYAFTGAHPMHMHGHNYWVLAEGYGTWDGTVTNAGNPQRRDVQLLPPAQVNADLVVTSPSYIVLQFNADNPGVWPLHCHIAWHVSAGLYVSILENPTAIKSMHIPKPAAWTGKDVPDQIDSGL

SEQ ID NO: 17218 - protein, 149 aa, Oryza sativa Japonica Group
MEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 17219 - protein, 837 aa, Pyrococcus furiosus DSM 3638
MIIGRGEERKEEIKLRVAEALKWDVGRGIVRFDKKYQRMLGVEPGDIVEIEGNRITAAIVANAHPDDRGLDIVRMDGYIRKNAGVSIGDYVTIRRAEVKEAKKVVLAPAQKGVYIQIPGDLVKNNLLGRPVVKGDIVVASGRSEFYTGTPFDEIFRGFFEMSMGFGELKFVVVSTVPRGIVQITYNTEVEVLPQAVEVREEKVPEVTYEDIGGLKEAIEKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKSRGKVIVIAATNRPDAIDPALRRPGRFDREIEVGVPDKQGRKEILQIHTRGMPIEPDYDKESVIKALKELEKEEKYEKSEIKKIIEEISKATSEEEVKEILKKHGKIFMDVRAKLIDKLLDELAEVTHGFVGADLAALAREAAMVVLRRLIKEGKINPEAESIPREVLEELKVTRRDFYEALKMVEPSALREVLIEIPNVHWDDIGGLEEVKQQLREAVEWPLKYPKAFKRLGISPPKGILLYGPPGTGKTLLAKAVATESQANFIAIRGPEVLSKWVGESEKRIREIFRKARQAAPAIIFIDEIDAIAPARGGYEGERVTDRLINQLLTEMDGIQENSGVVVIGATNRPDIIDPALLRPGRFDRLILVPAPDEKARLEIFKVHTRGMPLADDVDLKELARRTEGYTGADIAAVCREAALNALRRVVKSVPKEELEEESEEFLDKLIVTRKDFEEALKKVKPSVNKYMMEYYRQFEESRKRISGESMGREPDYFTG

SEQ ID NO: 17220 - protein, 176 aa, Thermococcus litoralis
MNPFHDLEPGPEVPEVVYALIEIPKGSRNKYELDKKTGLIKLDRVLYSPFHYPVDYGIIPQTWYDDDDPFDIMVIMREPTYPGVLIEARPIGLFKMIDSGDKDYKVLAVPVEDPYFNDWKDISDVPKAFLDEIAHFFQRYKELQGKEIIVEGWENAEKAKQEILRAIELYKEKFKK

SEQ ID NO: 17221 - protein, 526 aa, Salinibacter ruber DSM 13855
MTIRNTKHAIPRVRRSAPCTSPTSEPLLTDPVCPMPREHHPDGYRKHPRRPIGKRSAPERTADFREIWAPEWSPEALQDQGERCVDCGVPTCMSGCPIGNRIPEWNDLVHKEDWKEALQQLHATNNFPEFTGYTCPAPCEDACVLAVNDDAVAIKSIERAIVDKGWEEGWIQPEPPAERTGFQVAVVGSGPAGLAAAQQLNRAGHRVTVYERDDALGGLMTYGIPDFKFAKRRVDQRIDQLRQEGITFETSTEVGGDLAADRLHDAYDATCLALGAQKHRELPVPGTGLDGVLPAMEFLPQENRRQQGQAAPGGITAAHKNVVVLGGGSTGADCVATAHRQGAKQVVQIGINQKPPSERPADNPWPETAQVYTKTYAQEEGGAQEFAVNTTELADLDGDGRVDELRAERVDWTYENGSRTDKTVVDPDVRVPADLVLVAIGFVGPERNPFADLGVRQTDDGTVATDDRLMTDVDGVFAAGDARMGASLVVWAIGEGRDAARQVDRYLTGDTELSASLQTANPPLGR

SEQ ID NO: 17222 - protein, 211 aa, Solanum tuberosum
MSNENDDLSPQRRAPRLNERILSSISRRSVAAHPWHDLEIGPEAPSVFNVVIEISKGSKVKYELDKKTGLIKVDRILYSSVVYPQNYGFIPRTLCEDNDPMDVLVLMQEPVLPGCFLRARAIGLMPMIDQGEKDDKIIAVCADDPEYRHYTDIKQLPPHRLAEIRRFFEDYKKNENKDVAVDDFLPPNSAVNAIQYSMDLYAEYILHSLRK

SEQ ID NO: 17223 - protein, 1161 aa, Arabidopsis thaliana
MSSTAASSTVGGGGSSEISGVKKTSKRPKYSRFTQQELPACKPILTPRWVILTFLVAGVVFIPLGVICLFASQGLRFCGFIEDMFHSYLKVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGCYDAVSVASGFFMSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 17224 - protein, 496 aa, Ananas comosus
MSFREESGSEDGGRSELKKPFLHTGSWYRMGMGSRQSSLMEKMGSSASVIRDSSISAFLCTLIVALGPIQFGFTAGFSSPTQESIISDLSLSLSEFSLFGSLSNVGAMVGAIASGQIAEYIGRKGSLMIASIPNIIGWLAISFAKDYSFLYMGRLLEGFGVGVISYTVPVYIAEIAPQNMRGALGSVNQLSVTIGIMFAYLLGMFVPWRLLAVIGILPCTVLIPGLFFIPESPRWLAKMGMMEDFESSLQVLRGFDTDITAEANEIKRAVASSRRRTTIRFADLKQKRYSVPLMIGIRLLVLQQLSGVNGILFYAGSIFKAAGLTNSDLATCGLGAIQVVATGITTWLLDRAGRRILLMVSTAGMTISLLVVSVVFFLKGTVSEDSELYFILSILSLVALVAYVISFSLGMGAIPWIIMSEILPVNIKSLAGSVATLANWLTSWLITMTATLMLNWSTGGTFTAYMIVSVVTLVFVILWVPETKGRTLEEIQWSFR

SEQ ID NO: 17225 - protein, 168 aa, Nicotiana attenuata
KHWSKKDAREATILKDPEYLEFLEFLAKPVENLPSAEIQLERKEAERAGSAKDAPIVTPLMDYIRQKRAAKGGARRSISNGRSTKRVGGASSRTPSSAASKRGSEKRTSTTMYVLRDSSKAGNGKDKSYILVPKRDDQQLSDKSGTSAPGSGIDLVEGEIGRSVTADS

SEQ ID NO: 17226 - protein, 617 aa, Ananas comosus
MDGAAASAAATASIRVPYRHLNEAELELVRLDGEPNGEAEVAPSRAVHVPSSSPSSSSSPSAPAMAKPRSSVKTLVLSCTVAAGVQFGWALQLSLLTPYIQTLGIQHAFSSFIWLCGPNYRLCGATMCWYLGVINALSKYGTEAAFLFLLGVSRYRFAVTLIRLFLQTLDTFLGDTSEHCSTYKGTRYRAAVFFIIGFWMLDLANNTVQGPARALLADLSGPDQCSSANAIFCSWMAVGNILGFSSGASGHWHRWFPFLTTRACCEACGNLKAAFLIAVIFLLSCMLVTLYFAKEVPLEANHSRQLSDSSPLLHNQGTERHESSHSNYEKLTNGRHSESNIESSNSHFDYSEDINSNISRDNSEHFNDGPGAVLVNILTSLRHLPPGMHAVLLVMALTWLSWFPFFLFDTDWMGREVYHGDPNGDSTERQYYENGVREGAFGLLLNSAVLGVSSFLIDPMCRFIGARLVWAACNFIVFICMAATTILSWVSISNYSNGIQHVIGANKAVKNVALVVFSLLGFPLAITYSVPFSVTAELTAGTGGGQGLATGVLNLAIVVPQMVVSIGAGPWDALFGGGNIPAFALASIFSLAAGILAVLKLPRLTNSYSSVGFHGFG

SEQ ID NO: 17227 - protein, 78 aa, Zea mays
KGAGGLLLPPTGAVTGSAGPALALVDEGMSPEGPGLSLGVTNNLLGWILLGVLGLIWSLYPIYPFSLEKDEGSGGPSL

SEQ ID NO: 17228 - protein, 800 aa, Geobacter metallireducens GS-15
MTWIRWFSAITIDDVPLVGGKNASLGEMYRELRPLGVKIPNGFAITAEAYWYLVRSAGVLDEMRRTLAKLHKEDVDDLALRGHRVRELICGAPLPADLAAEITAAYRRLCIEYGENCDVAVRSSATAEDLPTASFAGQQETYLNIRGEVQLLDACRRCFASLFTDRAISYRIDQGFDHFKVGLSIGVMKMVRSDRASSGVIFTLDTETGFRDTVLVTGAWGLGENVVQGAVNPDEFTVFKPPLRQGFRPIVRRKLGEKKIKMIYGTGTSKHLTKNVEVPREERRHYCLADAEVLELARQALLIEEHYSKRAGHDVPMDIEWAKDGVSGELFIVQARPETVESQKRLDFLETYVLERKGEVLVTGTSVGGKIAVGPARVITDVHKLNEFSPGEVLVADTTTPDWEPVMKTAAAIVTNKGGRTCHAAIVSRELGIPSVVGTGDGTGRIAPGREITVSCAEGDVGRIYDGALPFRIERVDLSGMRRPRTRIMMNLGNPEEAFSLCRIPNDGVGLARMEFIITNHIKVHPMALVHPERVEDEASRREIGRLTAGYPDPPAYFVEKLAEGIGTIAAAFHPKPVIVRMSDFKSNEYASLLGGRAFEPAEENPMIGFRGASRYYDERYREGFALECRALKRVRDEMGLVNVIPMIPFCRRIVEAEKVLAEMAANGLVRGENGLGVYVMCEIPNNVIMIDEFSQLFDGFSIGSNDLTQLTLGIDRDSALVAHVFDERDPGVMRLIASVVEGARRNHRHSGICGQAPSDYPEFAAFLVREGIDSISLNPDSILKITLRVLEMEKEIEKP

SEQ ID NO: 17229 - protein, 269 aa, Streptomyces coelicolor A3(2)
MRIRIVDAFTDRPFAGNPAGVLLLDAFPDDDRLQRVALEVNHSETAFAHRLPAGGEADWALRWFTPATEVAMCGHATLATAHVLHTTGAHEGPVRFATRSGVLVATPREDGSFTLDFPTAPLTPVEAPPGIAAALGAEPRTVLDTGPNIGDLLVEVADEETVRGLSPDLGALAAHSERGIIATARAEDPARGYDYVSRCFFPNVGIDEDPVTGSAHTALAPFWSERLGRPDLIGLQASSRSGRVRTELRGGRTLLSGHAVTVIDGELLA

SEQ ID NO: 17230 - protein, 395 aa, Candidatus Kuenenia stuttgartiensis
MEIIVSKRLQSIGAYAFAEVDKEVEKLRAMGVTPIDFGVGDPTVPTPEIIRKATQEGITKRKSSGYPSYIGTAEFRQTIAQWTKKRFGVTLDPSTEISSTIGSKEGIFNFHEGFIDPGDYVIIPTPGYPPYTRGTLFAEGTPYYVPLLKENNFLMDLKSIPEEVCKRAKILWLNYPNSPTGAVAPLSYLKEAVEFGKRHNIIVASDEAYSEIYFNEPPHSILEVAKEGVIVFNSLSKRSAMTCYRIGWVAGDKKIVDVFKKVKTNIDSGTPTFIQDGAIAALSDETHVGEMRADYKLKRDLLVTAFKKINLPDCTPEATIYLWQKVPQGMSSVEFAKKLLSPDIAIVTTPGGWISDKTESGINPGEGYVRFALVPGIEDTKKAAKRIEEQLSKII

SEQ ID NO: 17231 - protein, 553 aa, Arabidopsis thaliana
MNSFMSLVRTVTIALLLIAFLQNAKAVKNLQSIVAYHGAVATDDGRCSAIGTNVLRQGGNAIDASVAAALCLGVVSPASSGIGGGAFTMIKLANGTEVAYDSRETAPLSASEDMYGGNVDLKKKGALSVGVPGEVAGLFTAWKQHGKLPWKRLVTPAEKLAEGFKISKYLYMQMNATRSDILADKGLSDLFVSNGELKKPGTICHNPKLALTLKLIGEYGPKAFYNGTVGVNLARDIKKSGGIITLKDLQSYRVKIKEPLSADILGYRVLGMPPPSSGGAAMMLVLNILSQYGIPSGVSGPLGVHRLIEALKHAFAVRMNLGDPDFTDVTKVVSDMLSPKWNQIDDHGTSHLSIIDRERNAVSMTSTINGYFGALMLSPSTGIVLNNEMDDFSIPMKSNGNLDVPPPAPANFIRPGKRPLSSMSPTIVLKDGKVKAAVGASGGANIIAGTTEVYLNHFFLKMDPLSSVLAPRIYHQLIPNRASYENWTTVFNDHFEIPKATRVVLEKKGHVLSPIAGGTIAQFIVQESGENSGGRSELVAVSDPRKGGFPSGY

SEQ ID NO: 17232 - protein, 405 aa, Burkholderia xenovorans LB400
MNPLLDSLQPYPFEKLRALFKDVTPNAGLAHISFGIGEPKHPTPALIRDAVVASLGGLSAYPATSGSPALRESIAKWVTQRYNLPPVDPATQVLPVSGSREALFSLAQTVLDPQKNAGGEPAIVLCPNPFYQIYEGAAILAGAQPYFVNSDPARNFACDYSAVPAEIWARTQLLYVCSPGNPTGAVLTLDDWRELFALSDRYGFVIASDECYSEIYFDEAKPPLGGLEAAHKLGRGFERLVMLSSLSKRSNVPGMRSGFVAGDAAILKDFLLYRTYHGAALSTVFQNASIAAWNDEAHVRENRAKYLQKFSTVTPMLAEVLDVRLPDAAFYLWADVSRTGLTDTVFAQRLYADYNVTVLPGSFLARTAHGVNPGRNFVRMALVADVDECTQGAQRIVDFCRALAG

SEQ ID NO: 17233 - protein, 420 aa, Haloarcula marismortui ATCC 43049
MTHTESDTLPVTYADIERARERLDDDTVVKKTPVERSSSLGGFVDAEVYLKMEHLQWTGSFKTRGAYNKISQDVADDVESFVAASAGNHAQGVALAATKCGAESTIFMPENAPQAKIDATRAYGGSVELVGNDFQETMSHAKAVVEETDAEFVHAYDDLDIIAGQGTLGTEMYHDCPDVDTVIVPIGGGGLISGVSTAIKHLSPETRVIGVQATGAETVHESLDKGIPVVLDEVDTIADGIATGGISETTLDIIEANVDEVVTVSDTDIAQAILLLMERAKQVVEGAGAASVAAILSDSLDVSGETVMPLLCGGNLDMTQMREVLIHALTERQQLLQLRVRIDDQPGVMEEISGVIARQGANIHDVRHERSVENLEIGEAYLVFNVETSGAEHAQSIITAIRDAGYPVDNVAREAKSGAL

SEQ ID NO: 17234 - protein, 1151 aa, Solanum lycopersicum
MELLVETRPFRIVEESISAESSDPTNAVIFVGISLLLGIGCRHLLRGTRVPYSVALLVLGIGLGALEYGTHHGLGRIGDGIRIWANIDPDLLLAVSFPALLFESAFSMEIHQIKRCAVQMLLLAGPGVLISTFFLGAALKIAFPYNWSWSTSLLLGGLLSATDPVAVVALLKELGASKKLGTIIEGESLMNDGTAIVVYQLLLRMVTGWTFNWGAVIKFLVQVSLGAVGFGIAFGIASVLWLGFIFNDTVIEISLTLAVSYVAYFTAQQGADVSGVLTVMTLGMFYSAVAKTAFKGESHQSLHHFWEMVSYIANTLIFILSGVVIAEGILAGDNIFKIYDNSWGYLILLYVLILVSRAVVVGVLYPFLRYFGYGLDLKEAFILVWGGLRGAVALSLSLSVKRSSDGSQYISSDTGTLFVFLTGGVVFLTLIINGSTTQFALHYLGMDKLSAAKKRILNYTKYEMLNKALEAFGDLGDDEELGPADWPTVKRYITSLNDVEGEPVHPHTSSGNDDNVDHMHLEDIRIRLLNGVQAAYWEMLNEGRIPQTIANLLMQSVEEANDVVSHEPLCDWKGLKSYVNIPNYYKFLQTSFVHRKLVTYFTVERLESACYICAGFLRAHRTARQQLNEFIGESEIASLVIKESEEEGEDARKFLEEVRVSFPQVLRVVKTRQVTYAVLNHLIDYVHNLEKIGILEEKEMAHLHDAVQTDLKRLVRNPPLVKFPKIRDLISVNPLLGALPPTVRETLIGSTKEIMKLRGATLYEEGSKATRVWLISNGVVKWSSKSTSNIHLLHPTFSHGSTLGLYEVLVGKPYICDIITDSVALCFSVDNERILTALRSDPAVEDFFWQESALVLAKVLLPQMFETTKMQDMRTLVAERSTMSIYIRGESFELPHHSIGFLLEGFVKSHGSHEGLLSAPAPLLPLALEQQSFHNTEASGVHAASFSHQPSQYQVETRARVIMFDIAGFLSGRGLQRRSSSLLSHSIDHPSRSFSRELGGLMSWPENTYKAMQHRQDVERTGQQETNMSTRAMQLNIFGSMISDTRSRSRSFPGISAAKTSHSQSYPEVRSDGVQTLVSVRSEGSTTLRKKAQVQGENKDMSIQLPSAPIEESDTREYSSDDSGGEDEHLIRIDSGRPSFPQWIAEEDKTS

SEQ ID NO: 17235 - protein, 137 aa, Streptomyces coelicolor A3(2)
MTQRSLVLLKPDAVRRGLTGEIISRIERKAGWQITALELRTLDTETLEQHYGEHKGKPFYEPLVEFMASGPVVAMVVEGERVIEGVRALAGPTDPIAAAPGSIRGDYGVIVRENLIHASDSEESAERELKIFFPGRV

SEQ ID NO: 17236 - protein, 343 aa, Marinobacter sp. ELB17
MTQPAFYRVAINGYGRIGQCVLRALYENGYRDHFQVVAINELSDIDTIAHLTRYDSTHGRFQGTVAVEGDSLWVNGDVIRVLNSTNPAELPWKEMGIDLVLECSGAFSDRATAEQHLAAGAKRLLFSQPAEADVDRTVVYGINHLEMVDSDRIVAAGSCTTNCLVPMIKVLDDALGIEQGTTTTIHAAMNDQPVIDAYHHQDLRRTRSALHNIVPVDTALALGIERLLPHLHGRFSSVAMRVPTLNVSAIDMVLNVRTPVTVADVNGILQRAATTLPLMGILGYTNELLASSDFNHDSRSGVVDGGQTRVTGETMVKVLCWFDNEWGFANRMLDVSRHWLAVS

SEQ ID NO: 17237 - protein, 388 aa, Marinobacter sp. ELB17
MAIKKMTNLNLAGKRVLIREDLNVPLKNGRITSDARIRAALPTIKAAASAGAKVMLMSHLGRPEEGVYDQAASLKPVAEHLSDALGQNVRLIKDYLNGEDLHLADGDVVLFENVRFNKGEKKDDEALAKQYAALCDIYVMDAFGTAHRAQASTHGVGKFAPEACAGPLLAGELEALGKALDNPARPVVAIVGGSKVSTKLDVLNALEKVCDQIIVGGGIANTFLAAAGYPVGKSLCEHDLLDVAKNIASRVEIPLPVDVVVASEFSETATATIRNISDVTEDDMILDVGPETAGQFAELLKNAKTILWNGPVGVFEFGPFENGTKVLAHAIADSAAFSLAGGGDTVAAIDKYGVNEKISYISTGGGAFLEFVEGKTLPAVAMLEERGA

SEQ ID NO: 17238 - protein, 923 aa, Vicia hirsuta
MELQALWITRLAVACVLCLCIFIRSGSSATGGFESIACCADSNYTDPKTNLNYTTDYKWFSDKSSCRQIPEILLSHRSNVNFRLFDIDEGKRCYSLPTIKDQVYLIRGTFPFDSVNSSFYVSIGATELGEVTSSRLEDLEIEGVFKATKDSVDFCLLKEDVNPFISQLELRPLPEEYLRDFSTDVLKLISRNNLCGIEDDIRFPVDQNDRIWKATSTPSYALPLSLNVSNVDLKGKVTPPLQVLQTALTHPERLEFVHDGLETDDYEYSVLLYFLELNNTLTAGQRVFDIYLNSEIKKENFDVLEGGSKYSYTALNITANGSLNMTLVKASGSKFGPLLNAYEILQARPWIDETSQPDVEVIQKMRKELLLQNQDNEALESWSGDPCMIFPWKGVACDGSNGSSVITKLDLSFNDLKGTIPSSVTEMTNLQILNLSHNHFDGYIPSFPSSSLLISVDLSYNDLTGQLPESIISLPHLKSLYFGCNQHMSDDDEAKLNSSLIITDYGRCKAKKNKFGQVFVIGAITSGSILITLAVGILCFCRYRHRTITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRVLPSTTTMAESTITTQNVSHPQPR

SEQ ID NO: 17239 - protein, 657 aa, Burkholderia xenovorans LB400
MIRFNQFSLARGTKPLFDNTTFTLNPGEKAGLVGANGAGKSTLFAVLRGELHADGGDFSIPPTWQIAHVAQETPAADKTALAYTLDGDAALRTIEARIAAASAAHDGAAEGEAHAAFADADGYTAPARAEALLLGLGFTLEQTREPVSSFSGGWRMRLNLAQALMCRSDLLLLDEPTNHLDLDAIVWLEDWLHRYPGTLIVISHDREFLDSVCNVTLHLEQQQIKRYGGNYSQFEVLRAQQIALQQSAYEKQQRTVEHLQSYINRFKAQATKARQAQSRVKALEKMELIAPAHAASPFTFEFRTPDSAPNPMMVMEDVRCGYRSESEPGVEIPIVDHVMLSIQNGQRIGLLGANGQGKSTLIKTLAGTLEPLGGHVREGKGLRIGYFAQHQLETLRPEDTPLQHLARLAPDTREQELRDFLGSFNFSGEMATSKIAPFSGGEKARLALALIIWQKPNLLLLDEPTNHLDLETRHALTMALAQFEGTLILVSHDRHLLRATTDQFMLVAKHRLQEFDGDLDDYRDWLLQHAAEQRAALKAGTASNGGNGGNGGSGSDGGADNGVNRKEQRRLEAETRQKLAHLKKPLQSRITKIEKEMDALNAEKTTLDAFVVDPASYEPGQKSKLTEAIRRQADVNARLEALEAEWLEAHEELEQIG

SEQ ID NO: 17240 - protein, 923 aa, Melilotus albus
  misc_feature (64)..(64): Xaa can be any naturally occurring amino acid
MELQIIWILRLVVACVLCLCIFIRSASSATKGFESIACCADSSYKDLKTTLNYTTDYIWFSDKXSCRQIPEILFSHRSNKNVRLFDIDEGKRCYDLPTIKDQVYLIRGTFPFDSLNSSFYVSIGATELGEVRSSRLDDFEIEGVFRATKDYIDFCLLKKDVNPFISQLELRPLPEEYLHGLATSVLKLISRNNLGGTEDDIRFPVDQNDRIWKATSTPSSALPLPSNVSNVDLKGSVTPPLQVLQTALTHPERLEFVHDGLETDDYEYSVFLYFLELNGTLKAGQRVFDIYLNNEIKKEKLDVLAGGSKNSYTVLNISANGSLNITLVKASGSEFGPLLNAYEILQARPWIEETNQIDLEVVQMMREKLLLHNQDNEALESWSGDPCMLFPWKGIACDDSNGSSIITKLDLSSNNLKGTIPSTVTEMTNLQILNLSHNHFDGYIPSFPPSSVLISVDLSYNDLTGQLPESIISLPHLKSLYFGCNQHMSDEDTAKLNSSLINTDYGRCKAKKPKFGQVFVIGAITSGSLLITLAVGILFFCRYRHKSISLEGFGGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEAAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESAITIQTLSHPQPR

SEQ ID NO: 17241 - protein, 429 aa, Helicobacter hepaticus ATCC 51449
MINDSLPHTCTLPSLESAHIAVIGLGYVGLPLAVAFGKVYPTIGFDIDSKRIEELQTGIDNTQEVNKEDILQASQLYFCDQLTHIASANIYIICVPTPIDKNKVPDLSPLLNASKLVGKVLQKGNLVIYESTTYPTCTETECKNMLESTSHLSLNKDFYLGYSPERINPSDSSHTLTQIRKITSGSTLEVAKFVDSLYASIITAGTHCVSSIKTAEMVKIIENAQRDLNIAFVNEMCIICDYLDIDALEVLEAAKTKWNFLPFSPGLVGGHCISIDPYYLTHKMNAIGYIPQVISSGRLINDMMPHFVAQKMIKLMIAQHIEVLSSKILILGITFKQNCPDIRNSKVPLVKKELEDFGAQVSIYDPLANVKEVQKQYGITLLPSLPTEYFDAIFLAVAHDKFLSLSHQDLGKKEHIYYTLTHHKLSPDL

SEQ ID NO: 17242 - protein, 776 aa, Halobacterium sp. NRC-1
MIGAGIFVLPKIAAEQAGPASMVSFFVGGMVSLFAALSLSELATGMPKAGGSYYYVNRALGPFFGSIVGWGMWAGLTFASAFYMIGFGQYLLPGLGEYVGVLAGWGDLGITVAALAMAALLTAVNYYGVKETSALQNVIVLTLVGLVLAFLGLGAVTGPTITEFNPNGWPAVAATIGTVYVTFIGFEVIATSAEEIKNPSRNLPLAMIAAVVTPTLMYVGVMFVSTGTIDIPVLAGSDVPVALVAREIFQPLAGAVSWLPFVSVQPATAGSVGALAMIVGAVLATVSSANASILSAARVNFAMGRDKILVNWLNEVHDRFRTPYRAIAATGVITLLLIGIGVGVGTLAEVASFMYLVTYALVHVSVVVLRRANPDTYDPAFRIPAVLYPVVPVLGAAACVAVLVQMSVTFSPMTIGVASVAVVLPVTPTPVGAIGTVLVAFGIAWYYCYARARAPSQSLVGDALAPSSSPDTDTPDTYTVVVPVANPDTEHDLLRMAAASAHAHTDAHAEVIAVNVIEVPRQTSLSQDLAFEEERVERQQELLDAASAAAADLDVRLRTRAVASHDTGAAILDVIEDTAADHVLLGWGGTRRRDHVLGSTIDPVVGHASCDATLVRLGPAAAGDASDIMVLAGEGPHAPVAARRAAEFVAADETDASLTLLNVQPPADDDDDADASATERGAAVIDALAERAGIKYMTYDTEVVVSTDTEAAVIDAAADFDMVYAGATRSGPVSQAVFGSIPEAVGAGVDQTVVMARGPDNTPMSVRDAITRRFGG

SEQ ID NO: 17243 - protein, 301 aa, Chlamydomonas reinhardtii
MSDRTRGGEAVSDLAAFARAGITSLDTADNYGPAEALIGQYLRLHPWNSPATTIATKLSYINEEQMAGVSRTLVEYAVRSCLVRTGRQRVDLVQLQKWLDVLKWLAELREQGMIGHIGLCNFDVPSLAKAMDARVGVVSNQVQYSLIDRRPALYMQQAAQAYGVQLIAYGTLAGGLIADKYYGVAAGKVRLDTASKQKYGTLLHQVGTPPGGLAGGAAVAGGGSWAFMQEVLGATRAVGERHGGVSSSAVALAWVLQQPQVACALKLDDADMLDLDAVWEGAPNPPTSDIYVWERGGAWAV

SEQ ID NO: 17244 - protein, 236 aa, Streptomyces coelicolor A3(2)
MNDFPGSGLYDRVNAAQDMRAASQGRYTGPQAESRYVIPRFVERTSQGVREYDPYAKLFEERVIFLGVQIDDASANDVMAQLLCLESMDPDRDISVYINSPGGSFTALTAIYDTMQYVKPDVQTVCMGQAASAAAVLLAAGTPGKRMALPNARVLIHQPYSETGRGQVSDLEIAANEILRMRSQLEEMLAKHSTTPVEKIREDIERDKILTAEDALSYGLIDQIITTRKMDNSSLR

SEQ ID NO: 17245 - protein, 272 aa, Dehalococcoides sp. VS
MKMPQPSNQIAVIKLGGSVLNSKDTSLKDIATLKQMGLKPVLIHGGASTVSAWSAKLGLETRLVNGERVTDETTLDVVAAILAGLVNKEIVAALLDMGIQAAGISGVDAATVTGQMRATETGYLGDVIKINTELITTLLDANITPVISPVSFHQTNRPSGSRRILNINGDPVAGEIAAALQAERLVFMTDVPAVKGKNGEALGEISADHAAELLSSGTASGGMIPKLRSCLKATLAGCSACIIDGRKPHMLVREFTEGNCGTTVIGQHLRRS

SEQ ID NO: 17246 - protein, 219 aa, Streptomyces coelicolor A3(2)
MRRPGAVVRRAGGYVTNLMPSAAGEPSIGGGLGDQVYNRLLGERIIFLGQPVDDDIANKITAQLLLLASDPDKDIFLYINSPGGSITAGMAIYDTMQYIKNDVVTIAMGLAASMGQFLLSAGTPGKRFALPNAEILIHQPSAGLAGSASDIKIHAERLLHTKRRMAELTSQHTGQTIEQITRDSDRDRWFDAFEAKEYGLIDDVIATAAGMPGGGGTGA

SEQ ID NO: 17247 - protein, 398 aa, Dehalococcoides sp. VS
MDNWQELEHKYYMQTFYRAPITIVKGQGVKVWDDAGKEYLDFVAGWAVNSLGHCHPAVVKAVSEQAGILIQTSNNFYTIPQLKLAQLLVDNSVLDRIFFCNSGTEATEGAVKLARRYGKLKLKGAYEVITATGSFHGRTLAMVSASGQSKYQEPYTPLPTGFINVEYNNPQAIKAAITDKTCAVMLEPIQGESGVNVPDSGYLKAVRQICDETGRLLILDEIQTGIGRTGKLFAYEHSGIEPDIITLAKGLAAGVPIGAFMAKESASVFAKGEHGSTFGGNPLACAAGYATMKFILDNHISEHAGIMGSYLAKGFEKLKAKHRLIQGYRGCGLLMALGFNTDIAKEIEESCLEEGLLLNAVKPNALRFMPSLNITQADIDEALSKLERVLTRYENSGV

SEQ ID NO: 17248 - protein, 467 aa, Idiomarina baltica OS145
MSSNNLHIAVIGSGGSAMAAALKATEGGARVTLIERGTIGGTCVNIGCVPSKIMIRAAHIAQLRRESPFDKGLSTHTLKVNRSALLEQQQARVEELRESKYQSILRENSAITVINGEARFINDETLSVSLCDGGEQTVHFDRAFIGTGARPAQPPIPGLAETPYLTSTSALGLSNIPKRLAIIGASVVALELAQAYARLGSEVTVLARSRVLSQDEPAIGEAIATVFYHEGINVLEHTEASEVRYDGQHFILKTNAGTLKAEQLLVATGRTPNTENLDLETIAVQTERGAITINDRMQTSNSRVYAAGDCTNQPKFVYVAAAGGSRAAINMTGGDAHLDLSAMPEVIFTDPQVATVGLSEADAKTGGYVTESRTLGLENVPRALVNFDTQGFIKIVAESGSGRLLGVQVVAGEAGELIQAAVMAIRAGMTVNELADELFPYLTMVEGLKLCAQTFTKDVKQLSCCAG

SEQ ID NO: 17249 - protein, 379 aa, Vitis vinifera
MSSLARRLRGIFTSPLPATTKTPAKIIKRSSSNNSRLKEMVDKFKKSSDSKRFRSRYGYYEKAVLTLAKAKKFSFIEDILEHQKQYNEISTEVFAIRLMTLYGKAGMFEHAHKLFDEMPKLNCERTVMSFNALLSVCVNSKKFDKIDGFFQELPGNLGIVPDVVSYNIIVNAFCEMGSLDSALSVLDEMEKVGLEPDLITFNTLLNAFYQSGSYADGEKIWDLMKKNNVESNVRSYNAKLRGVISENRMSEAVELIDEMKTSGIKPDVFTLNSLMKGFCNAGNLEEAKRWYSEIAINELPPVRATYMTLIPCLVEKGDFEMATELCKEVCSRRWLIEPALLQQVLEGLVKESKIEEATELVELAKLKKFRITLELPSDK

SEQ ID NO: 17250 - protein, 413 aa, Sulfolobus solfataricus P2
MMQKIPEDGEVIKFENGKWIVPKKPIILYVEGDGIGHEITHAAMKVINKAVEKAYGSDREIKWVEVLAGDKAEKLTGNRFPKESEELIEKYRVLLKGPLETPIGKGWKSINVAIRLMLDLYANIRPVKYIPGIESPIKNADKIDLIIFRENTDDLYRGIEYPYDSEQAKKIRDFLRKELGVEVEDDTGIGIKLISRFKTQRIARMAIKYAIDHKRKKVTIMHKGNVMKYTEGAFREWSYEVATKEFRDYIVTEEEVTKNYNGVPPSGKVIINDRIADNMFQQIIIRPDEYDIILAPNVNGDYISDAAGALVGNIGMLGGANIGDTGGMFEAIHGTAPKYAGKNVANPTGIIKGGELMLRFMGWDKAAELIDSAIMESIRQKKVTQDLARFMGVRALSTTEYTDELIAIIDTLS

SEQ ID NO: 17251 - protein, 461 aa, Pseudomonas putida GB-1
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPNSQVSGASHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRVALDN

SEQ ID NO: 17252 - protein, 480 aa, Solanum lycopersicum
MKEDIEHSENRVNEEITTPLIIQTNKRVKEENGCYEKKQDRCMVYLSTLVAVRGSYSLGSCAGYSSPTQSAIREDLNLSIAQISLFGSIWTFGAMIGAITSGPIADYIGRKGAMRMSSGFCVAGWLAIFFAQGALALDIGRLATGYGMGVFSYVVPVFIAEIAPKDLRGALTTINQLMICCGVSVSFIIGTMMTWRTLALTGLIPCAILLFGLFIIPESPRWLAKIGHQKEFELALRKLRGKDADISEEAAEIKDYIETLEKLPKVNLFDLFQRRYSSSLIVGVGLMVFQQFGGINGICFYTGSIFESSGFSSDIGTIIYAIIQVPITALGAALIDRTGRKPLLLVSGTGLVIGCILTGISFYMKGHEMAIKAAPILAVTGILVYIGSFSVGMGAVPWVVMSEIYPINIKGAAGSLATLVNWFGAWACSYTFNFLMTWNSFGTFVLYAAVNALSILFVIKIVPETKGRTLEQIQAAINAS

SEQ ID NO: 17253 - protein, 439 aa, Bordetella parapertussis
MHSFLGPPMSISQQAFLRDAMRRLNLTRDVFAGRIGVKRRALDTWLLPEGSQEFRAMPEVVERFVSEIVQNRDLLEKYTQSGQVGPLRDRIAVEGRHQLLSVDQFTRESVEDLFRVADMMQPIARRQKVSRVLEGAVLGNLFFEASTRTRVSFGAAFCRLGGSVCDTTGFTFSSMAKGESIYDTSRVMSGYVDAMVIRHPEQGSVAEFAQATNIPVVNGGDGPGEHPSQALLDLYTILTEFSRLGKLLDGAHIAMVGDLKYGRTVHSLIKLLALYKGVKFTLISPQGLEMPDYIVEQASRNGNVIEQKSTLAEGLAGADVIYATRVQKERFANEEAGEGYTADFQVSRAIIDAYCGPDTIVMHPLPRDSRPGSNDLSTDLNHDPRLAIFRQTDNGIPIRMAIFAVLLGVEGLVQHSMRDVTWQHPSHIGPDDSVFHGLD

SEQ ID NO: 17254 - protein, 438 aa, Clostridium botulinum
GKVIVAKFGGSSLSDSALFRKVRSIIYDNENRRYIVPSAPGKRFKKDYKITDLLYLCHAHRESGISFDDVFKHIEERYLNLAKELRVKVDIKNKLEEIKREIEAGASRDFAASRGEYLNGLILADYLNYQFIDAAEIIHFKKYGSLDLRKTEKAIKEKIKNVKKAVIPGFYGALPDGTIKTFSRGGSDVTGAIVARAVEASLYENWTDVSGFLMADPNIINDPKPIEVISYKELRELSYMGAKVLHEESIFPVRDVKIPINIKNTNRAEDKGTLIVDDDKALNYTGSITGIAGKKGFTVIAIHKMLMNSELGFCRKLLSILEENGVAFENIPSGIDSVSLVIEDSQLGNKLDIILEEIKRQCNPDSLEVHVNMALIATVGNGMNRTKGISAKIFKGLLEEDVNIRMINQGSSEINIIVGVENDDFERAIRGIYNTFIK

SEQ ID NO: 17255 - protein, 429 aa, Oryza sativa
MKKLEKELKHQELLKNEQYQMKLQKCNERRLALIKSSLDIVVAIGLLQLAPKKVPRALLYPSPPSPSPLVVGNALASWDLAPPSLQPCAAAVPVVAVAREGRHRGRRRVSVLVRPFAVAEDRRSTVAAVNPKSVAASSSSSSPSVDLPPLFWSPATASHLDHGHVSVALYTCELPLPPSAETNTKGNGEAVRRSDERRRVGTPATAPAAATHTTDMEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 17256 - protein, 483 aa, Xylella fastidiosa 9a5c
MLKKHLFIVKPIEPTNHTGTGKGETQLKRSLTAGQLVMLGIGAVIGAGIFVLSGHAAAEYAGPAVVLSYILAGIACALAGLCYAEFAAMLPVSGSAYSYAYATLGEFTAWFIGWNLVLEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNAAPGKYGMEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLLVGACACTLAGLFPISLLGDLVSMGTLLAFATVCIGIVVLRRTRPDLPRPFRVPMYWVIAPAGAAACLYLFWQPFTEHWPLMVGWTVLGLVMYGLYGYHHSKLRRGG

SEQ ID NO: 17257 - protein, 403 aa, Zea mays
  misc_feature (53)..(53): Xaa can be any naturally occurring amino acid
MATKRSVGTLGEADLKGKKVFVRADLNVPLDDAQKITDDTRIRASVPTIKFLXLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 17258 - protein, 419 aa, Bacteroides fragilis YCH46
MQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLADGVSYVSTGGGALLEAIEGKVLPGIAAIQE

SEQ ID NO: 17259 - protein, 446 aa, Solanum lycopersicum
MKKVKRKLGKYEVGRTIGEGTFAKVKFARNTETGENVAIKVLAKSTILKHRMVEQIKREISIMKIVRHPCIVRLHEVLASQTKIYIVQEFVTGGELFDKIVHLGRLSEDEARRYFQELIDAIAHCHSKGVYHRDLKPENLLLDFQGNLKISDFGLSALPQQGVELLYTTCGTPNYVAPEVLGNRGYDGAAADVWSCGIILYVLMAGYLPFDETDLPTLYTKIKAAEFSCPFWFSPGATSLIQKIIDPNPQTRIKIDGIKRDPWFRKNYRAVKAKADEVVNLDDIHAVFDDIEDAFVSEKSEDSESGPLVMNAFEMITLSQGLNLSALFDRRQDYVKRQTRFISRQPAKVVIETIEAAAESLGLKVHTRDYKTRIEGVTANRAGQFAVVLEVFQVAPSLFMVDVRKAAGDTLEYHKFYKTFCTKIDDVIWKPKEGMSNAVLLRTRTR

SEQ ID NO: 17260 - protein, 341 aa, Bacteroides thetaiotaomicron VPI-5482
MGKKVVTLGEIMLRLSTPGNTRFVQSDSFDVVYGGGEANVAVSCANYGHEAYFVTKLPKHEIGQSAVNALRKYGVKTDFIARGGDRVGIYYLETGASMRPSKVIYDRAHSAIAEADAADFDFDAIMEGADWFHWSGITPAISDKAAELTRLACEAAKRHGVTVSVDLNFRKKLWTKEKAQSIMKPLMKYVDVCIGNEEDAELCLGFKPDADVEAGHTDAEGYKGIFQQMMKEFGFKYVVSTLRESFSATHNGWKAMIYNGEEFYTSKRYDIDPIIDRVGGGDSFSGGIIHGLMTKPNQGAALEFAVAASALKHTINGDFNLVSVEEVEALAGGDASGRVQR

SEQ ID NO: 17261 - protein, 436 aa, Clostridium botulinum
VIVAKFGGSSLSDSDLFRKVRSIIYDNENRRYIVPSAPGKRFKKDYKITDLLYLCHAHRESGISFDDVFKHIEERYLNLAKELRVKVDIKNKLEEIKREIEAGASRDFAASRGEYLNGLILADYLNYQFIDAAEIIHFKKYGSLDLRKTEKAIKEKIKNVKKAVIPGFYGALPDGTIKTFSRGGSDVTGAIVARAVEASLYENWTDVSGFLMADPNIINDPKPIEVISYKELRELSYMGAKVLHEESIFPVRDVKIPINIKNTNRAEDKGTLIVDDDKALNYTGSITGIAGKKGFTVIAIHKMLMNSELGFCRKLLSILEENGVAFENIPSGIDSVSLVIEDSQLGNKLDIILEEIKRQCNPDSLEVHVNMALIATVGNGMNRTKGISAKIFKGLLEEDVNIRMINQGSSEINIIVGVENDDFERAIRGIYNTFIK

SEQ ID NO: 17262 - protein, 448 aa, Bacillus licheniformis ATCC 14580
MPVQTSSKNQVFLEQQNRRESNARSYPRRFPLAMQTAEGVLVTDADGKQYYDCLAGAGTLALGHNHPVVIEAIQKMIEEKRPLHTLDITSEIKEEFVNEVFASLPEAFAKRAKIQFCGPTGGDAIEAALKLVKTATGKRTILSFHGAYHGATHGTMALSGNLSPKENVQGLMPDVHFLPYPYEYRCPFGKGGEASHKLSSAYIENMLDDPESGVLQPAGMIFEAVQGEGGSVPARAEWIREMRRITKERGIPLIIDEVQTGIGRTGKMFAFEHAGIIPDVIVLSKAIGGSLPLSVVIYDQDLDQWGPGAHIGTFRGNQMAMAAGSATLKYIKEHDVLSHVEKVGAKLMRELQDIQEHVPEIGDVRGRGLMIGAEIVAPHKKQNANGSYPADAELASTIQRKCFEKGLIVETGGRHGSVIRFLPPLIVTEAQIDDIITIFREAVYEAVK

SEQ ID NO: 17263 - protein, 117 aa, Medicago truncatula
MAAEEGHVIGVHTVEAWKEHLEKGNGSKKLIVVDFTASWCGPCRFIAPILAEIAKKLPNVTFLKVDVDELKTVAEEWAVDAMPTFLFLKEGKLVDKVVGAQKDQLQAAITKHATTDA

SEQ ID NO: 17264 - protein, 346 aa, Neisseria meningitidis MC58
MQAVVVNKNVAGDVEVIEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHH

SEQ ID NO: 17265 - protein, 469 aa, Shewanella sp. ANA-3
MSVESVLKQLEELEVKFVDLRFTDTKGKEQHVSIPAHQVDADFFEDGKMFDGSSIAGWKGINESDMVLMPDPTTFVLDPFTEETTALIRCDILEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGIDGIQNKIHPGEAMDKDLYDLPAEEAAEIPQVATSLENALENLQADHEFLTRGGVFSEDFIQSYIALKSAEAERVSRTTHPLEFEMYYSL

SEQ ID NO: 17266 - protein, 120 aa, Medicago truncatula
MAAEEGQVIGVHTVEQWKEEIQKGNDSKKLIVVDFTASWCGPCRFIAPILAEIAKKIPEVIFLKVDIDEVKSVAKEWSVEAMPTFLFLKEGKEVDKVVGARKEELENAITKHKDATVATA

SEQ ID NO: 17267 - protein, 625 aa, Triticum aestivum
  misc_feature (590)..(590): Xaa can be any naturally occurring amino acid
MEAPPSPRRLVAVVLAAVALLVSSPCSALLSAKGVNIEVQALIGIKNQLKDPHGVLKNWDQYSVDPCSFTMITCSSDNFVTGLEAPSQNLSGLLAPSIGNLTSLETILLQNNIITGPIPAEIGNLASLKTLDLSGNNFYGEIPPSVGHLESLQYLRLNNNTLSGPFPTASTNLSHLVFLDLSYNNLSGPIPGSLARTYNIVGNPLICAANTEKDCYGTAPMPMTYNLSQGTPPTKAKSHKFAVAFGAVTGCMSFLFLAAGFLFWWRQRRNRQILFDDEDQHMDNVSLGNVRRFQFRELQVATEKFSSKNILGKGGFGHVYRGQLPDGTLVAVKRLKDGNAAGGESQFKTEVEMISLAVHRNLLRILGFCMTATERLLVYPYMSNGSVASRLKGKPPLDWITRKRIALGAARGLLYLHEQCDPKIIHRDVKAANVLLDDCCEAIVGDFGLAKLLDHQDSHVTTAVRGTVGHIAPEYLSTGQSSEKTDVFGFGILLLELITGQTALEFGKASNQKGAMLDWVKKMHQEKKLDVLVDKGLRSSYDRIELEEMVQVALLCTQYLPGHRPRMSEVVRMLEGDGLAERWQASPASXSHKFTVPEFTFSRCYSDLTDDSSLLVQAVELSGPR

SEQ ID NO: 17268 - protein, 519 aa, Yarrowia lipolytica CLIB122
MSTFDWESIVPATPLDQIPGDIQRLRKGFRSGKTLDLNYRLDQIRNLHYVLRDNVEAIKDAVYKDLGRPKHETDLCEVGFLWGEFNNVVANLKKWAADEDVKTNLQYSISSPKIRKRPLGNVLIISPWNYPFMLTVSPLIGALAAGNTVAVKFSEMAPHTSKIVGDLCTKALDPDVFQAIQGGVPVVTKTLEQKFDKIMYTGNHTVGKIIATAANKYLTPVILELGGKSPVFVTKNCKNIKLAAKRALWGKVVNAGQTCVAPDYVIVEPEVEQEFIDACKYWINEFYSGKIDQYNPDFAKIATPNHWNRLTSMLSKSKGEIITGGNTDEKTRFIAPTVVAKVPDNDSLMEDEIFGPLLPILTARSVEEGIKYVHENHDTPLAMYVFTDKASEGDYIQSQINSGGLIFNDTLIHVGCVQAPFGGVGMSGYGAYHGEDSFLAFTHRQTYLNQPKLLEPLQDVRYAPYTKTKRSMVKNLLLVGPIFPRTGSVYPNVLIRIFRKIWFWVLIVAIGAAGAKALL

SEQ ID NO: 17269 - protein, 448 aa, Enterococcus faecalis V583
MDAKQYVKNIQEKIHQLDQGQTEYLQAVDEFLPTVEGFLEKNPQYIEANVLGVLIEPERIFQFRVPWQDDQGNWHVNRGYRVQYNSAIGPYKGGLRFHPSVNLSVMKFLAFEQIFKNSLTGLPIGGGKGGSDFDPKGKSDAEVMRFCQSFMTELQKHIGPSTDVPAGDIGVGAREIGYLFGMYKRLRNYDAGVLTGKPLGYWGSQARTEATGYGTVYFVKHLLADKNDTFEGKKVAVSGSGNVAIYAMEKATELGATVITCSDSSGFVYDPEGIDVALVKELKEKNRERISKYVETRKGATYYDKESVWNFETAYDIALPCATQNEINEKQAAILVKNGVKVVAEGANMPCTLEAVAVFAKSAVIYCPGKAANAGGVAVSALEMSQNAERLAWSFEKVDGMLDQIMQNIYETCRDTANEYQARDNFVLGANIAGFEKVAAAMLSQGLV

SEQ ID NO: 17270 - protein, 537 aa, Burkholderia xenovorans LB400
MTSSNTPSSPLNAIADQALGLADAPAQAAAIAAAPEAVVAEAAAPTGPSFASLGLSADVVSALTAAGYQNPTPVQQRAIPAGIAGRDLMVSSPTGSGKTAAFMLPAIERFSQLQKTQAGQPREPRPADGARTRRPQPVARPTMLVLTPTRELAMQVTTAAATYGKHLKRLRTVSILGGVAYGQQLMLLAKNPEILVATPGRLIDHLERGRIDLSQLQILVLDEADRMLDMGFIEDIETIVAATPATRQTMLFSATLDGKITSLTGRLLKDPERIEIVQRMEQRTNIAQTVHYVDDRDHKDRLLDHLLRDSGLDQAIVFTATKIDADQLAGRLADAGFESAALHGDLPQGARNRTIRALRERRVRVLVATDVAARGIDIPGITHVFNYDLPKFAEDYVHRIGRTGRAGRSGIAVSLVHHAEQGALKRIERFVRTPLAVNVVEGFEPRKSAPSGNGRPGFGGRGRPGGGNGGGRRFGSGSGKPAGNGGAARSGTGSNGGGWAGKSAGGGSREGGFGGGSRDGGYGARRSDGPRTARRGS

SEQ ID NO: 17271 - protein, 422 aa, Streptomyces coelicolor A3(2)
MTSQPTLTKPEEGPAGPSGPDTGLQAGLKNRHLSMIAIGGVIGAGLFVGSSSGIATAGPGILLSYALVGTLVVLVMRMLGEMSAANPTSGSFSAHADRALGPWAGFSIGWLYWFFWVVVLAVEATAGAKILEGWIPAVPQWGWALIVMVVLTATNLASVGSYGEFEFWFAGIKVVAIAAFIVVGGLAVFGVLPGVDSDRAGLGNLTEHGGFLPHGAGAVLTGVLLVVFSFMGSEIPTLAAGESEDPQRAVTKATNSIIWRIAVFYLGSIFVVVALLPWDSQSIVDQGSYVAALDSLGIPNAGEIMNFIVLTSVLSCLNSGLYTASRMAFSLGRRGDAPKAFARTTRRGVPQAAILSSVVFGFVAVFFNYKFPDTVFLFLLNSSGAVASSSGWPSASRSCGCGRSSRPRRRRSWSCGCGCTRI

SEQ ID NO: 17272 - protein, 508 aa, Wolbachia endosymbiont of Drosophila ananassae
MQDFKILENLKTKALEAEKGGGSDRITKQHEKGKLTARERLSILLDESSFAEYDKFVKHHANDFGMQNANFLGDGVVIGHGTIYGRKVFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHTSKTGVADFAFNNDVEMLLKMREFFTFLPANNQESPKSAPICNDVDDIDESLNTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPFFAASHGYIDDIIVPSKTRYHFCKALELLKNKKVERIWKKHDNLPL

SEQ ID NO: 17273 - protein, 144 aa, Dehalococcoides sp. VS
MSFKRGLTALSAFILVCTGILTGCATASPVDDVNLPAVQNISVAEAKSLIDRNVVSADFIILDVRTPSEYAQGHIPGAVNLDYYASFEASLSAFDKTKTYLVYCRTGNRSASAARLMLDNGFAAIYNIQGGINVWISGGLPLET

SEQ ID NO: 17274 - protein, 121 aa, Glycine max
MASLLTLALLLFCIAFTSHVAVQAHMEDTAFNLMSDALEWPTTMSLYDEDDAQEDVENAYSRRSLFWRRMKYYISYGALSANRIPCPPRSGRSYYTHNCYRARGPVHPYSRGCSAITRCRR

SEQ ID NO: 17275 - protein, 461 aa, Streptomyces coelicolor A3(2)
MSNSTTAKAPRQPADASLSHGLKQRHLSMIALGGVIGAGLFVGSGAGIAAAGPSIVVAYTVSGLLVMLVMRMLGEMSAAYPSSGSFSAHAERAIGPWAGFTAGWAFWVLLCTAVGLEGIGAAQIVHGWLPGTPEWAWVALFMVVFCGTNLAAVKNFGEFEFWFAALKVGAISLFLVLGVLAICGVLPGTDSPGTSHLGDFLPHGGNGLIIGLLASVFAYGGLETVTIAAAESENPVRGVASAVRTAMWRIALFYIGSMAVIVTLVPWDSPEVVEKGPYVAALDELGIPGAGQLMNIVVLVALLSAMNANIYGASRIGYSLVERGQGPKVLGRVSGGVPRVAVLVSSLFGFGCVLLSYWRPDDVFSWLLNMIGAVILVVWIFIAAAQLRLRRRLEREAPEKLVVRMWAFPWLTWVALAGMAAVFVLMAREPDTRVQLYSTGGMTLVLAAVGYARQRRGAARD

SEQ ID NO: 17276 - protein, 359 aa, Vitis vinifera
MGEQKRPLSEEEIRSFMSQVLQGLAHMHKNGYFHRDLKPENLLVTNNVIKIADFGLAREVSSMPPYTDYVSTRWYRAPEVLFQSSSYTPAIDMWAVGAILAELFTLCPIFPGESEIDQLYKICCVLGTPDWTIFPEATNISRLLSVSYSEILPANLSDIIPNASLEATDLIMQLCSWDPLGRPTAEQALKHPFFHVGKWVPHPLPDPFQMKQNDTAKPNLELNLWDFGREPDDCFLGLTLAVKPSVSNLEMVHKVSQGTGEDILFCSGFQDSSGKSVFWSVLSPDRNGIDTSVDASLSLSFRSVLIFNNSFLLTSVNWQCLQTSLFTCVSFFRQIYFEQNMHMQTSSLGELLFNTKSFM

SEQ ID NO: 17277 - protein, 580 aa, Zea mays
MRLPLPLLALVCCALMARQHCAAAGKARHLRWEISNMFWSPDCEEKVVIGINGQFPGPTIRARAGDTVHVRLRNALHTEGVVIHWHGIRQIGTPWADGTAAISQCAINPEETFTYRFVVDKPGTYFYHGHYGMQRAAGLYGSLVVDVAEGEEEPFQYDGELNLLLSDWYHESIHTQMVALSSRPFRWIGEPQSLLINGRGQFNCSLAAAHTQGATNTQCAATAANTQCAPVVLPVQPNKTYRLRVASTTSLASLNLAIGNHKLTVVEADGNYVDPFVVDDIDLYSGDSYSVLLTTDQDTSSNYWVSVGVRGRLPKTAPALAVLNYRPNRASDLPALAPPVTPAWDDYGHSKAFTYRIRARAGTPPPPPTAARRIELLNTQNRMDGRIRWSINNVSMVLPATPYLGSLKMGLKSTLAAARPAETFSREYDVTLPPPNPNTTAGDNVYVLAHNTTVDVLLQNANALSRNVSEVHPWHLHGHDFWVLGYGDGAYRGDAADEARLNLRDPPLRNTAVIFPYGWTMLRFVADNPGVWAFHCHIEPHLHMGMGVIFAEAVDLVAKVPNEAVSCGATATALMAGGHL

SEQ ID NO: 17278 - protein, 426 aa, Triticum aestivum
MEGRMQGKVQQLSDSNRRIMEADAAPPRRVYQAWKGSNIFFLGGRLIFGPDVRSLIATVCLIVIPVIIFAAVVSPQLAHGYQNQIGGWVASVSIIFTAYILVLLLLTSGRDPGIVPRNSHPPEPEDIGESSNLSDWPGGQHGSAGLPLTKDVIVNGVLVKVKYCHTCMLYRPPRCSHCSICNNCVERFDHHCPWVGQCIGKRNYRFFLMFVSSATVLCIYVFTFCWVNIGKIMDTHECTFGRAILKSPISAILMLYTFVAVWFVGGLTSFHLYLISTNQTTYENFRYRYNRRSNPYNRGLVQNFIEILCSRIPSSRNNFRAKANEDSAAFASTLSMGWVLSPPKMSVDLEMGTKRQAVGAEDMEDLHSQIGSSMGLERCGTEPPHFVGRKGCSEIASDIETFAEEFGMDNKFTERKKTVRHTNDNP

SEQ ID NO: 17279 - protein, 438 aa, Clostridium botulinum
GKVIVAKFGGSSLSDSELFRKVRSIIYDNENRRYIVPSAPGKRFKKDYKITDLLYLCHAHRESGISFDDVFKHIEERYLNLAKELRVKVDIKNKLEEIKREIEAGASRDFAASRGEYLNGLILADYLNYQFIDAAEIIHFKKYGSLDLRKTEKAIKEKIKNVKKAVIPGFYGALPDGTIKTFSRGGSDVTGAIVARAVEASLYENWTDVSGFLMADPNIINDPKPIEVISYKELRELSYMGAKVLHEESIFPVRDVKIPINIKNTNRAEDKGTLIVDDDKALNYTGSITGIAGKKGFTVIAIHKMLMNSELGFCRKLLSILEENGVAFENIPSGIDSVSLVIEDSQLGNKLDIILEEIKRQCNPDSLEVHVNMALIATVGNGMNRTKGISAKIFKGLLEEDVNIRMINQGSSEINIIVGVENDDFERAIRGIYNTFIK

SEQ ID NO: 17280 - protein, 257 aa, Coprinopsis cinerea okayama7#130
MADSARGRGGFGRGRGERGRGRRGPRRGGRRDEEKDWVPVTKLGRLVKDGKIKSMEEIYLFSLPVKEYQIIDFFLPKLKDEVMKIMPVQKQTRAGQRTRFKAFVAIGDFDGHVGLGVKCAKEVATAIRGAIILAKLSVIPVRRGYWGAALGQPHTVPSKVSGKVGSVMCRLIPAPRGTGIVAAPASKRLLQLAGIEDSYTQSKGSTATMGNFLKATFAALTKTYAFLTPDLWREIPVSKFPYDEHSAHLQLAAKKVY

SEQ ID NO: 17281 - protein, 368 aa, Pseudomonas putida GB-1
MKTLNSTPRADGFHMPAEWAPQTQVWMVWPERPDNWRLGGKPAQAAHVTLAKAIARFEPVTVAASAGQYENARRQLDQPNIRVVEISNDDAWVRDTGPTFVINDHGEVRGVDWGFNAWGGFDGGLYAPWNRDEELAAKVLEMERCQRYQTEGFVLEGGSIHVDGEGTVITTEECLLNRNRNPHMNREQIEAVLRDQLAVDTVVWLPDGLFNDETDGHVDNFCCYVRPGEVLLAWTDDSNDPNYARCHAAMEVLKNTRDAKGREFIVHKMPIPGPLFATAEECAGVDQVAGSQERDPSVRLAGSYVNFLIVNGGIIAPSFDDPADAEARAILAKIFPDHEVVMIPGRELLLGGGNIHCLTQQQPAPVKR

SEQ ID NO: 17282 - protein, 493 aa, Cucurbita pepo
MGFHQIDERNQALLSKIALDDGHGENSPYFDGWKAYDNDPFHPENNPLGVIQMGLAENQLSFDMIVDWIRKHPEASICTPEGLERFKSIANFQDYHGLPEFRNAIANFMGKVRGGRVKFDPSRIVMGGGATGASETVIFCLADPGDAFLVPSPYYAGFDRDLKWRTRAQIIRVHCNRSNNFQVTKAALEIAYKKAQEANMKVKGVIITNPSNPLGTTYDRDTLKTLVTFVNQHDIHLICDEIYSATVFKAPTFTSIAEIVEQMEHCKKELIHILYSLSKDMGLPGFRVGIIYSYNDVVVRRARQMSSFGLVSSQTQHLLAAMLSDEDFVDKFLAENSKRVGERHARFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRHRDNKLRLSFSFSGRRYDEGNVLNSPHTMSPHSPLVIAKN

SEQ ID NO: 17283 - protein, 831 aa, Streptomyces coelicolor A3(2)
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDAFLVISGDALTDFDLTDLINFHKEKGSLVTVCLTRVPNPLEFGITIVDEEGKVERFLEKPTWGQVFSDTVNTGIYVMEPEVFNYVDPDVPVDWSGDVFPQLMKEGKPIYGYVAEGYWEDVGTHESYVKAQADVLERKVDVDIDGFEISPGVWVAEGAEVHPDAVLRGPLYVGDYAKVEAGAEIREHTVIGSNVVVKSGAFLHKAVVADNVYVGPHSNLRGCVVGKNTDIMRAARIEDGAVIGDECLVGEESIIQGNVRVYPFKTIEAGAFVNTSVIWESRGQAHLFGARGVSGILNVEITPELAVRLAGAYATTLKKGSTVTTARDHSRGARALKRAVISALQASAIDVRDLENVPLPVARQQTARGSAGGIMIRTTLGVPDSVDIMFFDGQGADLSQGSQRKLDRVFARQEYRRAFPGEIGDLHFPSSVFDSYTGSLLRNVDITGIAESGLKVVVDASNGSAGLVLPSLLGKLGVDSLTINPGLDEARPTESADMRRSGLVRLGEIVASSRAAFGVRFDPVGERLSLVDEKGRIIEDDRALLVMLDLIAAERRSGRVALPVTTTRIAEQVAAYHGTQVEWTTTSPDDLTRVGGEEGAIFGGDGKGGFIVPEFSSVYDGTAAFVRLIGLVARTQLTLSQIDARIPRAHVLKRDLATPWAVKGLVMRRVVEAAGDRFVDTTDGVRVVETDGRWVMVLPDPAEAVTHLWAEGPDDASAQALLDEWAAVVDSAGR

SEQ ID NO: 17284 - protein, 437 aa, Clostridium botulinum
KVIVAKFGGSSLSDSELFRKVRSIIYDNENRRYIVPSAPGKRFKKDYKITDLLYLCHAHRESGISFDDVFKHIEERYLNLAKELRVKVDIKNKLEEIKREIEAGASRDFAASRGEYLNGLILADYLNYQFIDAAEIIHFKKYGSLDLRKTEKAIKEKIKNVKKAVIPGFYGALPDGTIKTFSRGGSDVTGAIVARAVEASLYENWTDVSGFLMADPNIINDPKPIEVISYKELRELSYMGAKVLHEESIFPVRDVKIPINIKNTNRAEDKGTLIVDDDKALNYTGSITGIAGKKGFTVIAIHKMLMNSELGFCRKLLSILEENGVAFENIPSGIDSVSLVIEDSQLGNKLDIILEEIKRQCNPDSLEVHVNMALIATVGNGMNRTKGISAKIFKGLLEEDVNIRMINQGSSEINIIVGVENDDFERAIRGIYNTFIK

SEQ ID NO: 17285 - protein, 495 aa, Cucurbita pepo
MGFHQIDERNQALLSKIAIDDGHGENSAYFDGWKAYDNNPFHPENNPLGVIQMGLAENQLSFGMIVDWIRKHPEASICTPEGLEKFKSIANFQDYHGLQEFRKAMASFMGKVRGGRVKFDPSRIVMGGGATGASETVIFCLADPGDAFLVPSPYYAAFDRDLKWRTRAQIIPVHCNSSNNFQVTEAALEIAYKKAQEANMKVKGVIITNPSNPLGTTYDRDTLKTLVTFVNQHDIHLICDEIYSATVFKAPTFTSIAEIVEQMEHCKKELIHILYSLSKDMGLPGFRVGIIYSYNDVVVRRARQMSSFGLVSSQTQHLLAAMLSDEDFVDKFLAENSKRLGERHASRFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRHRDNKLRLSFSFSGRRYDKGNVLNSPHTMSPHSPLVRARTY

SEQ ID NO: 17286 - protein, 215 aa, Streptomyces coelicolor A3(2)
MSIIGSFPPGGPRVEVQETRVQTDRVLTIPNILSMARLAGVPLFLWLILRPEFGGPQSDGWALLVLALSGVSDYLDGKLARRWNQISSLGRLLDPAADRLYILSTLVGLTWREILPLWLTLVLLAREAMLLVMVGILRRHGYPPPQVNFLGKAATFNLMYAFPLLLLSDGSGWIASLAAVFGWAFAGWGTTLYWWAGVLYVVQVRRLVRADVAAD

SEQ ID NO: 17287 - protein, 438 aa, Clostridium botulinum
GKVIVAKFGGSSLSDSDLFRKVRSIIYDNENRRYIVPSAPGKRFKKDYKITDLLYLCHAHRESGISFDDVFKHIEERYLNLAKELRVKVDIKNKLEEIKREIEAGASRDFAASRGEYLNGLILADYLNYQFIDAAEIIHFKKYGSLDLRKTEKAIKEKIKNVKKAVIPGFYGALPDGTIKTFSRGGSDVTGAIVARAVEASLYENWTDVSGFLMADPNIINDPKPIEVISYKELRELSYMGAKVLHEESIFPVRDVKIPINIKNTNRAEDKGTLIVDDDKALNYTGSITGIAGKKGFTVIAIHKMLMNSELGFCRKLLSILEENGVAFENIPSGIDSVSLVIEDSQLGNKLDIILEEIKRQCNPDSLEVHVNMALIATVGNGMNRTKGISAKIFKGLLEEDVNIRMINQGSSEINIIVGVENDDFERAIRGIYNTFIK

SEQ ID NO: 17288 - protein, 382 aa, Arabidopsis thaliana
MSYSTIISNTSFLSLASKFTTRGSRLQCTVSMARSAVDETSDSGAFQRTASTFRNFVSKDSNSQFPAESGRYHLYISYACPWASRCLSYLKIKGLDDAISFSSVKPIWGRTKETDEHMGWVFPGSDTEVPGADPDHLNGAKSVRELYEIASPNYTGKYTVPVLWDKKLKTVVNNESAEIIRMFNTEFNHIAGNPDLDLYPSHLQAKIDETNEWIYNGINNGVYRCGFAKKQGPYEEAVEQVYEALDRCEEILGKHRYICGNTLTETDIRLFVTLIRFDEVSSYFQSKKKKYTICERISNVETLIQVYAVHFKCNKKLIREYPNLFNYTKDIFQIPGMSSTVNMNHIKQHYYGSHPSINPFGIIPHGPNIDYTSPHDRHRFSK

SEQ ID NO: 17289 - protein, 556 aa, Streptomyces coelicolor A3(2)
METTLRGVGVSHGVAIGEVRHMGTAVLEPPAKQIPAEDAEREQGRARKAVEAVAADLMARGNLAGGEAQAVLEAQAMMAQDPELLADVERRITVGSTAERAVYDAFAAYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIPEGTVVAVDGSTGEIFVNPAEEKKARLAAEAAERKAALAAATGPGATSDGHKVPLLANIGGPADVPAAVEAGAEGVGLFRTEFLFLDDSANAPSEEKQITAYRQVLEAFPEGRVVVRVLDAGADKPLDFLTPGDEPNPALGVRGLRTLLDHPDVLRTQLTALAKAAEGLPVYLEVMAPMVADRADAKAFADACREAGLRAKFGAMVEIPSAALRARSVLQEVEFLSLGTNDLAQYTFAADRQVGAVSRLQDPWQPALLDLVALSAEAAKAEGKSCGVCGEAAADPLLACVLTGLGVTSLSMGAASLPYVRATLAKFTLAQCERAAAAARAADSAEEARTAAQAVLSGE

SEQ ID NO: 17290 - protein, 395 aa, Helicobacter hepaticus ATCC 51449
MKKTTYAKRVELLGESTTIAISTLARELKAAGQDILSFSAGEPDFDTPEIIKDEAIRALKSGFTKYTAVAGIPELLEAIKDKLLRENTLAYERNEILVSNGAKHSLFNVFQALVDKDDEVIIPSPYWVTYPELVTFSGGKSVIVQTTQANNFKITPKQLREAITPKTKVFVLNTPSNPTGMVYTKEELESLAEVLKDTNIWVVSDEMYEKLVYGVKFFSVAAVNEDMMQRTITINGLSKSVAMTGWRIGYLACKDKKLVKLMNNLQSQCTSNINSITQKAAIVALKGEANNDIEDMRKAFEERMRFACDAINNIQNLNVCEPQGAFYLFINISTLPRYGTDSMGFCQALLKEQGVALVPGVAFGMEGFVRLSFACSLEQLKEGITRISQFVKTLF

SEQ ID NO: 17291 - protein, 560 aa, Haloarcula marismortui ATCC 43049
MAERTLHGTGATPRSGVGTVVWYGRDISLPDPDDVEVNPETERRRFADAVDTARAELESEREATAERVGEDEAAVFDAHIQFLEDPTIEDTVETMIADGGLAPNAVDAAFGEHIEQFEGMDGRMAERADDLRDVRDRLLRLLTDGERVGLGDLPADSVVLAERLTPSDTAQLDPERVAGFATVTGGRTSHAAIFARSLALPAVVGIGTDLDTLEDGAEVVVDGDNGTLLVSPDDSERAAAANESGAAVVNDSVKTTDGRHVEVAANIGQPAELEPAAKRGADGVGLYRTEFLFLDRETPPSEDEQYEAIRQALDTFPDGRVVVRTLDIGGDKRIPYLDLPDEENPFLGERGIRRSLAPDSDLFATQLRALLRAAADGAGDLAIMFPLVATIEELDAALDALEAAAGLDDYDADAVDPEVGVMIETPSAVFMADELAARVDFLSIGTNDLTQYVMAADRENERVGDLHDPTHPGVLRAIQQTVTAAHAEDIWVGMCGEMAGDPDLTELLVGLGLDELSMSAVTIPEVKTAVSETSYSSASERGDRAQLAATRSEVHTTLDT

SEQ ID NO: 17292 - protein, 189 aa, Sinorhizobium meliloti 1021
MAQERRGSREDRQNREERDSEFVDKLVAINRVAKVVKGGRRFGFAALVVVGDQKGRVGFGHGKAREVPEAIRKATEAAKRDLIFVPLRGGRTLHHDVHGRHGAGKVLLRSAKPGTGIIAGGPMRAVFETLGVHDVVAKSTGSSNPYNMVRATFDALKNQMHPKDIAAQRGMKYATLQSRRVSAGVASEE

SEQ ID NO: 17293 - protein, 295 aa, Yarrowia lipolytica CLIB122
MIRTLRPHIIGLPRSRILQATLRPPLRAGIQHPVARWNSSKPTQTEVLKSDIKSPVLKKLNLDPLKRPATLLPSEIHENLYTLPNILTFTRLLSAPLIGYFVIQHEQVLATGLFVYSCVTDMLDGYIARKFDMKSVVGSVIDPLADKFLMITLTVCLAAAGEMPVYLTTLILGRDFGLGLSAFYYRYISLPPPKTFTRFWDFSIPSAEVNPTTISKYNTAFQMLYIGLVMSKPIIGTFADMAAFDVGMTYYGYFVGATTFLSGMSYVFSKTAVKILPYPQQAKPMVFEGKKLNEK

SEQ ID NO: 17294 - protein, 477 aa, Streptomyces peucetius ATCC 27952
MCPPSSPTTYPSSPCDPPPLRKGLVRMTTTLVPPGPRGHPVLGSIREIQRDNVSAFMEAFRHHGDIVNFRGPLRINLLAHPDYVQHVLRDQHKRYPRPRKVQGCLSTIVGDGLVAAEGTSWLRSRRLTQPAFHRDILRRFGDSFTASTAELLDGWERRARDGEPLDIKSEMMHLSLANLARALFRTEWTDEVSRIEPAVQEALGFTHRRMTSPVDPLKFPSAARTRFRGALETINSLLYPMVAERRRDGGGDDLVSLLIDAVDPESGGMFTDEQIRDEVSGFFVAGHETVSTALSWTWYLLSLNPESRRRLQAEVDEVLAGRVPTVDDLPKLTYTTMVLQESMRLYPPIFVYMRCAAEDDVIGGYHIPEGRWVVVCPYVTHRHPEFWDNPEGFEPERFTPENSANRHRMAYLPFGAGPRKCIGDSFAMLQMPLVVAMIAQRFRLDLVEGQQVFPEPAISLRPRDPLMMWLRPNEETP

SEQ ID NO: 17295 - protein, 684 aa, Physcomitrella patens subsp. patens
MSNPCRLRVVHLLLLLLTILTTLAEGQLAKWNFANFSSSLATVRDSIVLLGDAAIVNTTGPPRLVLNGRGSQTGVATAGRVVYSSPVQFKDDLTRIFVSFSTNFTFTITDPGLPKPVGCGGFTFYIRGDNNSVGESGEYLGLTTEANDGLTSNRLLAVEFDTSISNIPGGDPSPAHIGLDVNGVKSDSTYDLCPGTPDCTVLVNRGDYLAKIAYDSSKEALSVELYLNTTNLVANWTAPKLSLEPIFQNYMYVGFTGSNGVFCNQTHTIYSWSFSTSRPPSSKPKSPEAPALHTSYDCYKFDGCNNYRALIIGVPVAVGGCALIFLMICIYCVYCRKTQKNPEYKARDYKDTIVFSAKELAQATKNFSEKVIIGTPGRKPVYKGVLRDNGAEVAIKEIALNNISNEFVSKAMLLGRIRHPNLVHLLGWCKCEEKRKLYLVYDYMPRGSMDKLLLLSKDADGFLGFDARYNVLVGVAAGLNCLHAEWEQCVLHRDVKPSNVYLDAMFNAHVGNFSLASLVDHDKVAHSTVMDGTLGYMAPEIPFTGKPTMKSDVFSYGILVLEVACGRLPLDWHLPQEERVLLDCVWRAREEGDIARVADKRLENTYSEKQMATLLQIGLNCAHPDPSMRPNMAFVWKVLIGGAEPPELPAKKPVIENYAALSSLGTMRNSASRGNLGSTSSDTQ

SEQ ID NO: 17296 - protein, 311 aa, Dehalococcoides sp. VS
MNTKDLLSISDLSPDDIGRLLSDAVELKARGWNNSLSGKTLALVFEKPSLRTRVSFELAMKQLGGEALYLSPAEVGLGKREPVADVARVLSRFVDIIACRTFGHDTLVQLAKYADIPIINALSDLEHPCQALADIMTIYEKKGELKGLNLAYIGDGNNCANSLLLACAMTGINCRLASPEGYLVDKNIFAKAKAYAEDSGAELYSGTDLKTAIRGADVIYTDVWTSMGQEAESEKRLKDFAGFQVNAKLVSLADKDAIIMHPLPAHYGEEVDREILECPQSVIFDQAENRLHAQKAVLRDMLGGLEIGGRH

SEQ ID NO: 17297 - protein, 436 aa, Zea mays
  misc_feature (381)..(381): Xaa can be any naturally occurring amino acid
MAELKAKRGSRTYLTWTDAMDLALLEVLVEHHNNGDRGQNGWKPHVYNAAIRNVKDKCNVDITKDNISARCKTFDKHYEIISKILSQSGFGWDWENNRLSMDSEDVWFRYVEANKGAACYKTKVVKNWDAIYTIYSKDHANGEGAKTGTESGQDVVNDSPTNANENSPVLAPKKQRTGDAIMGVLTDMKASFQEAMQSNAPLELPKKTAPSKILAALQEIPDLPREDMLRSYGMLLSRDDRIFEALMELPMEMRKDWLLFENERNDKPTRVTINNGSKAFFWHSNQINGQTPANLFNSCIIIVGESTERLKRPRAQSYPLHRRPTNGGASGRAEAERRHSAGQMEGLTSSEIAGFVVGALLLGATIAAPKVDGFIASSQRXCKGTGSARSGGMLSLGMLDDLYESLGAEAKTENLVPCTKCRSRGRLLCPECSKVA

SEQ ID NO: 17298 - protein, 425 aa, Ralstonia metallidurans CH34
MSKVAEIRGLEVLDSRGNPTVEVEVVLDDGAVGRAIVPSGASTGAREAVELRDADPRRYLGRGVLRAVQAVNTELCEALLGRDAGDQPEIDTIMIDLDGTPDKRRLGANALLGVSLAVAHAAAMSNGLPLFAYLGGERASLLPVPLINVINGGAHADNALDFQEFMIVPAGAPTFTEAVRASAEVFHTLRAMLKAAGYTTNVGDEGGFAPEFHAAEEALDILVAAIAKAGYRPGEDIALAIDPAASELYVNGSYVYQGEGVERSREEQVAYLVRLADRYPIVSIEDGMAEDDAMGWQLLTRQLGKRCQLVGDDVFCTHPTLLRQGVEQGMANAILVKANQIGTLSEMRETVRVAHGYAYSAVMSHRSGETEDVTIADLAVALRCGQIKTGSMSRADRTAKYNRLLRIERELGSRAEYAGALLRRR

SEQ ID NO: 17299 - protein, 385 aa, Ashbya gossypii ATCC 10895
MRKRNGAAAPRNGSVYNGGCGQLLCRTQLQPVATMSSPSIPKTQHAIVFDKNGGPLEYREIEVPEPKPTELLINVKYSGVCHTDLHAWKGDWPLPTKLPLVGGHEGAGVVVAMGENVRGWQVGDLAGIKWLNGSCMSCEACEQGHESNCPEADLSGYTHDGSFQQYATADAVQAAHIPAGTDLAQVAPILCAGITVYKALKSANLRAGNWVAISGACGGLGSLAIQYARAMGYRVLEIDGGDEKEALFRKLGGEVFVDFRKSKDVVADVVKATGGGAHGVINVSVSEAAIESSTEYVRSNGTVVLVGLPGGAKCKSDVFNHVVKSVSIVGSYVGNRADTREALDFFARGLVQCPIKVVGLSELPDIYGKMERGEVAGRYVVDTSK

SEQ ID NO: 17300 - protein, 220 aa, Erythrobacter sp. NAP1
MAAPLISPSILSADFARLGEEVRAVDAAGADWIHIDVMDGHFVPNLTIGPDVVKALRPHSDKTFDVHLMISPVDPYLEAFAEAGADIITVHPEAGPHIHRTLQAIRSLGKKAGAVINPGTPVEVLDNIMDMVDLILVMSVNPGFGGQSFIHSQLEKVRRIRAMIEKTGREIHLEVDGGVNPDTARLCVEAGADVLVAGSATFKGGPDHYAANIAALKGES

SEQ ID NO: 17301 - protein, 359 aa, Dehalococcoides sp. VS
MSKVCIIGTTTWGITLGTVIAHKGREVMLWARTEDEAALLSAQRRPADFLPEDYRFPEFMNVTANLEDAITGSDMILMAVPSQRMRPNIKLVAPLLTKNMLVCSAAKGLEIGTAKRMSQVIADEIYPDFAKNICVLSGPNLAMEILRGLPAVTVLAADTEKTAKKAAKLVTASNFCAYTNTDIIGVELGGSLKNIIALGAGIVDGLNFGNNAKSALITRGLTEISALGAALGANPLTFSGLAGLGDLIATCSSNLSRNHFVGVELTKGRSLNDIMYSMSNVAEGVSTTAVAYELARSMDLEMPVTENIYDVLYNNADPKEAARKLMDAQAAHELAGRKWNLFKMFRKRRARKTPELNPD

SEQ ID NO: 17302 - protein, 356 aa, Dehalococcoides sp. VS
MVNKRDYYEVLGIERSASDEDIKKAFRKMAMKHHPDRNHEEGAAEKFKEVNEAYEVLSNPEKRAAYDRFGFSAGADAFGQGGFENFDFGGLGSIFETFFGGATQGAKRGPRRGPDMSYDIQISLEEAATGVEKEITTERLEYCTECSGTGAKAGTSPVKCTNCNGTGQVYQVQKSVFGRFTSVTPCPKCRGEGTIIGEPCAKCRGTGKEYVKRTVQVKIPAGVADGNQIRLNGYGGVGDKGASAGDVYINVSIAEHTDFKRDGDDVVYELKINFAQAALGTEVNVPGLNTEHKLKIPPGSQNGKYFVLKGKGIPHLNRFGSGDEMVQLNVVTPEKLSRKQKQLFEELEKSFAEDKK

SEQ ID NO: 17303 - protein, 158 aa, Brassica napus
  misc_feature (112)..(112): Xaa can be any naturally occurring amino acid
MAQRTEKEETEFKVLETLTTTTTPTLCSNNCGVTASPSTNNMCQKCFNAAAAGIDPNPIVKRSARSVSLRSTPAKAAIRPRETDPVKRDHHQQTVNRCSGCRKNVGLTGFRXRCGDLFCAEHRYSDRHDCSYDYKTAGREAIARENPVVKAAKMVKLS

SEQ ID NO: 17304 - protein, 540 aa, Yarrowia lipolytica CLIB122
MSLDKNRQITTSESSSGSSADEGTHIMRGLTSTSTQDETTGSISEGNLEAEKISPFVFVLVALASISGFLFGYDTGYVSGALVVIKEDLGRALSNGDKELITASTSLGALLGGVIAGAMCDFFGRKWVITFANILFLVGAAIQCGAHAVWTMIGGRFVMGWGVGIASLCAPLYISELAPTRIRGRLVVLNVLAITGGQLVAYGIGAGMAHVHQGWRILVGLSMVPAFVQMVIFVFMPETPRYLVRKNKIAEAKKVLAKTYATDDDNLLDRKLHELMLHNAYKESGLSTMARARNTMKELYCVPSNLRALIIACGLQGIQQFCGFNSLMYFSATIFEVVGFDNATAVSIIVAGTNFVFTIVAFMVIDRIGRRRILLGTIWGMSLGLVVNAIAFHFLDKQKEKNPNHELDKEHISGWAYVVLVAQLVYVAFYATGIGNVPWQQSELFPISVRGVGTGMATATNWAGSLIVSSTFLTMLENITPTGTFSFYAGLCALGEVFVFFLYPETSGMDLEQIQQLLTGGFNIKESMRLSDEAKRGYKK

SEQ ID NO: 17305 - protein, 181 aa, Helicobacter hepaticus ATCC 51449
MKHLPNFLSISRIFLAVLLLFVALHYDAVFPDYIDKSWVNYLTCFIFCIASITDFFDGYIAREYCVHSRFGEVFDPLADKMLILSAFIALLILDRASPWAVFLILSREFFITGLRVMVAGSGASVAASRSGKYKTGAQITAIAFLLADFFPGGEILLWIAVALTLYSGADYTLKYVKSLSV

SEQ ID NO: 17306 - protein, 119 aa, Triticum aestivum
MAGGKEPIEVKFRLFDGTDIGPSKYDPATTVSALKDFILARWPQDKEITPKTVNDLKLINGGKILENNRTLAESRVTIGEVPGGVITMHVVVRPPQVDKNREKQLGNSPKQNRCGCTIL

SEQ ID NO: 17307 - protein, 261 aa, Chlamydomonas reinhardtii
MVEATESAEDTIPIVPLLGVTKPAESLTSPIDRRSDFYRHAALVVPHKPARQPLMTIPNVLTFFRLLLVPVLLLVWELQWHYTPTLCAVIFIAASVTDYFDGYLARKLKIATVFGAFLDPVADKIMVATALVLLAVSPPPPWSPQWLTAPVVLIICREITMSALREWAAAAGGGVSKAVKVNTLGKWKTALQMVSMSVLLVVRQPLGDLLPSYAGSPLWLHISLASYVALWGGTVLGLWSLAIYFSNVWVHFVYPEAKKHH

SEQ ID NO: 17308 - protein, 436 aa, Idiomarina baltica OS145
MAEHDHEHGHQDYQKSSLSLWGAVSLGTGVMIGAGIFALTGQVAQLAREWFVLAFVCGGIIAGFSAYSYVKLAKAYPSAGGIAMFLSKAYGKGSVTAIFALLMYFSMVINESLVARTFASYTSQLISFEAQWLVPLLAVGLLVFAFFINILSNQFIQTFSFFMAFVKALGLVILAAGGLWASGIQFESISAIPEEATGGGILAGIALSILAYKGFTTITNSGGEIVEPKKNVGRAIIISLIICALIYVLVTLAVGSSLSIDEIVKAKDYALAEAARPVYGETGLWVTVAFAIVATVSGVIASAFAVSRMLAMLTNMKLVPHSHFGMPGSIQKHTLVYTIVMAMVLAAFFDLSRIASLGAIFYIVMDIAIHWGVLRHLRQKVNANIYILVSAITLDVIVLAAFIWVKWTSDPQVIWASLIGMALIAAGEILFLRKKR

SEQ ID NO: 17309 - protein, 225 aa, Candida glabrata CBS 138
MDKRILLLIGGGHDTGVKSMSNELKTKFDSLFPESNIKVIDIDYEQEYMISPARIKRSYSNEDYDFDVLYNTLTHQSEHKAEGEVDIIIVCGCYALYNQKINELANLRVFVESDGDVRLINKIRSENIDNSEQLATTLQEYLQNLRPEMENYIEPTRVHAHLIIPYANKDSGVAIIVDGMVKIVNEVSNSRSPDRQNSKEIARNQLYDFLGESMDNERSRYYDLA

SEQ ID NO: 17310 - protein, 348 aa, Pyrococcus furiosus DSM 3638
MSEKMVAIMKTKPEYGAELVEVDVPKPGPGEVLIKILATSICGTDLHIYEWNEWAQTRIRPPQIMGHEVAGEVVEVGPGVEGIEVGDYVSVETHIVCGKCYACKRGQYHVCQNTKIFGVDTDGVFAEYAVVPAQNVWKNPKNIPPEYATLQEPLGNAVDTVLAGPIAGKSVLITGAGPLGLLGIAVAKASGAYPVIVSEPSEFRRNLAKKVGADYVINPFEEDVVKEVMDITDGNGVDVFLEFSGAPKALEQGLQAVTPAGRVSLLGLFPGKVSIDFNNLIIFKALTVYGITGRHLWETWYTVSRLLQSGKLNIDPIITHKYKGFDKYEEAFELMRAGKTGKVVFMLK

SEQ ID NO: 17311 - protein, 288 aa, Zea mays
MAKDIEASGPEAGEFSAKDYTDPPPAPLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGLQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 17312 - protein, 445 aa, Salinibacter ruber DSM 13855
MTTPDRTPVKVGLLTAASLVVANMVGTGIFTSVGFQVEYLDSPFALLMLWAVGGVISLCGALTYGELGAALPRSGGEYHLISELYHPSLGFIAGWISATLGFAGPTALAAIAFGDYTTAVFPSLSSTHLAAGIVLLCSAIHATSITWGSWFQNAFTALKVLLILVFVGAAVRADPTHSITVAPSGDGLNELLSPGFAVSLVFVSYAYAGWNAAIYIVGEIRDPQRNLPLSLVLGTALVTVLYVLLNFVFLYTVPAQEMAGEVEVGFLAGSVIFGDAGGEVMSLFIALLLISTVSALVYLGPRVTQAMGEDAPALRWLAVTNDRGIPVNSILFQLGLALLFIYTSTFDQVLVYAGFTLILSTMVTVAGVFVLRWRRPEIDRPYTTWGYPVTPLLFLAANAWILVYVFLDRPTESLIGLGIVAVGAALYFASQWGAPDEAPVSGPRP

SEQ ID NO: 17313 - protein, 240 aa, Prochlorococcus marinus str. MIT 9301
MTFTKYQFNNFCYWPSNPKKIVEFIGGSYLASKPDLTYKRFIDSLINKNYAVHAYKYTPQFDHQQLAIKAWRDFKNCRISLSKRIGTSIPSIRIGHSLGCKLHLISPDGGRNCEKFISISFNNFSANKSIPLLKQISRKLEFNSEFSPSPERTLRLIEKTYNQKNNFLIKFNSDELDQTDKLFSCLKARKEDNSKGVMLKGTHTIIASAGLRENFLGDWADDEFKRNTIKKISNLIDESD

SEQ ID NO: 17314 - protein, 437 aa, Clostridium botulinum
KVIVAKFGGSSLSHSALFRKVRSIIYDNENRRYIVPSAPGKRFKKDYKITDLLYLCHAHRESGISFDDVFKHIEERYLNLAKELRVKVDIKNKLEEIKREIEAGASRDFAASRGEYLNGLILADYLNYQFIDAAEIIHFKKYGSLDLRKTEKAIKEKIKNVKKAVIPGFYGALPDGTIKTFSRGGSDVTGAIVARAVEASLYENWTDVSGFLMADPNIINDPKPIEVISYKELRELSYMGAKVLHEESIFPVRDVKIPINIKNTNRAEDKGTLIVDDDKALNYTGSITGIAGKKGFTVIAIHKMLMNSELGFCRKLLSILEENGVAFENIPSGIDSVSLVIEDSQLGNKLDIILEEIKRQCNPDSLEVHVNMALIATVGNGMNRTKGISAKIFKGLLEEDVNIRMINQGSSEINIIVGVENDDFERAIRGIYNTFIK

SEQ ID NO: 17315 - protein, 491 aa, Shigella flexneri 2a str. 2457T
MAVTQTAQACDLVIFGAKGDLARRKLLPSLYQLEKVGQLNPDTRIIGVGRADWDKAAYTKVVREALETFMKETIDEGLWDTLSARLDFCNLDVNDTAAFNRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 17316 - protein, 448 aa, Coprinopsis cinerea okayama7#130
MFKHDPMSARYGGLSVGVPGEIRGLEEAHRLWGTLPWKDLIQPSVELAEGWKVDAELAKRIRWYPDLMLKNPDWSSIFAPRGVFLNEGETVKRTNLARTLSIIAEEGPDAFYKGEIADSIIEKIRQTGGIMTHSDLENYKVITRPALQGSYNRRRIYTTHAPTSGPVLLHMFNLIEGYDMSQFNGLNVHRLVEALKFGFAARTRICDPSYTNSSERIDQIPTKAYAHEIRKNLTDLYQDRTHPPNYYQPEYDIITDHGTSHTSVVDKSGMAVALTSTVNLIFGSQVLDPVTGILLNDEMDDFSTPGTPNGFGLWPSPYNYPEPGKRPLSSTAPTIIENEDGSFYLAIGGSGGSRIFGSLYQAVLNLDWGMDASEAVEFGRLHDQLFPDITDADSVYPEDILEDLRRRGHHITVVDVNRVAAVVQLVLQKDGVFYAASDSRKNGIAAGW

SEQ ID NO: 17317 - protein, 181 aa, Zea mays
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 17318 - protein, 480 aa, Shigella flexneri 2a str. 2457T
MSKRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPTDVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVPFDSANDGVAAASEAVNLLRDKGYLMSGDLVIVTQGDVMSTVGSTNTTRILTVE

SEQ ID NO: 17319 - protein, 464 aa, Oryza sativa Japonica Group
MAASPAAGAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 17320 - protein, 601 aa, Haemophilus somnus 129PT
MVAEGANPLVSVVTLLAAAVVAVPLFKRLGLGSVLGYLAAGLVIGPFGFGLFTDPEGIIHIAELGVVMFLFIIGLEMKPSHIWGLRNHIFLLGAFQITLCTSALTYIATLFGFDWKVAFVAASGFVLTSTAIVMQELSERNDLTSPRGQRIISILLFEDLLIVPLLAFVAFLSPDKVTSTDPLWHKIAISGGAFAVLVAAGLWLLNPLFKILAKTKTREVMTAAALLVVLGSALLMEEGGLSMAMGAFVAGVLLSESSFRHQLEADIEPFRGLLLGLFFLGVGMSLDLSVVAENWFLIIFGVLVFMLVKGFIIYLIALITKTGNANSIDRAFIMAQGGEFAFVLFSSAASQNVISKEMQANMTAIVVLSMILTPLFIIAQKKYIIPRLKPTQPERKADHIDEQHPTILIGLGRFGQVVNRMLVMTGHHPTIIDKDANLIAGMKKLGIKCYYGDAARPELLHAAGVENAELLIVAIDNSEQTLQIVEQARKMNPQIKIIARAHDRIHVYNLYGAGANIQIRETFDSALRTSKQALLSLGMNEDIVAEIGDVYFRKDCHSVKLMAEVYDPKLSRFENKELIQIALDVDQEMMAEIQQIMKKEH

SEQ ID NO: 17321 - protein, 517 aa, Bacteroides fragilis YCH46
MSNQLEKVKELIELRAQARLGGGEKAIEKQHAKGKYTARERIAQLLDEGSFEELDMFVQHRCTNFGQEKKHFLGDGVVTGYGTIEGRLVYVFAQDFTVFGGSLSETMAQKICKVMDMAMKMGAPVIGINDSGGARIQEGINALSGYAEIFQRNIMASGVIPQISGIFGPCAGGAVYSPALTDFTLMTEGTSYMFLTGPAVVKTVTGEDVSQEDLGGASVHASKSGVTHFTAETGEEGLAIIRKLLSFIPQNNLEEAPLVNCTDPIDRMDDLLNEIIPDSPNKPYDMYEVIGAIIDNGEFLEVQKDYAKNLIIGFARMNGQSVGVVANQPKYLAGVLDSNASRKGARFVRFCDAFNIPLVTLVDVPGFLPGTGQEYNGVILHGAKLLYAYGEATVPKVTVTLRKSYGGSHIVMSCKQLRGDMNYAWPTAEIAVMGGAGAVAVLYAKEAKDQENPAQFLADKEAEYTKLFANPYNAAKYGYIDDVIEPRNTRFRVIRALQQLQTKKLTNPAKKHGNIPL

SEQ ID NO: 17322 - protein, 162 aa, Haemophilus somnus 129PT
MIRIGHGFDVHAFGGEGPIIIGGVAIPYEKGLVAHSDGDVALHALTDALLGAMALGDIGKLFPDTDIQYKGADSRRLLRTAYQAILDKGYQVGNVDITIIAQAPKMRPYIDAMRTVIAQDLHCDIEQVNVKATTTEKLGFTGRSEGIACEAVALLIKQTGTK

SEQ ID NO: 17323 - protein, 222 aa, Helicobacter hepaticus ATCC 51449
MLALNLERILRRIERARLAYSPHQIISLVAVSKYQSTEQIRALYECGQRAFGENKVQDLRAKIESLDDLPLEWHFIGNLQENKINTLLSLNPTLLHSLDSIKLALALQKRLGEQKIRALLQVNAANEESKSGVSVESAKEIYEHICATCPNIKLEGIMSIGAHSDDRALIERSFRLTRDVFDSLKGSGAKILSMGMSGDFEIAIAYGANLVRIGSKLFEEAK

SEQ ID NO: 17324 - protein, 451 aa, Haloarcula marismortui ATCC 43049
MADKKVPGDGVVVGYGKVDGRRVYVFAHDFTVFGGSLGEAFAQKVCKVMDKAIETGAPIIGLNDSAGARIQEGIDSLAGYADIFHRNQQASGVVPQISAIMGPCAGGAVYSPSITDFVYMVEETSHMFITGPDVIETVTGEEVGFDELGGAKTHASESGVAHFTAADEKDAMDDIRYLLSYLPQNNVEDPPRVKPWDDPERRDEELKSAVPDAPQKPYDMTDVVGRIVDEDSFFEVAEDFARNIVIGFARMDGHSVGVVGNQPRVNAGTLDINASRKGARFVRFCDAFNIPILTFVDVPGFMPGKDQETNAIINHGAKLLYAYSEATVPLVTVITRKAYGGAYDVMASKHIGADMNYAWPTAEIAVMGPQGAVNVLYDDELEDADDVEARRQQLIDEYRDAFANPYTAAKRGFVDDVIEPQETRPRLIDDLDLLRGKRKDQPDRKHGNIPL

SEQ ID NO: 17325 - protein, 379 aa, Nicotiana sylvestris
MTIDCMITNVKSPMLRILEDEKRPLIFDASQMKREYNIPTQFIWPDDEKPRATARELPVPLIDLGGFLSGDPVAAQQASRLVGEACRNHGFFLVVNHGVNANLICNAHRFMDMFFDLPLSEKQKAQRKLGEHCGYASSFTGRFSSKLPWKETLSFRYSAQEDSSRIVKEYFQNTMGESFSHLGNVYQEYCNSMSILSLGIMELLGMSLGVGREHFKEFFEENESIMRLNYYPPCQKPDLTLGTGPHCDPTSLTILHQDCVGGLQVFVDNEWRSISPNFNAFVVNIGDTFMALSNGRYKSCLHRAVVNNKTPRKSLAFFLCPKKDKVVSPPTELVDSNNPRIYPNFTWPTLLEFTQKHYRADMNTLQSFSNWLQQTTAQV

SEQ ID NO: 17326 - protein, 351 aa, Microcystis aeruginosa PCC 7806
MQSSLKRIIIGASFFLATVVGATIGYMAYGWSFLDAVYMVIITIFGVGFGEVKPINTPSLRAFTMLVIICGTTSAVYVVGGFFQMLTEGEINKAFSDRRMNKEMECLENHVIICGFGRIGRILTTKLAKTAQSFIIVDNNPDRIRLAQEKGYITLNGNATDESILQKAGIDKARVLATVLPDDALNVFITLTARELSPQLYIIARGEYPSTEKKLKLAGADQVVLPATIGAERMAHLITHPAAIDFLQEDEGRRNLNELLADIDLQFEEYSILSNSPFLGQPISQMEVRGQGAFIIVAIRQFDGGVIAHPDNSTILQQGDTVILLGHRGDVPNFARRYALRREMRYRGSSW

SEQ ID NO: 17327 - protein, 402 aa, Xanthomonas oryzae pv. oryzae KACC10331
MLKDRANQVPSCSSSTWRSWHCCSGDREQVLRCSVPASGIIAGETSLRRSAGFDGWRSPLQVRKPNVMTQTITVIRGDGIGPEIMDATLFVLDALQAGLTYEYADAGLVALEKHGDLLPESTLASISKNKVALKSPLTTPVGEGFSSINVAMRRKFDLYANVRPAKSFPNTKSRFADGVDLITVRENTEGAYLSEGQTVSEDGETAFSGILITRKGSERIVRYAFDLARATGRKKVTAVHKANIIKSTSGLFLKVARDVAAQYPEIEFQEMIVDNTCMQLVMRPEQFDIIVTTNLFGDILSDLCAGLVGGLGLAPGANIGLDAAIFEAVHGSAPDIAGQGKANPCALLLGAAQMLDHIGQPQNAERLREAIVATLEAKDSLTPDLGGSGNTMGFAKAIASRL

SEQ ID NO: 17328 - protein, 596 aa, Ashbya gossypii ATCC 10895
MRVKKKNTTGNARNFVTRSQAVRKLQISLADFRRLCIFKGIYPREPRNKKKANKGSTAPTTFYYYKDIQYLQHEPVLAKFREHKTFAKKLTRALGRGEVSSAKKLEENKSHYKLDHIIKERYPSFADALRDLDDALNMLFLFANLPATDQVSTRVTKDAQELCNQWLALIARERLVRKVFVSIKGVYYQANVRGEEVRWLVPYKFPENIPSDVDFRIMLTFLEFYSTLLHFVLYKLYTDNGLVYPPKLDIKKNKLIGGISAYILESKDAPFLSSVDGSADSENQEVQVLDKKALRHAMKADDKAGSEADEGDADSNEQVTNIELDDFEDKNKNHGDILEQPSQYDSPTSTLFSEFVFYIGREVPVDILEFLIVSCGGSVISEAALDQADAANVDVSKVTHQLVDRPVVKNKVAGRTYIQPQWVFDSINKGELVPANLYLPGESLPPHLSPWGDSVGYDPAAELAEEEAESEEEEEVSDEAEGDEEATLAAEEDEEDEAEAEELRAQKELELEAQGVTYSEAADSAAPSKKASKQKKRKTEEEEEKDLKLIMMSNKQRKLFKKMKYSNQQKEQEIETLKQKKKQIAKTKAKLKKLEN

SEQ ID NO: 17329 - protein, 223 aa, Mesorhizobium sp. BNC1
MEASRPVKIAPSILASDFSRLGEEVTAVAAAGADWIHLDIMDGHFVPNITFGPPVVKAIRDRTNKVFDCHLMIAPADPYLAAFAEAGCDVLTVHAEAGPHLHRSLQTIRKLGKKAGVSLNPATPESAIEYVLDDVDLILIMTVNPGFGGQAFIPSAVKKIRRVRQMVGNRPIDIEVDGGITAENAGAVVAAGANVLVAGSSIFKGNGEDAYRQNIAAIRTAVE

SEQ ID NO: 17330 - protein, 398 aa, Helicobacter hepaticus ATCC 51449
MWQLCFLDNNKLMRDMNTLIYLDNAATSFPKPLCVIEAVKDYLCNVGASPARSAHSLSIESGRILYEARVGLAELLHQPNEERIIFGANATTMLNSALYGLLKKGDKVLTTTLEHNSVLRPLENLRLKYGITLEFIQSSQTCKLDLCDIESKLKGAKAFVCVYANNITGAVLPIEEIYKLCIKHKVIFILDASQAVGYLPLKATSADIICASCHKGLYAPSALGFMSLNPHFNEELLESFMQGGSGSLSEEITQPCILPDKYESGTPNMCAIAGLRAGLEWIKEQDIEQIHTHKMKLRQYLYDGLKSIQRAKIYEIESKWCVGNLAFNIEGMYPSKVGLRLDREFGILTRVGLHCSPLTHKSIGSFSCGGSIRLSAGVFNTTEEIEHTLEAIKIIART

SEQ ID NO: 17331 - protein, 117 aa, Zea mays
  misc_feature (20)..(20): Xaa can be any naturally occurring amino acid
  misc_feature (34)..(34): Xaa can be any naturally occurring amino acid
  misc_feature (61)..(61): Xaa can be any naturally occurring amino acid
  misc_feature (70)..(70): Xaa can be any naturally occurring amino acid
  misc_feature (91)..(91): Xaa can be any naturally occurring amino acid
YPRVRPGEDADALNNLMAQXYDELDENCTILESXYTDMQDMEILTGHSLWMLHSMTGKRYXKSAVNIRRXMIDEGLAEPPLTIKMAEPGHXDQLLHAYLENASPYIDQGIEQWPAHA

SEQ ID NO: 17332 - protein, 603 aa, Ralstonia metallidurans CH34
MRANLALTRWFPWLPRVTPLTLRADLVAGLLGAVLVLPQGVAFATLAGLPPQYGIYTAVIPCIVAALFGSSWHVMSGPTNANSLALFAMLSPVAFAGSPAYISLALAVTMLVGILQLAVGALRLGSLANFISPSVLLGFTCGAATLIGLHALKDLLGLAVPTGTSAFGVVRFLLDNLDTVSGSALIVGAVTLAVTLLVKRISRRAPFMLIGLLAGYGVALLLNSTGWGAARHVNVVGPIPSAIPPFHIPDINWRTVPDLLGIASALTIVALGQSISIAKAVALRSGQHIDANREFIGQGLSNIAGGFFSGYISCGSLNRSVPNFEAGAQTPLASVFSALLLVVLVMVSAPLLAQIPLAAISAMLLLVAWGLFDFQRLRRIARLSRTEFAIAVGTFVATLAIRLEMAVLLGTILSLVAYLYRTSRPAVRSLVPDADDPGRRFTPLDELRRPQPECPQLKLLRMEGAIYFGAVQYVTDRLHWLRTVNASQKHLLAMTKSMNFIDLAGAEMWEAELAERRAAGGNLYFHRPRTQVLETWEQTGFTAKLGDDHIFPTKRQALHTIIGSLSPDICAQCQARIFEECAQRPGAVPRSPQANASDAAASA

SEQ ID NO: 17333 - protein, 90 aa, Brassica napus
MAMRRIYSEIKGKKVKELPAYIKSTFSVETVKTSVRKSLDNYNDKYIQTSSVDPLLHICFGGMAFSYLVALPNERRHLEHQQHAKEHGGH

SEQ ID NO: 17334 - protein, 328 aa, Dehalococcoides sp. VS
MTACRLEAIGLGAVHVDHIYTVEQILHDGECVVTESALFPGGSGANTIHGLSRLGLKCGFIGAVGNDPDGNLLIKDFENAGIDNRYLMVKNEAQTGSVVSLSESSGRRSTYVNPGANNYLDLSDINLEYLSQAKLVHMSTFFNQNEFALCHEIAERLAPGVLFSFSPGALFAAQGLKRLAPILSRTNALFTNQQDIEKMTQKNYQRATDMCIRSGCEHVVVTLGESRRFQRKGKITLQTYIRDKDHECHMESTVSLRKDIRTVVDTIGAADAFTTGFLFGLMGDKPIEECGLLGDISARFCISKLGARSGLPDLAGLKERFGMHYFTN

SEQ ID NO: 17335 - protein, 343 aa, Zea mays
  misc_feature (60)..(60): Xaa can be any naturally occurring amino acid
LPASSYHQAKLARSFVRSFVPSSLASCCSVHGGGGGRGGGRGGCGAAARPTRGGGADGAXAKRRRVHPVPAGPPAGAAAPAAAPGRRSRRRRAVQRLFQACRHVFRGPGTVPSPGEVQLLRHMLDRMRPEDVGLSPDLSFFRARDATRGGGTPTITHTTIYKCPNFSMVILFLPRNAVIPLHNHPGMTVFSKLLLGSMHVKSYDWLNTADPDPSSATSTTSTSSSSSDGPCLRLAELVVDDVFTAPCDTSVLYPTAGGNMHRFTAMAPCAILDVLGPPYSIEEDRDCTYYAELPYANHSLVAAGDDVERGQGQGHLAWLEEIDMPRELKMCSVHYGGPPISDE

SEQ ID NO: 17336 - protein, 232 aa, Triticum aestivum
HLPQSKMLDLFQKDYIHAVTVGVGLMVLQQFGGVNAICFYASEIFVSAGFSSGNTGMLAMVAVQIPMTALGVLLLDKAGRRPLLMVSAAGTCLGCLLVGLSFLSKEHHWAKDLNVALALTGILIFSGSFSLGMGGIPWVIMSEIFPIHMKGSAGSLVTLVSWLGSWIVSYAFNFLLLWSSYGTFFMFASICGLTVVFVERLVPETKGRTLEEIQASMNSSLTPVSSGINRAA

SEQ ID NO: 17337 - protein, 376 aa, Sulfolobus solfataricus P2
MRLRDPREFRENVPVTRKYVYLNHASVSPTPLPSLFEAYRYLYEVANRGSIAVNEEEEDELYHIRSKISNLVGAYSDEISLIPNTSYGVNLVAHGLEWKGDDNIVTDNLEFPTVVYPFLKLTKKGVKINIVETNPYTFEEDIISHIDKNTRLVAISHVSFNTGLKVDVRKIVKAARENNTLVLLDIIQSAGAVKINVKELGIDFAIAGGYKWLMSPQGSGFIYVKRGLIEDPPFYGWKTSADYLDFNPNKFTLEKGPRRFEIGTVDLAANLSLAKSCEIIGENMELIESSVTNLSQFAIRLAKDHSMEVITPEDKRAGIVIVKVKKPKEIAKELLKENIVVSPRGEGIRISTHFYNTEEEVQKTIEKISELERKFN

SEQ ID NO: 17338 - protein, 171 aa, Triticum aestivum
  misc_feature (97)..(97): Xaa can be any naturally occurring amino acid
  misc_feature (109)..(109): Xaa can be any naturally occurring amino acid
  misc_feature (127)..(128): Xaa can be any naturally occurring amino acid
  misc_feature (144)..(146): Xaa can be any naturally occurring amino acid
  misc_feature (157)..(157): Xaa can be any naturally occurring amino acid
  misc_feature (161)..(165): Xaa can be any naturally occurring amino acid
  misc_feature (168)..(169): Xaa can be any naturally occurring amino acid
MAPAQCARVQRVFHFGKGKSEGNKAMKDLLGGKGANLAEMASIGLSVPPGFTVSTEACEQYQAAGRALPPGLWEETLEGLRWVEEYMGARLGDPARXLLLSVRSGAAVXMPGMMDTVLNLGLNDEVXXGLAAKSGDRFAYDSYXXXLDMFGNVVMDXPHAXXXXXLEXXKA

SEQ ID NO: 17339 - protein, 507 aa, Triticum aestivum
MEVESSAHGDAAASKFTLPVDSEHKAKSFRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAVIDDASGYIAVRFLIGFSLAAFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLHLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPITLVHFPQWGSMFFPASADATEEEYYASEWSEEEKGKGLHIAGQKFAENSRSERGRRNVILATSATPPNNTPQHV

SEQ ID NO: 17340 - protein, 525 aa, Salinibacter ruber DSM 13855
MTELTILLGLAAAGYGVSHWTQLPAIPFLLMGGLALNATGAVGDAGFVEDVLFLSVSILLFVAGTDLSLTRVGPFKKTAFVIGVAQFAGLAAAALGIAYGLDYALTDALYLGLALAASSTIVGVRLLQRRQQMFEPYGRTVLGALLLQDVIVVLLLPLLVRLPDGSAAVLGSLGGTIVLLVGVGVVMKGVVPLLLKRELDAETQLLAVLGVLFGFMGAAAWLDVPLFAAAFLAGVSLSGFPFSGIVHSEMQPLYDFFSALFFASLGVAAPQPAPVLFGHAALFAGAVLVLTPLIVAVVGAWAGLVAQSALESGLLLAQTSELSLVVGLQALVAGQIGGEVFSVIVLTTVFTMMLTPLLTSETVVWELVRWHPSRQSDVLSEVPSNHVLVVGGGRSARPLLRLLRESKYEAVVVDEDPTVVDRLRDQGVRCVRGDGSDRAVLLKAGGAQARIVVSLLRNPKAVESLLDYVGDTVPILVRVFEDHEAEWVEARGGTPIRFAHAASDAFMEWFRRAQSARSKQPPSGT

SEQ ID NO: 17341 - protein, 274 aa, Nostoc sp. PCC 7120
MNIAIIGCGYVGCAIAQHWQQNPHLLVTATTTTPERVTSLQKVAHKVVVTQGDDLDKLTDILQNQDIVLLSVGAKGGDLYEAAYLNTAKTLVSALQQNSHVKQLIYTSSYSVYGNKNGEWVDEETPTIPGSRNGEILQETEDILLSASSVNLRVCILRLGGIYGPRRELMKIFSRVPGTTRPGDGSDVTNWIHLDDIVGAIEFVRNNPLQGVYNLVDDAHLPSRKLLDTLLSKYNLPQVIWDNTAKSNRPYNVKVSNRKIKEAGYQLIQPYTVF

SEQ ID NO: 17342 - protein, 154 aa, Vitis vinifera
MGKGKGKGKGKAQTKQRQSRGSDGIGFGGKRNDPTWQCIQGCGACCKLDKGPSFATPEEIFDDPSDVKLYRSMVGPDGWCIHYEKSTRTCSIYSDRPYFCRVEPNVFQTLYGIGKKRFNKEACSFCEDTIKAIYGSHSQELDNFVHAVRSTDSS

SEQ ID NO: 17343 - protein, 377 aa, Nicotiana sylvestris
MTVDCMITRNKFTMQRTSKEPLIFDASVMKNESNIPSQFIWPDNEKPCANARELHVPHIDLGGVLSGDPFATKQAATLVNEACQKHGFFLVINHGIDTNLISNAHRYMDLFFELPLNEKQKAQRKIGEHCGYASSFTGRFSSKLPWKETLSFQYSAEEGSSHIVEDYFQRTMGENFCHLGKVYQDYSIAMSTLSLGIMELLGLSLGVSRNHFKEFFQENESIMRLNYYPPCQKPELTFGTGPHCDPTSFTILHQDSVGGLQVFVDNEWRSITPNFNAFVVNIGDTFMALSNGRYKSGLHRAVVNTKIPRKSLAFFLCPKKDKVVSPPIELVDSNNPRIYPEFTWPALLEFTQKQYRVDMNTLQTFSNWVQQTTTQAL

SEQ ID NO: 17344 - protein, 302 aa, Mesorhizobium sp. BNC1
MARNFIDLSAVSAADLRSILDDAKERKALLKSGKAGKPFEGKVLAMIFDKPSTRTRVSFDVAMRQLGGDTIMLTGMEMQLGRSETIADTAKVLSRYVDAIMIRTTAHERLLELAENATVPVINGLTDDTHPCQIMADIMTFEEHRGDVKDRLFAWSGDGNNVLHSLLEASARFGFRLNIATPVGSEPSAHYVEWAKTNGGRVTLTSDPEAAVRGADCVVTDTWISMGQEHRARGHNVFQPYQVNERLMSFAKKEALFMHCLPAHRGEEVTDGVIDGPHSVVFDEAENRLHAQKAVLAWCLGQ

SEQ ID NO: 17345 - protein, 401 aa, Mesorhizobium sp. BNC1
MSGSALFDTFARLPLSFERGEGSWLITADGTRYLDFAAGIAVNSLGHAHPHLVAALTEQAGKLWHVSNLYEIPGQRRLGERLAEHSFADKVFFTNSGAEALECAIKTARRYHYVNGQENRFRIITFEGAFHGRTLATIAAGGQKKYLEGFGPKVEGFDQLPFGDLRAVENAITPETAAILIEPIQGEGGIRMPPAQFIQGLRELCDKHGLLLIFDEVQTGIGRTGKLFAYEWTGVAPDIAAIAKGIGGGFPMGACLATEEAAKGMTPGVHGTTFGGNPLAMAVGNAVLDVVLEPGFLDEVSRRGLLLKQGLAAIADTFPDIVDEIRGTGLLLGIRCKSPTSALQQALREEGILVAPAGENVLRLLPPLNVTDEDIQEGLERIHRAMESLVSASSIATATKV

SEQ ID NO: 17346 - protein, 555 aa, Ashbya gossypii ATCC 10895
MSSVNKENYRGVPSGRGMKNPVLAGAKRAVLNNVTNTTLSQEAANSNAHSGSGYTNSFGKVLRQAKSKLQSARVAGSLIPQMKREGLASSQEDKENVVPTGVAPAAVAAAAAAAQMAPAIAKPILQSISEESHQECQSLLKDGGSDEGASTVSTKSSDTELAPSSSSSLQSAPANSEEPVVLESGTQLVERRRPQTLNTTLTGSVASSSDCTTSTGQLTESTAGELTTTQNQLRPSVAVAESKKKRPISTIVEPEELKKFKISDQGNQCEWEDLDAEDINDPFMVSEYVNDIFEYLHKLEVMTLPNRHDLFKHANIQQNRDILVNWMVKIHNKFGLLPETLYLALNIMDRFLGKELVQLEKLQLVGTACLFIASKYEEVYSPSVKHFAYETDGACDEEEIKEGEKFILKTLQFNLNYPNPMNFLRRISKADDYDIQSRTLAKYLLEISVVDFKFIGILPSLCAAASMFLSRKMLGKGKWDGNLIHYSGGYSTTELAPICNMLMDYLVQPVVHDELFKKYASRRFMKASVISRQWAKKVMTRSYDIMTLHETQTEY

SEQ ID NO: 17347 - protein, 416 aa, Burkholderia xenovorans LB400
MALIVHKYGGTSMGSVERIKNVARRVAKWHKAGHKMVVVPSAMSGETNRLLGLAKEITAQPSPRELDMIAATGEQVSSGLLAIALQEAGVDAVSYAGWQVPVKTDSAFTKARISEIDGERVLRDLDAGKVVVITGFQGIDPDGNITTLGRGGSDTSAVAVAAALKADECLIYTDVDGVYTTDPRVVEEARRLDRVTFEEMLEMASLGSKVLQIRSVEFAGKYQVKTRVLSSLTDPLIPLDAEMKSGTLITFEEDETMEKAVISGIAFQRDEARIAVMGVPDKPGIAYQILGPVADANIDVDMIIQNQSVDGKTAFTFTVGRGDYQRAMDILTGQVKGHVQAEQVLGDPKVSKVSVVGVGMRSHVGIASTMFRTLSEEGINIQMISTSEIKISVLIDEKYMELAVRALHKAFELDQA

SEQ ID NO: 17348 - protein, 404 aa, Ashbya gossypii ATCC 10895
MSPVGETRRVSDENEAAGARRRGELAKKRGNTVLGVPRKALGAVGVNTRKQERDGAATGSGAGGARGAGTKRMVYHDSEGEETQEPEEKRVSKKAKAERQCPSPAAQTESPEAARGALVREPHPHRDLDALEADDLTMCVDYTNEIFAHLLQREQETTCVVNYVQERQCAFYIRPSMRAILVDWLIEVHLKFQLLPEALYLAINIMDRYLSTNKVSLSKLQLVAITSLLIAAKFEEVNLPKLSNYVYITDNAYTVEEVKQSECNILNALEFNIGWPNPMNFLRRISKADNYNHNTRNYAKVFLEYAMCCPKFVAITPSVLAAMSMRCAMMLNYGAEGFEWDDTMEWYSSMATTSAKFDFQKLCDDLIKDIQEPSTQLNALIYKYKKLGLWVAVKTWCDEQKIVR

SEQ ID NO: 17349 - protein, 375 aa, Sinorhizobium meliloti 1021
MDVRAAVALEAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 17350 - protein, 351 aa, Bacillus clausii KSM-K16
MKIVNIASIPGDGVGREVVPEAERVLKAIAELHGGLTFEFTSFPWSCEYYLENGSMMPEDGLEQIKDFDSIFLGAVGNQRLVPDHISLWGLLIKIRREFEQVINVRPAKLIKGINSPLSNPKDFDLLVVRENSEGEYSSIGGRIYNEDEELAIQNAVFSRRGTERAMRYAFELAKTRRGHVTSATKSNGIVYSMPFWDDVFKEISKDYPSVEVDSQHIDALAAFFVTQPERFDVIVASNLFGDILTDIGAAIMGSIGIAPAANININGKYPSMFEPVHGSAPDIIGKGIANPIGQIWTAKMMLDHHGETELGDHLLDSIEEVTSRGIRTPDIGGTSSTTEVTSEIIKTLLR

SEQ ID NO: 17351 - protein, 554 aa, Ralstonia metallidurans CH34
MSQAIEIKVPDIGDYDAVPVIEVHVKPGDTINAEDALVTLESDKATMDVPSPQAGTVKEVRIKVGDSVSEGSVLVMLEPAGAAAAAPAPAAAAAPAAPAPAAAAPAPAAPAAPAPAAAPAGGGTVEVKVPDIGDYDAVPVIEIHVKVGDQINAEDALVTLESDKATMDVPSPQAGTVKEIKVKVGDNVAQGTLILILEAAGGAAAAAPAPAAAPAPAAAAPAPAPAAAAPAPVAAPAVAPAVQGTTGKAAHASPTVRKFARELGVDVSRVPGTAPKGRITQEDVQNYVKSVMSGQTATPSAPAAAAGTGVGLDLLPWPKVDFTRFGEVESKPLSRIKKISGANLHRNWVMIPHVTNCDEADITELEAFRVQLNKENEKAGIKVTMLAFMIKATVAALKKFPNFNASLDGDNLVLKKYFNIGFAADTPNGLVVPVIKDADKKGVLEISQEMSDLAKLARDGKLKPDQMQGGCFSISSLGGLGGTYFTPIINAPEVAIMGVCKSYMKPVWDGKQFAPRLTLPLSLSWDHRVIDGAEAARFNTYFAALLADFRRILL

SEQ ID NO: 17352 - protein, 592 aa, Ralstonia metallidurans CH34
MSVIEVKVPDIGDFDAVEVIEVLVKAGDTVEEEQSLIVLESDKASMEVPSSAAGKVVDVKVKVGDKVAKGTLICTVEGGAAAAPAPAPAAAPKPAAAPAPAPAAAPAAATHAGGADIQCEMLVLGAGPGGYSAAFRSADLGMNTVLVERYGTLGGVCLNVGCIPSKALLHNAAVIDEAKALAAHGILFGEAKIDLDGLRHYKESVVGKLTGGLSGMAKARKVQVVRGIGTFLDPHHLEVQETEGDSKATNGKKTVIRFEKAIIAAGSQAVKLPFVPEDPRIFDSTGALELRDIPNKMLVIGGGIIGLEMATVYSTLGARLDVVEMLDGLMQGADRDLVKVWDKVNKHRFDNVMLKTKTVGVEAKPDGIYVKFEGESAPAEPQRYDAVLVSVGRSPNGKKIGAEKAGVAVTDRGFIDVDKQMRTNVPHIYAIGDIVGQPMLAHKAVHEAHVAAEAAHGEKAYFDAKQIPSVAFTDPEVAWAGKTEDQCKAEGIKYSKGVFPWAASGRAIANGRDEGFTKLIFDEETHRIIGGGIVGTHAGDLISEVCLAIEMGADAVDIGKTIHPHPTLGESIGMAAEIYEGVCTDVPPPRKR

SEQ ID NO: 17353 - protein, 424 aa, Dehalococcoides sp. VS
METEIYFKFILSFGLILLVARLGGAIAERFLKQPAVIGELLAGIIISPFLVGQFLFANDPIIMNFALIDGVFSQNGEHLSEFAPMEIISQIAVVVLLFVAGLETNVASFIKNSFTGAMVAIGGVIVPFALGVFSAMYFFPDLHMAGWLFIGAILTATSIGITVRILMDMGKLSSREGTIILVAAVVDDIIGLVILSVVISMAQSGSINALSAIGTGVIGFAVWLGILLLGVYGHKYISKYILTPFKASGTMPVMALIVGLLVSYLVTLVGLHPVVGAYVAGLMFASTMEKEEILHQTRPIMLFIAPFFFAYLGMQVDLKEVWAVIVPALVIVVLAIVGKIVGCYFPARFVGKTSHNGALIVGVGMVPRGEVGLIVAGAGLIAGAITRDLFGIAVAVSILTTLVMPLMINPLFKPKAEANGKRLS

SEQ ID NO: 17354 - protein, 176 aa, Enterococcus faecium
PPVAFSEKEIRTEKIKALKAIRIYNEEEVLENFVRGQYAQGELDGVQFKGYREEDKVDAQSETETFVAGKFTIDNFRWSGVPFYVRTGKRLTEKGTRINIVFKQVPVNVFKTSVDEPCDDTTLPPNVLTIYIQPTEGFSLSLNGKEVGQGFETEPIKLEFRNSAEMVENSPEAYEK

SEQ ID NO: 17355 - protein, 283 aa, Raphanus sativus
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 17356 - protein, 128 aa, Triticum aestivum
MSQETVNPKAYPLADSQLTITILDLVQQAANYKQLKKGANEATKTLNRGISEFVVMAADTEPLEILLHLPLLAEDKNVPYVFVPSKQALGRACGVTWPVIACSVTSNEGSQLKQPIQSLKDAIEKLLI

SEQ ID NO: 17357 - protein, 458 aa, Caulobacter crescentus CB15
MDADVRSAPLIPPAPKVHPRQLGGSFVGELRIALEMSRNLMGAWCEEDFDNLFTPYVFMGQPGMVVSDPAAARRILSSPNYVRPVKAARSVRPIAGDGLLLSEGETWRRQRKSLAPVFTPMAVEGLLPHFVAAGASLAEALSGHARADLSEAFHHATLDAVLSALFSRRADAQGDQLAYMVRRYMEGPAHFNLMDFVSRGADDLTFLDVERRRQGAAWFQAVEHLIAQRQAHPHAEARDLLDRLLAARDEDGAPLSNQEIRDQCGTMLVAGFETTSRLLFWATYLLALDPATQDRLRAEVLAAPAAAVRTLDDLQAWPLMRSVLFETLRLYPTAPLLAREAIGPDTVMGHAVVPGQIITISPWLIHRHRKLWDAPTAFVPDRFIDQPHPWGIEAFLPFGAGPRVCIGASFALAEAQIVLASLLERFEIGLVSDRPVIPIASITLGPDHAPAFTLTPVS

SEQ ID NO: 17358 - protein, 283 aa, Raphanus sativus
MAKDVEGAEGVTARDYEDPPPTPFFDAEELTKWSLYRAVIAEFVATLLFLYITVLTVIGYKISSDTKAGGDECGGVGILGIAWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 17359 - protein, 1209 aa, Oryza sativa
MSKVIATTLLLSVISHGAYPAMGSAWEEEDFARNCPPSWCSDSGPEIRFPHQLESSNSSSSSSCSASCARLACSGPDTILHHPFLGPCKVTAIDYKKAVFQIIPLVDSLSSYPLQKLIIDNLPEPDYHSSRCSLYNAQPGKIVCCSKVLTPSMSPTNDYDGNIADHAVVGPISCLSDPSHFSYLVDAYEDIYSLPLDCKAVSKGIVPISGAVTADGPTFKQLAERILNFAETTVSWSEGGIPDNCSRVKVIAEVHLKVEMFLRTYGTSKPTRYTFSEVKKIARCFKEKVGQGGFGTVYKGKLPNGVPVAVKMLENPTGDGEEFINEVATIGTIHHTNIVRLLGFCSEGTRRALVYELMPNESLEKYIFLRDPNTQELLSPDKMLDIALGIARGMEYLHQGCNQRILHFDIKPHNILLDYNFSPKISDFGLAKLCPRDQSIITLTKARGTMGYIAPELYSRNFGEISYKSDVYSFGMVVLEMVSGRRSWDPSIENQNEVYFPEWIYEKVITEQDFILSREMTEEEKQMVRQLALVALWCIQWNPRNRPSMTKAVNMITGRLQNIQSQGSHAQWRWEPGSRVDFGAGTGGAAAVCWSAAAARRSPPVRDQQHQLGDRHRPALHQDCTIVTCNFWADSTNYAAGATLNITNRCSFTVWPAAVPVGGGMRLDPGESWALDVPANSGAGRVWARTGCSFDANGNGSCQTGDCGGVLKCKNSGKPPQTLAEFTVDQTSVQDFFDISLTDGFNVPMDFLPVPAPEQRHGAPPCSKGPRCPANITSQCPSELKAPGGCNSACNVFKQDKYCCTGTTGTKTCEPTTFSLPFVRMCPDAYSYSLDDSSSTTFTCPSGTNYQIIFCPPTDLTSSSPVPPPAPIAIGPSGLDSSSKRGGRLVATIVVSVIGSTSVLTIIIASIIIIKRRIRRHQEMQEEEQEFEELPLQGMPRRFTFQQLQEATDQFRDKLGQGGFGSVFLGQIGGERVAVKRLDQSGQGMREFMAEVQTIGSIHHINLVRLIGFCAEKSQRLLVYEHMPKGSLDRWLYHQQGSPAPALDWWTRYKIITQVAKGLSYLHEECMMRIAHLDVKPQNILLDDNFNAKLSDFGLCKLIDRDKSQVITRMRGTPGYLAPEWLTSQITEKADVYSFGIVVMEMISGRKNLDTSRPQMSEVVKVLEGTTSIETDIDHDFVATNPVSFGVAGIVDSDPPVASNLSGPR

SEQ ID NO: 17360 - protein, 108 aa, Aspergillus fumigatus
MSHGKVIAVDNPIIYKALTSSGPVVVDFFATWCGPCRAVAPKVGELSEKYSNVRFIQVDVDKVRSVAHEMNIRAMPTFVLYKDGQPLEKRVVGGNVRELEEMIKSISA

SEQ ID NO: 17361 - protein, 711 aa, Salinibacter ruber DSM 13855
MASGSSDLQKTLTLYDVYSISTGAMFSSGFFLLPGIAAAETGPSVILAYLVAGLLILPSMYSMAELSTAMPKAGGTYYFLDRALGPLAGTVGGLGTWLALVFKSAFALIGMGAYLAIYADVPIKPLAAALTLAFGVLNVVGAKESSLLQRVLVTILVGVLGFYAAQGVLSVWGGQSAVGGAAGEFTPFFTEGARGFLATIGIVFVSYAGLTKVASVAEEVKNPDRNIPLGMGLSLLTATGIYVVGVAIMVAILPATDLHADLTPVYTSGEVFFNWLPYTLGPILIVVAAVAAFASTGNAGIMSASRYPLAMARDRLLPDGFARIGRFNTPTRSIVVTVALMLVIIFVLSEEGVAKLASAFQLLIFALLNFAVIVMRESEIPSYAPGYRSPLYPWVQVAGIAIPFFLISEMGTLAIVFTGVVVLVGVGWYFYYASDVPREGAIFHLFARLGKQRYDGLDRELQTILEEKGVGHDTAFDRLVAESDVIHLDEPVPYADVVEDVSGRLAEELGLSTETLEHGFLEGAPYSAVSVSHGAALPYCRLDGISESKMVMVHCQSGICVDLEDEIEELDRSEPVYAFFFLVSPKDDEGEHLRTLATLANRTDEEQFLVEWRAAADEQEVKESLLHHERYLTLNLLSGTNTDEFIGQTVTDLNLPAGVLVALVRRDGQITVPSGATRLEEGDRVTIIGNPAGIDRLYELYRAGEQEGVVQ

SEQ ID NO: 17362 - protein, 92 aa, Triticum aestivum
MAGQARAFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 17363 - protein, 524 aa, Salinibacter ruber DSM 13855
MDRTQGIEALQSRQTPWDFVIIGGGATGLGCAVDAAARGYDTLLLEMHDFAKATSSRSTKLVHGGVRYLEQGNVSLVFEALKERERLQDNAPHLVSNLPFVVPSYKWWEAPYYGIGMKVYDLLAGSQNFGRSQYLDRNQTIERLPTVETDGLRGGILYFDGQFDDTRLAVNMAQTADEQGGVLLNYMKATDLKKTNGAVDGVVAECQETGATFDIEARSVINATGIFTDTIRQMDDPSAGTTLRPSRGTHIVLDKSFLPGDSAIMVPKTDDGRVLFAIPWHDRVVVGTTEAEVDEVSMEPTPGHEELDFLLTHAQRYLAKDPGPEDVRSVYAGIRPLVAPPGSNGDTSDISREHQLNVSDSGLVTISGGKWTTYRKMAEDTIDRAARHAELARRPSQTDDLRLHGWHQNPEQFGDLALYGADAEALGGLMEEHPHLQTPLDERLPIRAGQVVWAARHEMARTVEDVLARRTRCLLLDAQASIDVAPRVAELMAEERDLPPSWVDDQVEAFTEVARNYLMPSIPA

SEQ ID NO: 17364 - protein, 455 aa, Salinibacter ruber DSM 13855
MEIPSVERLTSARIPTVDGEFSLSLYENSKDDKDHLALACGDVADGEDVLVRVHSECFTGDVLGSLRCDCGEQLDASMRRIAKNGRGILLYLRQEGRGIGLLSKLRAYNLQDDGYDTVEANRILGHGADERDYAIAARILDDLGVSSARLLTNNPQKIESLAEHGVEITERISLEPHVNRHNAEYLRTKVNRMRHILDLGPANGHAQGNAHGTSLRDLKQRIDRYFAEKGRPFVTLTYAQSLDGSIASTSGTPLPISSEQALRFTHQLRALHDGILVGIGTVLADDPRLTVRHNDGTHPVPIVLDSSLRFPSDAQLLAGDGPDPLIVTSPNADPDRKERLEAHGGTVIELSCGPEGGICVKTLLRTLGERDFSSVMVEGGTSILTSFLRRQCAQRVIVTVAPMFVGGTAALSSLAPEDQDTHARSDFPRLDNIQQRWYGEDLVLEGDPVWPVASE

SEQ ID NO: 17365 - protein, 222 aa, Nostoc sp. PCC 7120
MISSINERITQIRASLPPSVRLIAVTKQMPTEVIRAAYAAGIRDFGENRIQEAASKKAQLHDLPDITWHFIGHLQANKAKKALEQFQWIHSVDNLKLAQRLDQLAQQLGVNPQVCLQVKILPDPNKSGWTVPELLTDLPALNHCKTLQIQGLMTIPPFGLNDAEIFYVFNTTYKLAKDIAEQNWDHIHMGQLSMGMSGDYQLAVQAGATMVRLGTILFGQRT

SEQ ID NO: 17366 - protein, 493 aa, Pseudomonas fluorescens PfO-1
MTLARFQMCIGGEWVDALSGKTFESLNPALAEPWAELPDADEADVERAVQAAQTAFDSPAWRGLTATARGKLLRRLGDLIAENKEQLAQLESRDNGKLIRETRGQVGYLPEFFHYTAGLADKLEGGTLPLDKPDLFAYTVHEAMGVVAAIIPWNSPLYLTAIKLAPALAAGNTIVIKPSEHASATILELARLALEAGIPPGVVNVVTGYGPSTGAALTRHPLVRKIAFTGGAATARHVVRSSAENFAKLSLELGGKSPNIIFADADLDSAINGAIAGIYAASGQSCVSGSRLLVQDDIYDEFVSRLVERAQRIRIGNPQDDSSEMGPMATAQQLAVVEGLVADAIAEGARLRLGGKRPSGVGDGWFYEPTLFECDRNSMKIMQEEVFGPVASVIRFKDEAEALAIANDSQFGLAAGIWTRDLGRAHRLARDVRSGIIWVNTYRAVSAMAPIGGFKNSGYGRESGIDSVLAYTELKTVWINLSQAPMPDPFVMR

SEQ ID NO: 17367 - protein, 210 aa, Brassica napus
MPGPVVEEVKIEEAIKEQMKLEKEDDVVVEDVKDEDDDVDDDDNDDDNVDGAGDNESSKQSRSEKKSRKAMLKLGMKPVTDVSRVTIKRSKNVLFVISKPDVFKSPNSETYVIFGEAKIDDMSSQLQAQAAQRFKMPDVASMIPNSDASEAAAVAQEEDEDDDDDVDETGVEAKDVELVMTQAGVSKAKATKALKANDGDIVSAIMELTT

SEQ ID NO: 17368 - protein, 270 aa, Nostoc sp. PCC 7120
MTIKFGLIGGGVMGEALLSRLIARGIYQPSEVIVSEPQTARQAFLQQKYHVGVTTDNSLVFTQAQDVVFLAVKPQVFSAIAQELADTVFTDHSPLVVSILAGVSLSQLEAAFPQSPVIRAMPNTPATVGSGMTAICSGAYTYAQHQKLAQQIFSAVGEVVEVSESLMDAVTGLSGSGPAYVALLVEALADGGVASGLPRGIANQLALQTVLGTAQLLHESKLHPAELKDRVTSPGGTTIAGIAQLEKAGFRSALIEAVKAATWRSQELGK

SEQ ID NO: 17369 - protein, 175 aa, Haemophilus somnus 129PT
MGLENVPAGKALPDDIYVVIEIPANSDPIKYEVDKESGALFVDRFMATAMFYPANYGYVNNTLSSDGDPVDVLVPTPYPLQPGSVIRCRPVGVLKMTDEAGGDAKVVAVPHTKLSKEYDHIKDVDDLPALLKAQIQHFFESYKALEAGKWVKVDGWEGVESARQEILESFERAKK

SEQ ID NO: 17370 - protein, 212 aa, Pseudomonas putida GB-1
MSLKLGDIAPDFEQDSSEGKIRFHEWLGNSWGVLFSHPADFTPVCTTELGLTAKLKDDFAKRGVKAIALSVDPVDSHHRWIEDINETQNTVVNFPIIADADRKVSDLYDLIHPNASDTLTVRSLFVIDPNKKVRLTITYPASTGRNFNEILRVIDSLQLTDNHKVATPGNWQDGDEVVIVPSLKDEEEIKQRFPKGYRAVKPYLRLTPQPNR

SEQ ID NO: 17371 - protein, 438 aa, Bacteroides fragilis YCH46
MKVKPDLSFWKLWNISFGFFGVQIAYALQSANISRIFATLGADPHSLSYFWILPPLAGIIVQPIIGAASDKTWTRFGRRIPYLFAGSLLAVWVMCLLPNAGSFGMAVGTAMIFGLVALMFLDTSINMAMQPFKMLVGDMVNEKQKGLAYSIQSFLCNAGSLMGYLFPFIFTFIGISNTADKGTVPDSVIYSFYIGAAILILCVIYTTVKVKEMPPKEFEEFHGITADEKKEKADFISLLKHAPKVFWTVGLVQFFCWAAFMYMWTYTNGAIAATVWGTTDVQSAGYQEAGNWVGVLFAVQAIGSVIWAVILPLFKARKQAYAFSLVLGGIGFISTLFFHNEYLLFISYLLIGCAWAAMLAMPFTILTNSVSGKNMGAYLGLFNGTICVPQIAAALVGGGLLHLVGGHQVNMLVLAGVLLIAGAVCVYFIKETMAHHEA

SEQ ID NO: 17372 - protein, 281 aa, Burkholderia xenovorans LB400
MFTRLREDIATIRERDPAARSAWEVLTCYPGLHALVLHRFAHACWQARRRWLARFVSQLARFMTGIEIHPGATLGRRVFIDHGMGVVIGETAQVGDDCTIYQGVTLGGTSLTRGAKRHPTLERGVIVGAGAKVLGGFTIGAEAKIGSNAVVTKPVPARGTAVGNPARIIVPAAAAVASEGASVVANSDSGGAARGAKRSAGSSRFCAYGITPNADDPVSLAIHGLIDHAATQAKRIDEIVDALERLGTSLEALQGADAALLDLRRLSAAIAGKVDGVVAER

SEQ ID NO: 17373 - protein, 740 aa, Mesorhizobium sp. BNC1
MAGYKNFTVEVDSEGIALVTWNMPDRSMNVFTEEVMGELDKIIDQVAGDAGIKGAVFTSGKETFSGGADLSMLQNMLGRYHKEKAKSPEKATRELFDRAGSMSKLWRKLEVSGKPWVSAINGTCMGGAFELSLACHGRVAVDDDSVKLALPEVKVGIFPGAGGTQRVPRLTNTQEALQMLTSGQNLSPQKAKAMGLVHEIVPRKKLVDAAKRMIKDGLKPVQPWDEKGFKLPGGPVYSAAGANLWPPAIAILRRETYGNYPGATAILKCVYEGLLVPFDTALRIEQRYFTEIMQSKEAAAMIRSLFISMQELNKGARRPKDVPAKKIRKVGVLGAGFMGAGIAYVTAKAGIPVVLIDRDQESADKGKAHSAGLMDGLIKKGRATAEEKEKLLSLITATPDYSALEGADLVIEAVFEDSAVKKEATEKAEAALKSSAIFASNTSTIPITSLAKNSKRPKNFIGLHFFSPVDRMMLVEIILGKKTGDKALALAMDYVRAIRKTPIVVNDTRGFYVNRCVLRYMQEAYSMLIEGVPAPMIENAAKMAGMPVGPLALTDETAIDLAQKIMKQTIRDLGEKAVDPRHMELIDMMVDKHGRHGRKNGKGFYEYPAKPAKKFLWPGLKDFYRQQDPDEIDVEELKARFLYVIALEAARVMEEGIVTDPREADVGSILAFGFAPFTGGVLSLIDGIGAAEFVKRAERLQKKYGKQFKPPRLLLEMAEKGETFYDRFAPEGVGGFKEAA

SEQ ID NO: 17374 - protein, 672 aa, Trichodesmium erythraeum IMS101
MPHRKQPAPPTPWSKNLAQPKIDDTAYIHSFSNIIGDVRVGANVLVAPGTSIRADEGTPFFIGAGTNIQDGVVIHGLEQGRVIGDDQQNYSVWIGTNVSITHKALVHGPCYIGDDCFIGFRSTVFNSRIGEGCIVMLHALIQDVEIPPGKYVPSGAIITNQQQVNRLSDVLPDDIKFAHHVVGINESLRQGYLCANNISCITPIRNEMNINYKNGNGYNPSGTTGRLTPEVVAHVNQLVSQGYYVGTEHADTRHFKTGSWKTCSPIQSSHSSEVVAALEACIQEHSTEYVRMFGIDPKAKRRISPIMIQRPDGKKVAQKSTTGNYSVPAATGTTRVGSTTTPNTTGLTPEVVTQVNSLLSQGYKIGTEYANERRFKTSSWQNGPTISETNSAQVLAALEKFLAEHSGEYVRLIGIDSKVKRRVAEIIIQRPGDSPIQQCVSTSPSYQAPVSTHAGINTRLSQEVVEQVRSLFNQGYRISLEHANERRFKTSSWISCAPISATNHSQAIAELEQVLAEYNGEYVRLIGIDTQAKRRVMESLIQQPNGKGERSASLKATSNGVVNTTQQSPVSSSQVATTIAHKLSQEAVEEIRSLIAGGYKIGTEYADKRRFKTSSWKTDIQIDGKREADVFPVLEESLAHHEGEYVRLIGIDPKAKRRVLEKIIQQPNGKAN

SEQ ID NO: 17375 - protein, 267 aa, Burkholderia xenovorans LB400
MHPMLNIAVKAARRASQIITRASLDLDLVQVSKKQHNDFVTEVDKASEAAIIDTLKTAYPDHAILAEESGKSDNESEYQWIIDPLDGTTNFIHGFPYYCVSIALAHKGIVTQAVVYDPTRNDLFTASRGRGAFLNDRRIRVAKRDRLADGLIGTGFPFRETDGLEAYGRQFAEMTQACAGLRRPGAAALDLANVAAGRMDGFFEQGLNAWDVAAGSLLITEAGGLVGNYTGDSDFLHIGEIVAGNPKVYAQMIPILSRYSRTRQQSA

SEQ ID NO: 17376 - protein, 192 aa, Anabaena variabilis ATCC 29413
MTTDSPIKPETTAGERLRNFLVAMVAIALTVALVLGLRTETAAVSLDKLYAASTPLEVAISNGKPSMVEFYANWCTVCQKMAPDIAEFEQQYADKVNFVMLNVDNTKWLPEMLKYRVDGIPHFVFLNKEGESLAQAIGDQPHTIMASNLEALVTGSALPHAQTSGQVSQVSTPVAPIGSQDDPRSHGSQVVN

SEQ ID NO: 17377 - protein, 483 aa, Physcomitrella patens subsp. patens
MATLADSFLADLEDLSDEEILDEEVAEAAEEAADADEEMAEVPILKFDDLDSVAKLQKSQRFHDIMKKVDEAMANGTESSSKGLVAEDDPEYQLIVECNALSVDIDNEITIIHNFIRDKYRAKFPELESLVLHPIDYSRLVKQIGNEMDLTLVDLEGLLPSATIMVVSVTASTTSGKPLSEENLQKTIEACDRALALDEAKKKVLEFVESRMGYIAPNLSAVVGSTVAAKLMGVAGGLAALSKMPACNVQILGAKKKNLAGFSTATALPHTGFVFHTEIVQSTPPPLRMKACRLVAGKSTLAARVDFTRGDLSAKIGQELREDIRKKIEKWQEPPPPKQPKPLPVPDSDPKKKRGGRRLRKMKERYALTDMRKLANRMKFGVPEESSLGDGLGEGYGMLGQAGSGKLRVSIGQSKLAAKVAKKFKEKQYGSSGATSGLSSSLAFTPVQGIELSNPQAQAGLLGSGTASTYFSETGTFSKIKRI

SEQ ID NO: 17378 - protein, 339 aa, Candida glabrata CBS 138
MSGSYWTSMQRQKWQHTKPSLARERQRLWVMECQLFPQGLNIIVDSKPNSADSSNGNAANNGGGNGRSQLVATTKNIPITHRDLHYDKDYNLRIYCYFLIMKLGRRLNIRQYALATAHIYLSRFLLKASVREVNLYLLVTTCVYLACKVEECPQYIRTLVSEARSLWPEFIPPDPTKVTEFEFYLIEELQCYLIVHHPYKSMEQIVEALKEEPFKLTFTSDELQNCWSLINDSFINDVHLTYAPHIIAMACLFITVSIQGSNTKELSLTSAVTETLTSQSSLTPQQQTFFRFLAESHVDLEEVMDTIQQQIILYDHWDRYHEPWIKYLLHTLYLRPLSA

SEQ ID NO: 17379 - protein, 499 aa, Dehalococcoides sp. VS
MILPDGKRTGMKYQYDLVVIGGGLAGFTSAVFANGLGKKVALVERDKLGGACTWNACVPSKALLQIGLRIRQIEKYNRNGVKLVSVNLQPGNIMSYLHSILGDIARIDDFDNLGNIGINILKGEAVFTDHHHINLNGQVISAKRFIIATGSSPAIPPVEGLVDIPFYTNETVFDINTIPSSMIVLGGGPAGIELGLAFAWLGCKVDIVEMADHILPKDDTELSELLFEYLNVEENLRIHISTKAIRFQKQNNGQVKLEMQTREGKIDEIAAEAVLVAVGRRANVSGLGLEKTGVKYTSQGISVDKKLQTSSSNIFAAGDVAGPIQLGMMAEKQAILAASNACLPFKQSIRYEDVAWVTYSEPQMAHIGLTEDEARRKYGNNVRIIRYPLNKVRRAVMDHDIRGMCKFMLDKKDRLIGAQLLCSHAENLIHELQILKCLHKPFLKLHSIPHIYPTYEEGIIKRAADISYTMKMRHNPLIRLVLRYWPGYKDKLDAVINRL

SEQ ID NO: 17380 - protein, 204 aa, Listeria monocytogenes str. 1/2a F6854
MTKIYLIRHGESQANYDNKNNHAYFSGQLDSPLTAKGINSAKKLRDYFNNIEMNIIYSSDSIRARETCKHGFSSDTPLIISKLLRERSLGDFEGKRIEDVKKDKRYIKFFNDSNFTEFRHSFHQKAPFGENYLDVYKRIQIFFNQIFLNENHSSVIIAHQTTIRCCLLYLREISKEEVFNLRIPNCEPIVVDIKKGVIYERCIE

SEQ ID NO: 17381 - protein, 176 aa, Enterococcus faecium
PPVAFSEKEIRTEKIKALKAIRIYNEEEVLENFVRGQYAQGELDGVQFKGYREEDKVDAQSETETFVAGKFTIDNFRWSGVPFYVRTGKRLTEKGTRINIVFKQVPVNVFKTSVDEPCDETTLPPNVLTIYIQPTEGFSLSLNGKEVGQGFETEPIKLEFRNSAEMVENSPEAYEK

SEQ ID NO: 17382 - protein, 105 aa, Malassezia sympodialis
VQVISSYDQFKQVTGGDKVVVIDFWATWCGPCKMIGPVFEKISDTPAGDKVGFYKVDVDEQSQIAQEVGIRAMPTFVFFKNGQKIDTVVGADPSKLQAAITQHSA

SEQ ID NO: 17383 - protein, 364 aa, Wolbachia endosymbiont of Drosophila ananassae
MSFNCGIVGLPNIGKSTLFNALTESSAAEAANYPFCTIEPNIGKISIKDQRLKQIAAIAGSEKIIYNQLEVVDIAGLVKGASKGEGLGNKFLSHIREVDAIVHLLRCFSDDDISHVHSKIDPISDAEVVEMELILADIDSIEKRLPQLEKKAKQGDKELKRQLELMQEVLATLKLGKPARSLENIDEDEMKSLQLLTTKPVMYVCNVEDTNVITGNELSKKVERMAEENKSKFYCISAKLEADIANLDSEEEKQSFLSEFGLQESGLDGVARIMYEVLSMITFFTVGPKEARAWPVKIGSTADKAAGVIHTDFEKGFIKAETISFADYIKYGSESACKDAGKIRFEGRDYIMQDGDIMHFRFNV

SEQ ID NO: 17384 - protein, 1619 aa, Coccidioides immitis RS
MSSKLWQYFLQDDVEGFKGLLANASYSQGNKNGAILAVTSSKFSISPGAALGSSPSPASSKIKRFPGSFATSPLQERPPFPQAPSVVLTRADVNARDQHGRTLLHLAASSQKESALEFAHALLEVPLLDIYAQDAESGWTALHRALYAGNATIAQALIARDLKDATSFRASSGAHHLSGGLIKIKDREGNSPFDLFGSTIVARDINETSEAALLSGDDTSTADSSAFDDTERNVSRGKLKPLVNVLGDEIFTFGSNKNLSLGIGDGDDRQFPERIHLTRPDHLLYRFYHEREALREEQGMKATDGRIDAGFADELPMKIRSLPMVFQDVVMSKLHTAILTNDPESNLYMCGFGPGGRLGTGDEATRFNFVCIEGGGIAGKKIINVALGQDHSIAISDLGEVFTWGSNKYGQLGYSLPRTNQKDDSPVQTTPRQIFNPFKKETIIGAAASAIHSVVYTSTSIYTFGKNEGQLGLIDADARSLEMQVIPRKVGASLFNQSIFMVSAIDRATAVLLENHEVWVFTHYGYSKLTFPLDGASSFIKDSFSATRYGLSANFVTKISGGGNTICALSSFGEVYTVNVNRKADTHSVSSSTTNPSKIRNSLPQPSRVWSLRKSHMAVRDVDVGQDGSIIICTESGSAWRKEPRSRLKDTGTITFGERQTKDYKFVRIPGLSRVVAVRSNAFGAYAAAQRGYDVTKTQIVVEDRTIWHDIWPLLPFKDLLSRHVLEDIMAPASITGTPNGIGLDAQRVLLPTELEDELKETLQVHNPLDGFPALVWVSSTSSDARIPVHEFALAARSPVLRHALSEFRKSYYYSVPDLLSIEYDSDGQAHIQLQNFDILSVFNLVLFIYTDHTYSVWNRIRHDANNAPRYRQVRLEVIKLATQLDLKSLERAARLMIPPKPCLNLDMEHAILEPTFFDSGDVIIDLYSGEVRAHGPILCQRCPFFDALFNGRAGGRWLSSRKERFSDSVDVIRVDLKHIDPGIFKFVLRHIYADTDDDLFEDVQTNNLDDFIDIIIDVMFVANELMIDRLAHVCQKLLGSFVDIRNVVPYLNAVAPCSVPAFKRAALEYICLNLEVILENRLLDRLDPDLFDELNETCRQNQMTCQPISRWRNTEEYVIEKYPEIVSRLEQDKQRRIDSMRLRSHLYEDEEREEKFKVGSTENHGCLSPSAKKKSSLQNLNSKSSMESPLLKSKPSAGDLIFPMDDEGVLPSSAIPAAHYTPNYKLDTDSLKSASHALSRVAASDSAKSPSVNATSRVEGHATPAVITYEPSSDKNHRPAGAPWGPFTATPRAGLKDIMAEAAGFSSASLSHYINSRRETDAPRPAPSKLSQKERKKMKQQQMQEASTEAEPSKTESPSPWQIPRRKLQSPFTADREQEDLPSVPRRTSSKAPLTLRQTVAGTPPPPSNDEPESSSSPSLKPGTNQHKPGTNTNTVPSTTPKFSASPPLPLAAILEQQQFEKDIIREAVTAKHNLHDIQIEQEFQEWWDAESKRVMEEEAAAIAAAAAASASTSRTRGSGRGRSKGRAAGGAGGGGSGGRGRGRDSRTADKNNTERATSAPSEPPPGAAGGEHARSGHRQQRNGRTNDRGRGSGPTRSGGAGGRGSGRGRGKASQAQQ

SEQ ID NO: 17385 - protein, 382 aa, Pseudomonas fluorescens PfO-1
MVYHKFHPHRESSMAFNSIEEIIEDYRLGKMVLLVDDEDRENEGDLLLAADRCTPEAISFMAREARGLICLTLTDDHCQRLGLEQMVPSNGSVFSTAFTVSIEAAVGVTTGISAADRACTVAAAVAPNARAEDLVQPGHIFPLRAKEGGVLTRAGHTEAGCDLARLVGFTPASVIVEVMNDDGTMARRPDLEVFAHKHGIKIGTIADLIHYRLSTEHTIERIGERELPTVHGTFRLITFEDRIEGGVHMAMVMGELRREEPTLVRVHVIDPLRDLVGAEYSGPTNWTLWAALQRVAAEGHGVVVVLANHESSQALLERIPQLTQPPRQFSRSQSRIYSEVGTGAQILQNLGVGKLRHLGPPLKYAGLTGYDLEVVESIPFTE

SEQ ID NO: 17386 - protein, 274 aa, Salinibacter ruber DSM 13855
MRGPSTRHDVRADQGPRRRCQNAIDGCPPQHISDTLPSLTRSSMDRDTAKQAAAEAAAQLVRDGMCVGLGSGSTTAYALEFLGRRIQAEDLDVQGVPTSFATERRARTHGIPLTSLDDTPSLDLALDGADEVDDAFRLIKGAGGAHAREKVVAHQADRFVVLVDPTKEVSRLGTQFPVPVEVLPMAATPVMNALDAAGATPTLRTADAKDGPVVTDQGLWIIDARFPDGIENPDALNRRLCDRPGVLDHGLFLDMATDVLVGRPDESVDHRSAS

SEQ ID NO: 17387 - protein, 435 aa, Pyrococcus furiosus DSM 3638
MARITEEQRRKLAQDALEYHRNNFPGNGKIEVIPKVPLRDFYDLSLAYTPGVAEPCKVIAKKGNYEDYTIIPNTVAVVTDGSAILGLGNIGVLAGMPVMEGKCVLFKALAGIDAFPILIDTQDVEKIVETIKLISKGFGGINLEDISAPRCFEIEMRLKRELDIPVFHDDQHGTAVVTLAGLINALKLVGKKFNEIKVAISGAGAAGIAIAKLLHHVGVKEILLVDRAGIIYEGRKENMNPYKEEVARFNIHGVQGDLAKAMEGADVFIGVSVGGIVKPWMIKKMADDPIVFAMANPIPEIMPEDAKKAGAKIVATGRSDYPNQINNVLGFPGIFRGALDVRATDITLNMNIAAAEAIASVVSDEELSEDYIIPSPLHPDVYPKEARAVAEQAIRDGVARRKLSGEWVEEHTRKLREFYAALIEPLNERRKQYIT

SEQ ID NO: 17388 - protein, 141 aa, Photorhabdus luminescens subsp. laumondii TTO1
MTVERTFSIIKPNAVKKNAIGAIYARFESAGFKIIAAKMLHLTREQAEGFYAEHKGRPFFDGLVEFMTSGPIVVQVLEGENAVQRHRDLMGATNPDNALAGTLRADYADSFTENAVHGSDAVESANREIAYFFTEDEICPR

SEQ ID NO: 17389 - protein, 511 aa, Oryza sativa Japonica Group
MGAERGGDSCYSPAAVMATAGALALVAICSYLAVTSNKQKRRRRPPVVGTVFHQLYNVRRIHDYHTALSREHTTFRMLVPAGGDQIYTCDPAVVEHILKTNFANYGKGPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 17390 - protein, 480 aa, Oryza sativa
  misc_feature (368)..(368): Xaa can be any naturally occurring amino acid
  misc_feature (384)..(384): Xaa can be any naturally occurring amino acid
  misc_feature (393)..(393): Xaa can be any naturally occurring amino acid
  misc_feature (435)..(435): Xaa can be any naturally occurring amino acid
  misc_feature (463)..(463): Xaa can be any naturally occurring amino acid
MGKAAAMEVSASAAAEAGMMVGHGEWRDDDGRARRMGTVWTASAHIITAVIGSGVLSLAWAIAQLGWVAGPAVMLLFAFVIYYTSTLLAECYRSGDPCTGKRNYTYMDAVRANLGGSKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGTGVTSMQKVWRSLQAFGDIAFAYSYSIILIEIQDTIKAPPPSEAKVMKRATMVSVATTTVFYMLCGCMGYAAFGDKSPDNLLTGFGFYEPFWLLDVANAAIVVHLVGAYQVFVQPIFAFVERWAAARWPDGGFISXRELRVGPFSLSVFRLXTWRTAFVCXTTVVSMLLPFFGDVVGLLGAVSFWPLTVYFPVEMYIAQRGVXRRGSARWLCLKVLSAACLVVSVVAAAGXSIADVVDALKVYRPFSG

SEQ ID NO: 17391 - protein, 263 aa, Pseudomonas fluorescens PfO-1
MRNPIKINTQAEIAQSREAGRLAAEVLAMLVPHVKAGVTTDQLDQLCNDYIVNVQKAIPANVGYHGFPKTVCASVNEVVCHGIPSKRVLKDGDIVNLDIAVIKNGWFGDTSRMYVVGEPTPEARHLIKTTYDAMCAGIRVVRPGATLGDIGHAIQTLAEKEGFSVVREYCGHGIGKVYHDEPQVLHYGYPEQGLKLKAGMIFTIEPMLNAGKRHVKSLADGWTVVTKDHSLSAQWEHMIAVTDDGFEVLTAWPDEIEGFKAIV

SEQ ID NO: 17392 - protein, 310 aa, Pseudomonas putida GB-1
MSEQPSSAHWQLQNIVTGLRGAREQWRTRNGRSIGEQGGRELPSREAMRQILEQLCGALFPMRLGPVDLREESEDFYVGHTLDAALTALLAQARLELRYAARQSKAELAGVDAHALSLIQGFAAALPELRVLLDTDVLAAYHGDPAARSVDEVLLCYPGILAIIHHRLAHHLYQAGLPLLARISSELAHSATGIDIHPGAQIGPSFFIDHGTGVVIGETAIIGERVRIYQAVTLGAKRFPSDESGTLHKGLPRHPIVEDDVVIYAGATVLGRITIGKGSTIGGNVWLTRSVPAESNITQANLQLDCQDKN

SEQ ID NO: 17393 - protein, 415 aa, Oryza sativa Japonica Group
MVSVKNTKGSFNHGNMSDLFGDGIFAVDGDKWKQQRKIASYDFTTRALRDFSGDVFKRNAAKLAGVVSSHAASNQSMDFQGFLMRATMDSIFTIAFGQDLNTLDGSGEGRRFAAAFDDASEFTMLRYLNPFWKLSRLLNVGAEAMLKERIKVVDGFVYKLIRDRSDELSNTKAHDTDSRQDILTRFIQATTSDSGTVDYKYLRDIILNIVIAGKDTTAGSLAWFLYMMCKHPEVQEKICHEAMEATNAGEAASIDEFSQSLTDEALNKMHYLHAALTETLRLYPAVPLDNKQCFSDDVLPNGFNVSKGDIVFYIPYAMGRMESLWGKDAESFRPERWLDENGVFQQESPFKFTAFQAGPRICLGKDFAYRQMKIFAAVLLRFFVLKLRDEKEIISYRTMITLSVDQGLHLTAMAR

SEQ ID NO: 17394 - protein, 146 aa, Ralstonia metallidurans CH34
MKTARQVLESKANQAIFSIPPTATVYAALQLMAEKGIGALLVMEQQKIVGIISERDYARKVILMQRTSRETLVREIMTTAVIYVRADQTTDECMALMTRHRLRHLPVMNSDQLLGMISIGDLVNDIISEQRFTIEQLEHYIHGGSR

SEQ ID NO: 17395 - protein, 532 aa, Oryza sativa Japonica Group
MQQQAYRAHDELPYMGMDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRSFVFKLRDKKDNVSYRTAITLAIDQDLHLTATAR

SEQ ID NO: 17396 - protein, 475 aa, Oryza sativa Japonica Group
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGAVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 17397 - protein, 420 aa, Vitis vinifera
METQRITEFPHKNMDKRPRKRPRLTWDMPPPLPPPKVCSDLRFDVLFLSGVFTRNGSPPWRPDDKDGHYIFAIGENLTPRYRIISKMGEGTFGQVLECFDNDKKEVVAIKIVRSIHKYREAAMIEIDVLQKLARHDVGGTRCVQIRNWFDYRNHICIVFEKLGPSLYDFLRKNSYRSFPIDLVRELGRQLLESVAFMHDLRLIHTDLKPENILLVSSDYIKVPDYKFLSRTIKDGSYFKNLPKSSAIKLIDFGSTTFEHQDHNYVVSTRHYRAPEVILGLGWNYPCDLWSVGCILIELCSGEALFQTHENLEHLAMMERVLGPLPQHMVLRADRRAEKYFRRGARLDWPEGATSRESMRAVWKLPRLQNLVMQHVDHSAGDLIDLLQGLLRYDPAERLKAREALRHPFFTRDARRCGYPL

SEQ ID NO: 17398 - protein, 498 aa, Pelargonium x hortorum
MRLNPTASSPGDSTLQKKKLGRIVQIIGPVLDVAFPRGKMPYIYNALVVQGRDTVGQQIHVTCEVQQLLGNNRVRAVAMSATDGLMRGMEVIDTGAPLSVPVGGATLGRIFNVLGEPVDNLGPVDNRTTSPIHKSPPAFIELDTKLSIFETGIKVVDLLAPYRRGGKIGLFGGAGVGKTVLIMELINNIAKAHGGVSVFGGVGERTREGNDLYMEMKESGVINEQKVAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGNEHYEIAQRVKQTLQRYKELQDIIAILGLDELSEEDRLTVARARKIERFLSQPFFVAEVFTGSTGKYVGLSETIRGFHLILSGEFDGLPEQAFYLVGNIDEATAKAMKLEKESNLKK

SEQ ID NO: 17399 - protein, 101 aa, Triticum aestivum
  misc_feature (44)..(44): Xaa can be any naturally occurring amino acid
AKCRTLQEENEEIGAMASEGKIHELGMKIAVLKTQNNELRNQFXVSILQEELEAKDVELARLKEMLCQKEATEDDTVVEEREEAANDMNASSDPQPIKVES

SEQ ID NO: 17400 - protein, 306 aa, Salmonella enterica subsp. enterica serovar Typhi str. CT18
MTASLHIILDTDPGIDDAAAIAAALFAPQLDLQLITTVAGNVSVEKTTRNALQLLHFWNSDIPLAQGAATPLLRPLRDAAYVHGESGMEGYDFVDHQRQPLAKPAFIAIRDVLMNAPEPMTLVAIGPLTNIALLLMHYPECACNIRRLVLMGGSAGRGNFTPNAEFNIAVDPEAAALVFRSGLEIVMCGLDVTNQAMLSPDFLNKLPALNRTGKMLHSLFNHYRSGSMRTGVRMHDLCAIAWLVRPELFTLQSCFVAVETQGEYTAGTTVVDIEGRLGQPANAQVALALDVDGFRQWVAEVFAYVP

SEQ ID NO: 17401 - protein, 285 aa, Bacillus clausii KSM-K16
MYYYVIDSFTETRFGGNPAGVVIHKNLEQDFMQKFAAEVRFSETAFVKRLENDRFEVKFFTPNCQVDLCGHATVAAFKALLDSQLVEDNRAYVIETLAGALSIEVSQSFIVMEQAEPRLGKTFRDYAILSNLFQIDKSQIGDNQFRLLPKASSTGVWDLMLPIKTKDALYSLKPDFDGIAAFAEENHIAGIHAFTLDTTKGVAESRNFCPYYGINEEAATGTSTGALTYYLYKNNVLNDFDHNYVFIQGLSMDRPSTIVTKMVNHNQPKIKVAGKARILSKGELY

SEQ ID NO: 17402 - protein, 347 aa, Physcomitrella patens subsp. patens
MRLCSVVGMGYDWKKQYGFIILFLSLAMCAASAEIDRKTAICEYNRTKALNLVEYASAVYTIDDLSLLSWTCSRCKGLTKGFKIHTLIVDVQHCLQAFVGVAENLDAIVIAFRGTQDTSIQNWAEDIYFRELDLHYPGVIDAMVHSGFYAAYHNTTLRERVFDAIQAIRQARSDLGVIITGHSMGGAMATFCALDLSANYGFKNVEVITFGQPRVGNYAFALYYNAYVPLTIRVTHAHDIVPHLPPYYPLLGEKTYHHFATEVWIFRVAVGRLQYEFERVCDGSGEDTSCSRSVTGNSIADHLNYYGVYLKTEDDVMALQNSSNGQTLGLGCKTRSLWERFPAMAQE

SEQ ID NO: 17403 - protein, 385 aa, Ashbya gossypii ATCC 10895
MPSMTSTVHSNGGIGRFLSEIPLVTRGLLLALLLWCFNAFMRFSQLQVLVFAWNFRRHDYEFWRLYGRFIAVNSNSAAALLALYQIYRNSSSLELDYFQANPVDYAFYLAFCTTTCAALTAACHALLGIEPGSLFPALDGMLLYTWALLNANVTVNYIVFNIRGKYLPLLNLFVHMLGGEPSGVLIILLGYAAAYIYCCLETRTAGPLYGKLAGLPHYGYPTLRDSHFRGSALLAPLIATQSGGPPSAAAAVSGNFRGKGRRLHDGKAVAAPRHAARAAGTGAVVPLTSTSALAAALAGPGLAVIDFYAVWCGPCKQLAPLLDQYAAKHTAVRFYKIDVDRFPGVAATHEVHAMPTVLFFRAGKEVARVQGANPSAIRAALQSYS

SEQ ID NO: 17404 - protein, 377 aa, Streptomyces avermitilis MA-4680
MATEDAVREALATVNDPEIQRPITELGMVKSVEIGADGAVAVTVYLTVSGCPMRETITTNVTKAVSAVEGVTRVDVTLDVMSDEQRRELATALRGGQAEREVPFAKPGSLTRVYAVASGKGGVGKSSVTVNLAAAMAADGLKVGVVDADIYGHSVPRMLGADGRPTQVENMIMPPSANGVKVISIGMFTPGNAPVVWRGPMLHRALQQFLADVYWGDLDVLLLDLPPGTGDIAISVAQLVPNAEILVVTTPQQAAAEVAERAGSIAVQTHQKIVGVVENMAGLPCPHCDEMVDVFGTGGGQSVADGLTRTTGATVPVLGSIPIDVRLREGGDEGKPVVLTDPDSPAGSALRAIAGKLGGRQRGLSGMSLGITPRNKF

SEQ ID NO: 17405 - protein, 207 aa, Wolbachia endosymbiont of Drosophila ananassae
MHSGSQHLFDIIILLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASHVGRLSIAVLLMQDFAVVPLIVLVPLLTGNSEHSLISSLAGSLVQAAIALVLIFITGRLLLRP

SEQ ID NO: 17406 - protein, 155 aa, Bartonella henselae str. Houston-1
MTIEICKKLHVLIVEARFYDGISDALLTGAVSTLQKAEATYDIVTVPGALEIPGAIAFAEKNSKIYYDGYVALGCVIRGETYHFEIVANDSCRASMDLTIHKHLAIGNGILTVENEKQAWARAKQAEKNKGGFAAQAALCMIALKKRFGEIIKYG

SEQ ID NO: 17407 - protein, 278 aa, Triticum aestivum
AYLGDSIEQVCTKKQAGTGPEFPGYRRPTRPTEFRRTSVMRALINEQKKRIARGEARVSYLDFLVAENALTDDQLMMLVWEAVIENADTTLVTTEWAMYELAKNPEKQERLYQEIKDVCAGETVTEDHLRRLPYLNAVFHETLRFHSPVPLVPPRFVHENTKLAGYDVPAGTEIVINLYGCNMNKKDWEEPEEWRPERFLDPRFDAADMYKTMSFGSGKRICAGSMQATVISCTAMARMVQEFSFRLKEGDEDKVDTVQLTSYKLHPLYVHLSPRGSK

SEQ ID NO: 17408 - protein, 176 aa, Enterococcus faecium
PPVAFSEKEIRTEKIKALKAIRIYNEEEVLENFVRGQYAQGELDGVQFKGYREEDKVDAQSETETFVAGKFTIDNFRWSGVPFYVRTGKRLTEKGTRINIVFKQVPVNVFKTSVDEPCDDTTLPLNVLTIYIQPTEGFSLSLNGKEVGQGFETEPIKLEFRNSAEMVENSPEAYEK

SEQ ID NO: 17409 - protein, 165 aa, Methanosarcina barkeri str. Fusaro
MTERQVESVLIEIPKGSRNKYEYDKEKKVIKYDRMLFSSMVYPSDYGFFPDTLALDGDPLDAMVLTWEPTFPGCIIDVHLVALFDMEDDKGRDQKILCVPKNDPMWNYIETVEQVPPHLFKEITNFFQTYKNLEEKRVKVIGWKDLETAVAVLQEAKDRYIEQKK

SEQ ID NO: 17410 - protein, 479 aa, Pseudomonas fluorescens PfO-1
MLHASFFPANGTRSTPQRGEEMSKDSRPAVLGLIGNTPLVQVTRFDTGPCTLFLKLESQNPGGSIKDRIGLAMIDAAERDGRLQPGGTIVEATAGNTGLGLALVGRAKGYRVVLVVPDKMSTEKVLHLKAMGAEVHITRSDVGKGHPEYYQDVAARLAKDIPGAFFADQFNNPANPLAHEFSTGPEIWAQTEHDLDAIVVGVGSAGTLTGLTRFFKRVQPDLEMVLADPVGSVMAEYSRSKHLGTAGSWAVEGIGEDFIPSITDLSSVRSAYSISDEESFDHARQLLKAEGILGGSSTGTLLAAALRYCREQTEPKRVVSFVCDTGTRYLSKVYNDQWMTDQGLLQRKRYGDLRDLIARRFEDGKVVSVGPDDTLMTAFQRMRLADVSQLPVLVDGKQLVGVIDESDILVRVHEDASLFSKPVSSAMTDKLQTLAPGATLAELEAVLSSGLVAIIADASGFHGLITRVDMLNQLRRSLA

SEQ ID NO: 17411 - protein, 329 aa, Propionibacterium acnes KPA171202
MVSSRRRDLDVLTMGRIGVDIYPLQYGVGLEDVTSFGKFLGGSPTNVAVAAARLRHSAAVVTAVGDDPFGRFCRREMARLGVYDNYVLVNSELPTPVTFCEIFPPDDFPLYFYRRPTAPDLRITPDDVPEDAVRNAQILWLSVTGLCQQPSYDAHCRALEVRGKAEHTVLDLDYRSMFWQSAAKAHEAVSAVLPHVTVAIGNREECEMAVGESDPDRAAHALLDAGVQLAVVKQGPKGTLAMTREERVEVAPTPIDVTNGLGAGDSFGGSLCHGLLEGWSLAETIQAASAAGALVATRLECSTAMPSEPELFAMMAKHPDIAIKEEHLS

SEQ ID NO: 17412 - protein, 532 aa, Agaricus bisporus
MYPVDGIRSQIEWNTTLNVSDAPVPTETTKYHRKTAIIATIGPKINTVEKLTDVRLAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 17413 - protein, 350 aa, Yersinia pestis KIM
MSQVSEQSALVTSSKKAIPRGTDMAKHIQFTTTGGPDVLQYLEFTPSDPAPHEVQVENKAIGINYIDTYVRSGLYPPAHLPSGLGTEAAGIVSKVGAAVSSVKVGDRVVYAQSALGAYSEVHNVPADKIALLPEQISFEQAAASFLKGLTAYYLLRQTHEIKPGEVFLFHAAAGGVGLIACQWAKALGAKLIGTVGSDEKAQLAKAAGAWATINYRTENIAQRVAELTEGEKVGVVYDSVGKSTWEASLDSLKRRGLLVSFGNASGPVTGVNLGILNQKGGIYVTRPSLNVYVANRQELESASQQLFSMITSGAINVDVAQAQQFPLRDAQRAHETLEGRQTTGSSLLIP

SEQ ID NO: 17414 - protein, 233 aa, Zea mays
MVSSPFDLKIWGFGSASRARSGPSSFFPLLYLIGFFASFTQGSSERNRKEGRLIRVKEAMEHKEAGCQAPEGPILCINNCGFFGSAATMNMCSKCHKEMITKQDQAKLAASSIDSIVDGSDAVMEPGGAGSNTVVAVAQVELQKKNVQQPADVAEPNEGVAAISKGGKVGPNRCSACRKRVGLTGFNCRCGNLYCALHRYSDKHDCKFDYRTAARDAIAKANPVVKADKLDKI

SEQ ID NO: 17415 - protein, 425 aa, Pseudomonas putida GB-1
MSKTNESLMQRRVAAVPRGVGQIHPIFVDTAKNSTVIDVEGRELIDFAGGIAVLNTGHLHPKVVAAVQEQLTKVSHTCFQVLAYEPYVELCEKINKLVPGDFDKKTLLVTTGSEAVENAVKIARAATGRAGVIAFTGGYHGRTMMTLGLTGKVVPYSAGMGLMPGGIFRALFPSELHGISVDDAIASVERIFKNDAEPRDIAAIILEPVQGEGGFLPAPKELMKRLRALCDQHGILLIADEVQTGAGRTGTFFAMEQMGVAPDLTTFAKSIAGGFPLAGVCGKAEYMDAIAPGGLGGTYAGSPIACAAALAVIEVFEEEKLLDRSKAVGERLTTGLREIQKKHPIIGDVRGLGSMIAVEVFEKGTHTPNAAAVGQVVAKAREKGLILLSCGTYGNVLRILVPLTAEDALLDKGLAIIEECFAELA

SEQ ID NO: 17416 - protein, 142 aa, Sinorhizobium meliloti 1021
MSVKAILNEKGSNVITVTAQVTVQQAASLLHENHIGAVVVVDPEEHIVGIMTERDIVASIARYGAACLDKPVSSVMWQNVYCCREEMSVDSLMEMMSKFRARHLPVEREGRLAGIISIGDVVKYHIRAIENEAEQIKAYIAG

SEQ ID NO: 17417 - protein, 480 aa, Pseudomonas putida GB-1
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAQKLAAAVAKLKIGNGLEEGTTTGPLIDGKAVAKVQEHIEDAVGKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 17418 - protein, 487 aa, Aspergillus oryzae
MPPPVGRYGPTGLSGPYTHLQQAHLQQQQQPQHHPAHAQSANTALPPPSLGGHPGFAAGNPNTNINPFTLSGTGIANGMSVAGFGGAADAGGTGLASHAAQMGFARGAQMQQQQLHQTHDGRLALEAKAGAVKTRIRDVWKHNLAQEMAVLRQLVEKYPYISMDTEFPGIVARPIGAFTNKADYHYQTLRCNVDLLKMIQLGITLFSAEGEVPPPNATDANGQPLGNSLVPAPCTWQFNFRFSLEDDMYAQESTAMLAKAGIDFSMHDKNGIDPFEFGALLISSGLVLLDDVHWVSFHSGYDFGYLMKIMLCKPLPENEEEFHKLLNIFFPSLYDIKYLMKHAGRNQAVNDTPLTPAAAQILTNLGQKSGLQDIADELGVKRVGIAHQAGSDSLVTGEIYWKMRQLVFNGSIDESKYSGQIWGLNGQMPALLYQMPHQTPNLNGATIYSAAGTPSTPNAGTPQHQGLGTLTPGAVGGVLGQFQVGKA

SEQ ID NO: 17419 - protein, 382 aa, Salmonella enterica subsp. enterica serovar Typhi str. CT18
MIKSALLVLEDGTQFHGRAIGATGSAVGEVVFNTSMTGYQEILTDPSYSRQIVTLTYPHIGNVGTNEADEESSQVHAQGLVIRDLPLIASNFRNTEDLSSYLKRHNIVAIADIDTRKLTRLLREKGAQNGCIIAGDSPDAKLALEKAKAFPGLNGMDLAKEVTTAETYRWTQGSWTLKDGLPEAKSEDDLPFHVVAYDFGAKRNILRMLVDRGCRLTVVPAQTSAEEVLKMNPDGIFLSNGPSDPAPCDYAIEAIKKFLQTDIPVFGICLGHQLLALASGAKTVKMKFGHHGGNHPVKDMDRNVVMITAQNHGFAVDEDSLPANLRVTHKSLFDGTLQGIHRTDKPAFSFQGHPEASPGPHDAAPLFDHFIELIKHYRSSAK

SEQ ID NO: 17420 - protein, 484 aa, Arabidopsis thaliana
MLYFILLPLLFLVISYKFLYSKTQRFNLPPGPPSRPFVGHLHLMKPPIHRLLQRYSNQYGPIFSLRFGSRRVVVITSPSLAQESFTGQNDIVLSSRPLQLTAKYVAYNHTTVGTAPYGDHWRNLRRICSQEILSSHRLINFQHIRKDEILRMLTRLSRYTQTSNESNDFTHIELEPLLSDLTFNNIVRMVTGKRYYGDDVNNKEEAELFKKLVYDIAMYSGANHSADYLPILKLFGNKFEKEVKAIGKSMDDILQRLLDECRRDKEGNTMVNHLISLQQQQPEYYTDVIIKGLMMSMMLAGTETSAVTLEWAMANLLRNPEVLEKARSEIDEKIGKDRLIDESDIAVLPYLQNVVSETFRLFPVAPFLIPRSPTDDMKIGGYDVPRDTIVMVNAWAIHRDPEIWEEPEKFNPDRYNDGCGSDYYVYKLMPFGNGRRTCPGAGLGQRIVTLALGSLIQCFEWENVKGEEMDMSESTGLGMRKMDP

SEQ ID NO: 17421 - protein, 290 aa, Picea sitchensis
MNEVKLVAKIQHRNLVQLLGCCVDGPERLLVYEYLPNKSLDKLLFNPERRKVLDWQKRYNIIIGVARGLLYLHQDSQLRIIHRDVKVNNILLDDKLNPKIADFGLARLFPDDETHVHTRVAGTYGYMAPEYAMLGQLSVKADVYSFGVVLLEIVSGRRNTDIRLPQEQQILLEWGWRLCNGENLLNMIDPTIVGCCPQEQALRCIQVGLLCVQADVVNRPAMSDVVLMLSANSMGIPNPTKPAFVSLSFSGDACTKDGAVSTSSATSQIQRSNLTFSGCDSSSIISLEGR

SEQ ID NO: 17422 - protein, 356 aa, Physcomitrella patens subsp. patens
GACDLFEGSWVPDTRPPQYTNSTCKFIQGHQDCMKNGRPDTGYLHWKWQPYECDLPRIDARAFLSTMRGRSVVFAGDSISRNQFQSLLCILSQAEMPFPKYQSPDYKNIVYVFPSTNFTFTIRWSPFLVHVEEKQVTRSDNETITVPYIHIDELDKTWADYARGADILQLSTGQWWFQRALFLQGGQPIGGHTCDGWETECKEIGFFDAYRTAIRNVLQGILSIPGFTGTVVFRSFSPDHFENGRWDNGGECVRTTPGGVAMLYVTKWMLDIQKEVFQNVTGTLNAADKPRIKLLNVTNIAQFRADAHPNVYRTFQPYSKEHQGFIQKDCLHWCLPGSIDTWNDLLVQLLQDVIHR

SEQ ID NO: 17423 - protein, 637 aa, Bacillus clausii KSM-K16
MIVLQCVNVSKAFGTEPVLEQVKLEVQARDRVGLVGRNGAGKSTLLKIITGEMSQDTGEIVIPKQTTIGYLAQHTGLASNRSIWDEMLEVFAPLLEMERSLRTLEQQMANPEAIEQNNYQKLLSEYDQLQLAFKDSGGYQYEADIRSVLAGLHFHHFDYSTAISTLSGGQKTRLALAKLLLSKPDILVLDEPTNHLDMETLSWLEQYLANYSGAILVVSHDRYFLDKLVTKTVELSRGKTTTFHGNYSHYLDEKAKRYQQAVKQYEKQQEEVAKLETFIAKNIARASTTKRAQSRRKQLEKMDMVDRPDGDKSVVFSFNINKQTGNDVLTIRDLAVGYGQDTVFEGLHLSLTRGESVGLIGENGAGKSTLLKAITQQLSPQKGSIIYGSNVVIGYYDQEQAKLSSNKTVLHELWDEYPTTPEKDIRAVLGRFLFTGDDVLKPVSSLSGGEKARVALAKLMMQQANFLILDEPTNHLDLDAKEVLEAALLDYPGTILFVSHDRYFINRLATRIIELDQGDTNVYLGNYNDYLEKKRQNAERAALKKEETLTKQAAETDRNSFQLDKEAKRQERQKQRRIEAIETELEQIEASISALHEQLADPDVYTDHQKAQTIQAELEQQNNALEALMEEWETLST

SEQ ID NO: 17424 - protein, 443 aa, Candida glabrata CBS 138
MGKVLDLALHPLELRAALKLKFIRQPLFSTNDTRATPQLERCYELLNLTSRSFAAVIMELHPELRNVIMVFYLILRALDTVEDDMTIDPQLKVKVLREFDSKLDTTDWSFDGNDLKEKDRVVLTEFPCILGEYHKLKPEYQKVIKRITGLMGNGMADYILDENFNLNGVQTVKDYDKYCHYVAGLVGDGLTELIVLAGFGSDDLYHGKNSFQLYESMGLFLQKTNIIRDYAEDLDDGRSFWPKEIWSEYATKLTDFRDPKNTQKGVDCINHLVLNALTHVIDVLTYLSSIHEQSSFQFCAIPQVMAIATLAKVFNNPEVLRKNVKIRKGTTCDLILNSRTLKGCVDIFQYYLRDMKQRLPVEDPNYLKFNIQVAKIEQFIEEMFQDNLPAGVEPRETMIYLKVQERLKWDTQVIPRVQEEDYKFNMALSVVFCVLLSFYFFTK

SEQ ID NO: 17425 - protein, 338 aa, Microcystis aeruginosa PCC 7806
MIRVAINGFGRIGRNFLRCWLGRTNSGLEVVGINDTSDPRSNAHLLKYDSMLGKLNANIDADDNSLIVNGKTIKCYSDRNPLNLPWAEWGVDLVIEATGVFVDEEGASKHIVAGAKKVLITAPGKGSGVGTYVVGVNAHEYEHDKYNVISNASCTTNCLAPVVKVIHENFGIIKGTMTTTHSYTGDQRILDASHRDLRRARAAAVNIVPTSTGAAKAVALVIPDMKGKLNGIALRVPTPNVSVVDLVAQVEKSTIAEQVNEVLKEASENSLKGILEYNDLPLVSSDYRGVDASSIIDASLTMVMGGDMVKVIAWYDNEWGYSQRVVDLAEVVASKWKG

SEQ ID NO: 17426 - protein, 363 aa, Escherichia coli O157:H7 EDL933
  misc_feature (7)..(7): Xaa can be any naturally occurring amino acid
  misc_feature (16)..(16): Xaa can be any naturally occurring amino acid
  misc_feature (34)..(34): Xaa can be any naturally occurring amino acid
MGFKCGXVGLPNVGKXTLFNALTKAGIEAANFPXCTIEPNTGVVPMPDPRLDQLAEIVKPQRTLPTTMEFVDIAGLVKGASKGEGLGNQFLTNIRETEAIGHVVRCFENDNIIHVSGKVNPADDIEVINTELALADLDTCERAIHRVQKKAKGGDKDAKAELAVLEKCLPQLENAGMLRALDLSAEEKAAIRYLSFLTLKPTMYIANVNEDGFENNPYLDQVREIAAKEGSVVVPVCAAVEADIAELDDEERDEFMQELGLEEPGLNRVIRAGYKLLNLQTYFTAGVKEVRAWTIPVGATAPQAAGKIHTDFEKGFIRAQTISFEDFITYKGEQGAKEAGKMRAEGKDYIVKDGDVMNFLFNV

SEQ ID NO: 17427 - protein, 165 aa, Candida glabrata CBS 138
MAEIPEGANVTILNRNEKKARELISKLGLKKVPGIIRVTFRKKDNQIFAIEKPEVFRSVGGNYVVFGEAKVDNFTQRLAAAQQQAQSQTATKTPEDIQADMQAAAVANENKTEGDAAEEDVDAGDLSNDDIDLVVQQTNATKGQAIKALKEHNGDIVNAIMSLSK

SEQ ID NO: 17428 - protein, 550 aa, Escherichia coli O157:H7 EDL933
MPFRALIDACWKEKYTAARFTRDLIAGITVGIIAIPLAMALAIGSGVAPQYGLYTAAVAGIVIALTGGSRFSVSGPTAAFVVILYPVSQQFGLAGLLVATLLSGIFLILMGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNVEFQPLRTMARAGIQPIPGRLAFFPNRRAAMADL

SEQ ID NO: 17429 - protein, 226 aa, Triticum aestivum
MHPTRWELSHMVDLQAAALVISVVAAEVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFRYI

SEQ ID NO: 17430 - protein, 497 aa, Propionibacterium acnes KPA171202
MKTIRQWVGGEYYEGSPLGVIPVENPATGEVTAELLQASKEDLDHTVEVTRDAQKEWANYSLSKRVAIMFKMRQLVLDHQDEMARLIVEEHGKNYSDAIGEIQRGRETFDFATAINVALKGEYSHDVSTGVDIHTTRQPVGVVAGICPFNFPAMVPMWMHPLAVATGNAFILKPASPTPSASLLTAELYKEAGLPDGVFNVLSGDRRSVQDILVHPGIDAISFVGSTPVAHIVQDTGVSHGKRVQALGGANNHAIVMPDSDLDFAAQHISASAFGAAGERCMALPVVVAVGGCGPQVAEKVKKHAEAIKVGEGMGEGVEMGPVISAKAKDRIVGLIDDAEKRGSKVVLDGRGLTVPGYENGHFLGPTVLDDVPLDAPVYTEEVFGPVLAIVHADTYEEALKIVNAQPFGNGSAIFTNDGGVARRFTLDVEAGMVGVNVPIPTPVAFYSFGGWKESLLGDTHIHGPEGVTFYTRAKAITERWPTEKTYAATMSFQREE

SEQ ID NO: 17431 - protein, 315 aa, Escherichia coli O157:H7 EDL933
  misc_feature (62)..(62): Xaa can be any naturally occurring amino acid
  misc_feature (252)..(253): Xaa can be any naturally occurring amino acid
MPDMKLFAGNATPELAQRIANRLYTSLGDAAVGRFSDGEVSVQINENVRGGDIFIIQSTCAXTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPXXSGNAANNLRNSVIDEVVVCDTIPLSDEIKSLPNVRTLTLSGMLAEAIRRISNEESISAMFEH

SEQ ID NO: 17432 - protein, 366 aa, Caulobacter crescentus CB15
MKAAVLREVGKPLQIETVAIGKPGPREVLIRTKAAGVCHSDLHFVEGSYTHALPAVLGHESAGIVEAVGSEVRTVKVGDHVITCLNPYCGHCEVCLTGHMNLCISPETRRSKSDAPRLFKEDLNGATGPMAQFLNLSSFAEMMLVHEHACVAIRKDMPFDRAALIGCSVMTGVGAVMHTSNVRPGETVAVIGCGGVGLATINGAAIAGAGRIIAIDRLAGKLELAKTFGATDVVDASQVDDIAKAVVELTGGGVHHSFEAIGLKATAEASFKMLRRGGTANVIGMIPVGTKIELHGVDFLGERRIQGSYMGSNRFPVDMPRLVDFYMSGKLKLDELISRRIKLEDVNSAFDELKRGELARSVIVFD

SEQ ID NO: 17433 - protein, 418 aa, Escherichia coli O157:H7 EDL933
  misc_feature (37)..(37): Xaa can be any naturally occurring amino acid
MTLLALGINHKTAPVSLRERVSFSPDKLDQALDSLLXQPMVQGGVVLSTCNRTELYLSVEEQDNLQEALIRWLCDYHNLNEEDLRKSLYWHQDNDAVSHLMRVASGLDSLVLGEPQILGQVKKAFADSQKGHMKASELERMFQKSFSVAKRVRTETDIGASAVSVAFAACTLARQIFESLSTVTVLLVGAGETIELVARHLREHKVQKMIIANRTRERAQILADEVGAEVIALSDIDERLREADIIISSTASPLPIIGKGMVERALKSRRNQPMLLVDIAVPRDVEPEVGKLANAYLYSVDDLQSIISHNLAQRKAAAVEAETIVAQETSEFMAWLRAQSASETIREYRSQAEQVRDELTAKALAALEQGGDAQAIMQDLAWKLTNRLIHAPTKSLQQAARDGDNERLNILRDSLGLE

SEQ ID NO: 17434 - protein, 83 aa, Vitis vinifera
  misc_feature (24)..(24): Xaa can be any naturally occurring amino acid
  misc_feature (41)..(41): Xaa can be any naturally occurring amino acid
MPSGATIAGLSLGSSLSKLNTKVXAFSVCDDPDYFYDYVQXLLDGLQAGVRSHDIVDIQNAKCLLDILKSKAKGRILVLEKWI

SEQ ID NO: 17435 - protein, 293 aa, Photorhabdus luminescens subsp. laumondii TTO1
MASLEHFIGNTPLVKLQRITDKLGGEIWVKLEGNNPAGSIKDRTALSMIQQAELRGEISPGDVLIEATSGNTGIALAMIAAVKGYHLKLLMPDNMSLERQASMRAYGAELILVSRAMGMEGARDLAQQMERNGEGKVLDQFNNPDNPLAHFTTTGPEIWQQTQGRITHFVSSMGTTGTITGVSRYLKSQSNRVQIIGLQPAENSHIPGIRRWSPAYLPGIFRKELVDQVLDITQKEAEDTMRLLAQKEGIFCGVSSGGAVAGALSIAAQNPGSVIVTIICDRGDRYLSTGVFN

SEQ ID NO: 17436 - protein, 575 aa, Photorhabdus luminescens subsp. laumondii TTO1
MISGILVSPGIAFGKALLLKEDSIIINQKKISQEQIEQEISYFKQGREKASSQLEIIKNIAAKNLGEEKAEIFEGHIMLLEDEELEQEIIALIKNDLKTSDAAVYSVIETQAQALEELDDEYLKERATDVRDIGKRLLKNILGIPIVDLGSISEEVILVANDLTPSETAQLNLEKVLGFITDLGGRTSHTSIMARSLELPAIVGTTQATTTIQNGDYLILDAVNNHIYINPSDAEIEQLKKTKNEYLSEKAELAKLKDLPAMTLDGHQVEVCANIGTVRDVIGAERNGAEGVGLYRTEFLFMDRDALPTEEEQFQAYKAVAEAIGSQAVIIRTMDIGGDKNLPYMNLPKEENPFLGWRAIRICLDRKEILHSQLRAILRASAFGKLRIMFPMIISVEEVQELKVELELLKGQLREEGKKFDEAIEVGVMIETPASAVIAHHLAKEVDFFSIGTNDLTQYTLAVDRGNELISHLYNPMLPAVLSLIKQTIDASHAEGKWTGMCGELAGDERATLLLLGMGLDEFSMSAISIPRIKKIIRNTRYEDAKALAEQALSQSTAKGLIALVDTFIKEKTLC

SEQ ID NO: 17437 - protein, 337 aa, Oryza sativa Japonica Group
MADVGGRARAPKMATMAAGVALHLHLQGMKVKAIRVHKIGGPEVLTWEEVEIGEPSEGEIRIKNKAIGVNYVDIYYRTGLHQEPLPFVPGKEAVGVVSAVGPGVTGIEVGDVVGYADTPMGTYTEEQIIPATLAIPIPPSVDHITAASVLLKGMTTYVLVKQAFKWANALGATVIGTVSTQEKAIQAAEDGCHHVIIYTEEDFVAQVAEITSRKGVHVVYDAVGKDTFKGSMECLMPRGCMISYGQCSGRPDPVPVSDLASKSLILGRPGMRHYTATRDELLHAAGEVFAGVAAGVLRVRVNHVYPLHEAARAHADLEARRTSGSVVLLPAMPAADS

SEQ ID NO: 17438 - protein, 177 aa, uncultured bacterium
MTFDLKDTIRTIPDYPKQGIMFRDITTLLGDARAFRRAIDELVQPWAGTKIDKVAGIEARGFILGGAVAHQLSAGFVPIRKKGKLPYTKVSIAYSLEYGLDEMEMHKDAVAPGERVILVDDLIATGGSAEGAVGLLKKIGADVVAACFVIDLPDLDGAKKIKALGVPVRTLMSFGGH

SEQ ID NO: 17439 - protein, 435 aa, Oryza sativa
MKNTSSLCLLLLVVLCSLTCNSGQAQVLFQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDRLDWGPGMICSDDTQYSEGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAPGMIGWLPEKAVTFVDNHDTGSTQKLWPFPSDKVMQGYAYILTHPGVPCIFYDHMFDWNLKQEITALAAIRERNGINAGSKLRIVVADADAYVAVVDEKVMVKIGTRYDVGNAVPSDFHQTVHGKDYSVWEKGSLRVPAGRHL

SEQ ID NO: 17440 - protein, 348 aa, Oryza sativa Japonica Group
MAEARTIGSISVPNVQELAGTCNGIDEEIPERYIRPEVSSDEVIKNNHGDMSIPIIDLDKLISPQSSQEECVKLISACQYWGFFQLINHGVPDEVIANLKNDLVEFFSQPLDAKKEYSQLPNNLEGYGQAFVVSDNQKLDWADMLYLQVCPTDSRDLRFWPNYPASFRDRKYWTLPAAIHAKAVGVEPKSLLSVFEGQARGLRMNYYPPCLKADKVLGLSPHTDPGGLTLLLQVNDVQGLQINKDGKWFSVNALNGALIVNIGDTLEILSNGKFRSVEHRAVVHPSRERISAALFYYPCQDMVISPLPDFVKDGKVKYKTISYQDLLTEYFTAELDGRNRLKKMKLEP

SEQ ID NO: 17441 - protein, 437 aa, Oryza sativa
MGKHHVTLCCVVFAVLCLASSLAQAQVLFQGFNWESWRKQGGWYNFLHEKVEEIASTGATHVWLPPPSHSVSPQGYMPGRLYDLDASKYGTEAELKSLIEAFHDKNVECLADIVINHRCADYKDSRGVYCVFEGGTPDGRLDWGPDMICSDDTQYSNGRGHRDTGAGFGAAPDIDHLNPRVQRELTDWLNWLRTDLGFDGWRLDFAKGYSAPLARIYVDNTNPTFVVGEIWSSLIYNGDGKPSTNQDADRQELVNWVEGVGKPATAFDFTTKGILQAAVQGELWRLHDGNGKAPGLMGWMPDQAVTFVDNHDTGSTQSLWPFPSDKVMQGYAYILTHPGIPCIFYDHVFDWNLQHEIATLAEIRSRNGIHAESTLDILKAEGDIYVAMIDGKVITKLGPRYDAGGIIPSDFHVVAHGNDYCVWEKEGFRVPAGRKHY

SEQ ID NO: 17442 - protein, 145 aa, Pseudomonas putida GB-1
MKTVEQILKTKSQHQTVYTIGPDDSVLDALKMLAEKNVGALPVVEGNQVVGIVSERDYARKLVLKGRSSAATPVREIMSAPVVTVEPKQKLDFCMNLMTDRHLRHLPVVDNGKLLGLLSIGDLVKETIAEQASLIQQMEQYIRGE

SEQ ID NO: 17443 - protein, 198 aa, Salmonella enterica subsp. enterica serovar Typhi str. CT18
MSYYAFEGLIPVVHPDAFVHPSAVLIGDVIVGAGVYIGPLASLRGDYGRLILEAGSNLQDGCIMHGYCDTDTIVHENGHIGHGAILHGCVVGRDALVGMNSVIMDGAVIGEESIVAAMSFVKAGFQGEARQLLVGSPARVLRQVTDQELYWKRLNTKEYQDLAIRCRTGLSETKPLTQVEENRPRLKGTTDVKPKSAQ

SEQ ID NO: 17444 - protein, 120 aa, Malus x domestica
DIVTGPFEKFIQVTTILPLTGQQYSDKVSENCLVFWKSVGIYTDAEGKAIEKFLEVFKDQNFPPGASILFTQSPKGSLTISFSRDASVPEAANVVIENKLLSEAVLESIVGKHGVSPGSK

SEQ ID NO: 17445 - protein, 464 aa, Physcomitrella patens subsp. patens
MAMERALMRLVRAQALRASSSIGVLQRGPVGSASPLQQVREYVVSSSPSDGVSRTDLSESFISVRQPVWQQWIRRYAAGSGEPGVVVVPFMGESIEDGSLAAILKQPGDAVAVDEIIAQIETDKVTIDVRSDVAGKIEEILCKEGDTVKAGTQLARVAVGEAGATSDAPKKEAAPAPPVKEEEKSAPPLPPKTATASSASPNKDAPSPPKQSSPEPAQPKSISGTEVHMPTKGGERRVPMTRLRKRVATRLKDSQNTFALLTTFNEIDMSNLMQMRTQHKDLFQEKHGVKLGFMSGFVKAAVSALKQFPAVNAVIDGDDIIYRDYVDISIAVGTAKGLVVPVIRGADHLNFAQIEKTINTLGKKANDGSISIDDMAGGTFTISNGGVYGSLISTPIINPPQSAILGMHSIQKRPVVAGNDIVVKPMMYVALTYDHRLIDGREAVLFLRAVKDNVEDPRRLLLDI

SEQ ID NO: 17446 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 17447 - protein, 495 aa, Aspergillus oryzae
MASITVTGAAGRQIQVPTGLFIHNEFVPSTTSQTLTVENPSTGESLGTISAASPEDVNKAVESATIGFNVWKNTSGPARAKLLLKLADLIERDADDFASLEAVDAGVLYTDSKGMNIPQAVGNLRYYAGWADKIDGKTLAMEGGVAFTYREPLGVCGAIVPWNAPLMITIWKLAPALAAGNSLIIKPSELSPLYAQKLALLIQEAGFPAGVVNIISGDGASAGRALAEHMTVRKISFTGSSATGRQILKTAASTNLKRVNLELGGKGPSIVFDDCDLDNAVLWTRIGITANNGQICAAGSRIYVQKTIYEKFLEAYKKMAEGSPSVIGNPLDPATTKGPIVSAAQHNKILSYIEQGKQCGARLLFGGEKVGDKGYFVENTAFADVSENATIMKEEIFGPVASIAPFETEAEVIAKANDTLHGLSAAVFTNDISRAHRVTAALESGQVTVNAWAMLSPNAPFGGVKESGFGRDMGEEALEGWTSVKSVNWTLDFLG

SEQ ID NO: 17448 - protein, 120 aa, Malus x domestica
DIVTGPFEKFIQVTTILPLTGQQYSDKVSENCVAFWKSIGIYTDAEGKAIEKFLEVFKDQNFPPSASILFTQSPKGSLTISFSRDASVPEAANTVIENHLLSQAVLESIVGMHGVSPGSK

SEQ ID NO: 17449 - protein, 996 aa, Oryza sativa Japonica Group
MRIRGDGGGDEEEAAMAVVSAPPQHLVFAYYITGHGFGHATRALEVVRHLIAAGHDVHVVTGAPEFVFTTEISSPNLHIRKVLLDCGAVQADALTVDRLASLEKYHQTAVMPRESILRTEVEWLNTIKADLVVSDVVPVACRAAADAGIRSVCVTNFSWDFIYAEYVVVAGHHHRSIVWQIAEDYSHCEFLLRLPGYCPMPAFRDVIDVPLVVRRLHKSRSEVRKELGIKDDVKVVIFNFGGQPAGWKLKKEWLPDGWLCLVCGASETQELPPNFIKLAKDAYTPDLMAASDCMLGKIGYGTVSEALAYKLPFVFVRRDYFNEEPFLRNMLEHYQCGVEMVRRDLLTGHWKPYLQRAMTLHPCYDGPINGGEVAAHILQDTAVGKKYISGKLSGARRLRDAIVLGYQLQRAPGRDVGIPDWYSVSEKEIGVRPAPTYHEVNGSAESSFEDFEILHGDIQGLTDTMAFLTSLSGLVGNDPRSPEKQSRERVAASVFFDWEEEIYVARAPGRLDVMGGIADYSGSLVLQMPIREACHVAIQRSNPMKQKLWKHTQARQLANGRAVPLLQIVSFGSELSNRAPTFDMDLSDFMDGDKPISYDKAKEYFSQDPSQKWAAYVAGTILVLMTELGVVFTDSMSILVSSSVPEGKGVSSSASVEVASMSAIAAAYGLNIPPRDLAILCQKVENRIVGAPCGVMDQMTSACGEANKLLAMICQPAEVKELVSIPTHIRFWGLDSGIRHSVGGTDYGSVRVGTYMGRKMIKCAASDLLSESLPSCPPIQSGNTNSDEYEEHGVDLLKSEASLEYLCNLPPHRYEAVYARDIPEIITGDAFLEKYGDHNDAVTTVDPKRSYCVKAPTRHPIYENFRVEAFKALLTAAKTVEQLSALGELMYQCHYSYNACGLGSDGTDRLVNMVQEVQHRKTSQDGGPSLFGAKITGGGSGGSVCVIGKNCLKSSEEIFEIQKRYKAATGYLPIVFEGSSPGAGKFGYLKIRRRST

SEQ ID NO: 17450 - protein, 439 aa, Arabidopsis thaliana
MTSKAAWEPEHDEVFVDLCVEQKMLGNQPEMQHILEAFQEMGVRFTIDQLINHWDTMIKQWKIWCRLVQCKDIKWDSLTNTFGATDQEWANYLEVNPEAGQYRCNPPLFLEKLEIIFAGMNLDGEGTSSGSKMKQICEHRDEENVTGYVPRLSASDIATRRHYKWSPSSHAIVVDTCFQESLKGIRPIKRNHLFTKESWKMILEKINRITGLGYTHKQLENHFTRTRTSWKHWCETIASPIMKWDANTRKFGATEEDWDKYLMINKRARVFKRRHIPHADKLATIFKGRIEPGKTKTRRYRKRVIDHHSESPQLHDHQPTPSSVVVNTNEPVKGSDDRAEDGNVEPTSLIRSDSEDVAETVTPEMMEKIPVNASVKKKEKFTFEECVECLDAIEEVEKGGDLYMFALDLFKTKDYRYLFLMLQKSSLRMAWLLKLLSNP

SEQ ID NO: 17451 - protein, 571 aa, Leuconostoc mesenteroides
MTKNFKGIAASNGVAIAKAYLLVDPDLSFEKTTVTNVAAEQARVDDALKASSDDVKLIKAKATESLGATEAEVFEAHLMVLADPEMSGAIKQKIEDDKVNAEQAVKEVTDMYISMFDAMTDNEYMQERAADIRDVTKRILSHLLNISLPNPALIDEEVVLVSKDLTPSDTAQLDRQFVKGILTDLGGRTAHASIMARTLEIPAVVGSEKATVEVSSGDLVIVDGLTGDVIVNPDADTLATYQKKAADYFAQRAEWAKLKDEKSVSADGKEFIVGANIGAPKDMQAVLDNGSEGVGLYRTEFLYMESDHLPTEDEQFEAYKSVVEQMGDKPVTVRTMDIGGDKHLDYWKLPEEENPFLGYRAIRISLDQTDIFRTQLRALIRASAFGNLWIMFPMIATLSEFRAAKKIYLEEREKLEKAGVATGEVKLGIMIEIPAAAILADKFAKEVDFFSIGTNDLIAYTMAADRGNDRVAYLYQPYNPSILRLINTVISAAHKEGKFVAMCGEMAGDPVAVPLLVGMGLDEFSMSAPSVLQTRSLMKKLNTADMKVLAEKALDVETNDEVIELVKEATK

SEQ ID NO: 17452 - protein, 120 aa, Malus x domestica
DIVTGPFEKFIQVTTILPLTGQQYSDKVSENCVAFWKSIGIYTDAEGKAIEKFLEVFKDQNFPPGASILFTQSPKGSLTISFSRDASVPKAANTVIENKLLSEAVLESIVGMHGVSPGSK

SEQ ID NO: 17453 - protein, 648 aa, Ashbya gossypii ATCC 10895
MSDSSGKQQGIISPHVTNAVKRANLEGCLTPGAGPGHGASGIGSPGPSVSACVSPTQAVTKSIMNASGTSGAVVSNTPEPGLKRVPTVTFSDPKQLPAKQSGTGQGGRVISGDSTTSGATASEDTDTQSHLQMKVASPIHHPTAQHSTPPPLLSHGGGNGAAAVGMSHIRSTSPTSGSEVHPPKQAVGNIVHKLLHQFDGSGAGTPTSDVEKLHLHDEHPHFFVSDPLHTSPTVLRSRSNSISPKPISVLSETKPADILNLDSAIESTQQQQIAPNIPKRDPGKNVDPRLPQDDGKLHVLFGATGSLSVLKIKSMIKKLEEIYGWDHISIQVILTQAAAQFFANKNPKKKNLYVSSETNSFSNSVAHQGNLQQNNSDASYTAVNSVSNTPAVGGRTPTPADLLQGAAPQGAGSGLSQGAAAAKIELPPHIQVWTDQDEWDVWKQRTDPVLHIELRRWADILVVAPLTANTLSKIALGLCDNLLTSVIRAWNPMFPIFLAPSMVSGSYNSTITKRHLKMIKEEMPWITVFKPSEKIMGIHGDIGLGGMMDGNEIVDKVVMKLGGYPKDADEDDDEDDKAGKTNGKEDDDDDDEEELDEDDEDDDDDDDDDDDDDDDDDDDDDDDDDDSSQSPLKNAAATSPSHSSTAHT

SEQ ID NO: 17454 - protein, 275 aa, Vitis vinifera
MQPGPQVPSQNPHAIPLDPVQPMQFPPQPGHGNLSHTTHSSGQHLQSNPVQYPAQQAQFIPEHRQTNVACHAHQPTYNPAQPVPASYHVQSTNFQPSPAAMQYVPVHQTHATMVVPLQQTAPVIMVQSQPRVTTVGTEAWTTGLFDCMDDPTNALVTCCVPCLTFGQVAEIVDNGHTSCGTSALVYGAIACLIGCPFLISCTYRTKLRSRYGLVESPAPDWVVHCLCDFCALCQEYRELQNRGFDPSIGWHANVARHMQQQQVAMVVPPNQTMIG

SEQ ID NO: 17455 - protein, 617 aa, Oryza sativa Japonica Group
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVGMECSVYFTAALLQVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQGETGANVLVGIQVPPEEFDEFKSRADNLGYEYMSEQNNEIYRLLLRDPKI

SEQ ID NO: 17456 - protein, 102 aa, Oryza sativa
  misc_feature (43)..(43): Xaa can be any naturally occurring amino acid
MESGLVASHRLRVPFAAAHHRHHPAAPPHLLRQRRGSVAATPXFLGVETKTLKKIVPLGLMFFCILFNYTILRDTKDVLVVTAKGSSAEIIPFLKTWVNLPM

SEQ ID NO: 17457 - protein, 504 aa, Arabidopsis thaliana
MSILLCFLCLLPVFLVSLSILSKRLKPSKWKLPPGPKTLPIIGNLHNLTGLPHTCFRNLSQKFGPVMLLHFGFVPVVVISSKEGAEEALKTQDLECCSRPETVATRMISYNFKDIGFAPYGEEWKALRKLVVMELLNTKKFQSFRYIREEENDLLIKKLTESALKKSPVNLKKTLFTLVASIVCRLAFGVNIHKCEFVDEDNVADLVNKFEMLVAGVAFTDFFPGVGWLVDRISGQNKTLNNVFSELDTFFQNVLDDHIKPGRQVSENPDVVDVMLDLMKKQEKDGESFKLTTDHLKGIISDIFLAGVNTSAVTLNWAMAELIRNPRVMKKVQDEIRTTLGDKKQRITEQDLSQVHYFKLVVKEIFRLHPAAPLLLPRETMSHVKIQGYDIPVKTQMMINIYSIARDPKLWTNPDEFNPDRFLDSSIDYRGLNFELLPFGSGRRICPGMTLGITTVELGLLNLLYFFDWVVPVGKNVKDINLEETGSIIISKKTTLELVPLVHH

SEQ ID NO: 17458 - protein, 633 aa, Ashbya gossypii ATCC 10895
MLWNSQVCQNGRASPWGFIRLICSVSLFSVLVREGAALYIQPQKARLNGGNTHNIDIGPLNRSATLTPAAYYRKVGVNGAISSDLELCNRMTVHDILLGIPGANAADAAVTMSLCIGMINFFNSGIGGGGFAVYTDGQDPERHLAFDFREMAPELAHKEMYASDPNASKIGGLAIAIPGELAGLYEMYEKRGSGVARWEELLRPVIELGFQGWAVGPALAASLQEYEAYFKAHLDDWSFVYNHKEGRVLRAGEWISRPELAKTLQNLAASGGVKPFYDAESDLVKTMVNKIQSAGGVLSESDFENYEVDVTRPLSLKIRSSWEYLPNNDLTVLTTSGSSSGAALLSALKILDQFPNKEDGDFQPEQAYQLIEAMKWMASARSRLGDFGGGEELAPQVRDVLGDAWTDYAVNLIKAGYIDGHFGTLVDWHDYLPEYELNDPHGTAHISIVDHFNNAVSLTTTVNLLFGSLVHDPSTGIVFNNEMDDFSQPGRPNAFGLQPSRYNFPEPFKRPLSSTCPTVVLNDVGLPDLVVGAAGGSRILTSVLQLIVRTYWYNMPLLEAVAYPRIHHQLLPEVLEVESLALLGPDTVDAIRRMGHSIVEVTPKSVVNAIRHWHGTWHAVSDYWRKRGISVAY

SEQ ID NO: 17459 - protein, 267 aa, Dehalococcoides sp. VS
MKIAFIGGGNMGEAILGALIQKNICPPQDITVSEIKAERRAFLENTYGIKTTPSNPEAIKNTEVVLLAIKPQNLAELSAGLKGKLAETQLVISIIAGATLSKLSSGLGHKAVVRVMPNTPAMIGMGMSIWTALPAVNPTQKEQAKSILYAMGKEIYTDKENMLDAATAISGSGPAYFFLFMESLEKAALEMGFTPEEATVLVSQTAAGSAVYAGKSGLPLAQLRKNVTSPGGTTAEAIKVFEEAGLETTVIKAAKAAFDRSVELGKG

SEQ ID NO: 17460 - protein, 472 aa, Dunaliella salina
MASRSEESINYEAAGNNSLYNSFLVCGSVFECLSRYSPLKPIGKGAYGVVCSARDSETNQKVAIKKISNAFENLVDAKRTLREIKLVRHLNHENVVQIMDLIPPMVHSNFKDLYVVYELMDTDLHQIIRSPQPLSDDHCQYFLYQVLRGLKYIHSAAILHRDLKPSNLLVNANCDLKICDFGLARSTSSSRVEFMTEYVVTRWYRAPELLLSCSEYGTAIDVWSVGCIFAELLGRKPLFPGKDYVHQLNLITRVIGSPAESELGFISSDKARRYIRSLPRAEPADFMRMWPNANPKAVDLVKKMLMFDPNKRITVEEALAHEYLATLHDISDEPVCANPFNFDLESDDLTPDVVRGIILKDMAALHPSQADGINAAASACLCGASPAQQQEQQATTIPQGAMQQQQQQQEGESSSSKAGPQQQQQQQQQQHEHEQYQKQVPRKEEEKTDGLGGEQGEGMAASSADRGSHSGN

SEQ ID NO: 17461 - protein, 501 aa, Glycine max
MTSLTNGDAGSLNKVPTIKFTKLFINGDFVDSLSGKTFETIDPRTGDVIARISEGDKEDIDIAVKAARHAFDNGPWPRLPGSERARILLKWAEIIEENAEELAALDAIDAGKLYHMCRNVEVPAAANTLRYYAGAADKIHGEVLKMSREFHAYTLLEPLGVVGHITPWNFPNTMFYIKVAPSLAAGCTMVLKPAEQTPLSALFSAHLAKLAGIPDGVINVVPGFGPTAGAALSSHMDVDKVSFTGSTQTGRVIMQAAAKSNLKQVSLELGGKSPLIIFDDADIDKATELALLGILYNKGEVCVASSRVFVQEGIYDEFEKKLVEKAKAWVVGDPFDPKVQQGPQVDKEQFEKVLSYIEHGKKEGATLLTGGKTVGNKGYFIEPTIFSNIREDMLIAQDEIFGPVMALKKFKTTEEAIKSANNTKYGLAAGIVTKNLDTANTVSRSIRAGTIWINCYFAFGDDVPFGGYKMSGFGKDHGLEALHKYLQVKSVVTPLYNSPWL

SEQ ID NO: 17462 - protein, 199 aa, Microcystis aeruginosa PCC 7806
MTAEGCLRVGQAAPDFTATAVFDQEFKTIKLSDYRGKYVVLFFYPLDFTFVCPTEITAFSDRVSEFSSINTQILGVSVDSEFAHLAWIQTERKSGGVGDVAYPLVSDLKKEISTAYNVLDPDAGVSLRGLFIIDKEGVIQHATINNLSFGRSVDETLRTLKAIQYVQSHPDEVCPAGWQEGDATMVPDPVKSKVYFAAV

SEQ ID NO: 17463 - protein, 368 aa, Ureaplasma parvum serovar 3 str. ATCC 700970
MSLSAGLVGLPNVGKSTLFNTITNSRVEAANYPFATIEPNIGIVNINDPRLKRLASLVVPDKIVPTTFKFVDIAGLVKGASQGEGLGNQFLNNIRDVDAICHVVRCFDDKSITHVHNKIDALSDIHVINYELILSDLDIIEKRISRIKKKADSGDKDARREYLILFNIEEALKKGQLASSVKLTKEELKIINSFNLITLKPILYIANISENEISNPDLNKEYLKVKKYAQDNDARCVALSAKIEYEISILDEESKSIFIQDLGIKTTGLDEIVKQTYDLLNLKTYFTYGKQEVRAWTFINGMSAPECAGIIHSDFEKGFIKAEIMHYDDLISLGSEQAVKEAGKIRMEGKSYLMKDGDICNFRFNVTK

SEQ ID NO: 17464 - protein, 120 aa, Eucommia ulmoides
DMFHWQATIMGPPDSPYTGGVFLVTIHFPPDYPFKPPKVAFRTKVFHPNINSNGSICLDILKEQWSPALTISKVLLSICSLLTDPNPDDPLVPEIAHMYKTDKHKYETTARSWTQKYAMG

SEQ ID NO: 17465 - protein, 317 aa, Photorhabdus luminescens subsp. laumondii TTO1
MNKIYEDNSLTIGRTPLIRLKHFGNGRILAKVESRNPSFSVKCRIGSNMIWDAEKHGILQPGKELVEPTSGNTGIALAYVAAARGYKLTLTMPETMSIERRKLLKALGAQLVLTEGAKGMKGAIEKANEIKASDPDRYIILQQFSNPANPEIHEKTTGPEIWEDTDGEVDVFVTGVGTGGTLTGVARYLKNTKGKNITTVAVEPEESPVISQTLAGEEVKPGPHKIQGIGAGFIPDNLDLTLVDRVFKISSEEAIKTAREIMVKEGILAGISSGAAVAAAVKLSQEPEYKDKNIVVILASSGERYLSSVLFADLSDE

SEQ ID NO: 17466 - protein, 439 aa, Glycine max
MPETESAAAAAVEEENNTALFGKYEVGRLLGCGAFAKVYHARNTETGQSVAVKVISKKKLNSSGLASNVKREISIMSRLHHPNIVKLHEVLATKTKIYFILEFAKGGELFARIAKSRFSEDLARRYFQQLISAVGYCHARGVFHRDLKPENLLLDEQGNLKVSDFGLSAVKDQIGVDGLLHTLCGTPAYVAPEILAKKGYDGAKVDVWSCGIILFVLVAGYLPFNDPNLMVMYKKIYKGEFRCPRWFSMELRRILTRLLDTNPDTRITVDEIMKDTWFKKGYKEVKFGDLGLEWKSEGEGVKDLNAFDIISFSTGLNLSGLFDSSCGVEEGERFLLRESPEKVVEMLVAAAEKEGVVVRMRKECGVELEGCGGNFAALVEVYRLPGELVVVEVRRRDGDGGVFRDVWRNKLRPCLCAASSSTTSDRDGTTLAQPVAGDS

SEQ ID NO: 17467 - protein, 358 aa, Vitis vinifera
MELNLAPKFAQKIFEGEGGTYYRWSSAEYELLKEAKVGGGRLVLQPRGFALPHYADSNRIGYVLQGSCGVVGMVSPNASQEVVLRLKKGDIIPVPSGAVSWWYNDGDSELIIVFLGETSKAYVPGEFTYFLLTGTQGILGGFSTEFNSRAYDINNEEAKKLAKSQSGLLLIKLPEGHKMPHPCKNSPDKLVFNIDAALPDIHVQNAGLLTALTAKKFPFLGEVGLSATLVKLDANAMSSPVYAADSSVQVIYVAKGSGRIQVVGINGERALDRKVKAGHLFVVPRFFVAAAIADGEGMEYFSMITTTQPVFGEFTGKTSVWGALSPQVLQASLNVGPEFEQLFRAKIKKSTILVPPQN

SEQ ID NO: 17468 - protein, 184 aa, Brassica napus
GSGIPGDGHYGAGTWGVNEEQLQEAFGGEDFSACMRVNYYPKCPRPEPALGLSPHSDPGGITILLPDDQVAGLQVHHGDTWITVNALPNAFVVNLGDQMQILSNSIYKSSEHRVIVNSQKERVSLAFFYNPKSDIPIQPLEQLISSTNPPLYPPMSYDQYRLFIRTHGPRGKSYVESHVSLVNG

SEQ ID NO: 17469 - protein, 180 aa, Glycine max
MASTDKPGGDPEYRTSSTPAPAGVDYFKFDVILRFLLFAASLVAVVVIVTANQTEVIRVPQPVPWPAKFRYSPAFVIITTLASLFASNKPALKTKLLLYFILWDALILGIIASATGTAGGVAYLGLKGNRHVVGWNKICHVYDKFCRHVGASIAVALFGSVVTVLLIWLSAYSIHSRVPK

SEQ ID NO: 17470 - protein, 475 aa, Mycoplasma mycoides subsp. mycoides SC str. PG1
MVSKNTTDKKKNQSIGKVIQVLGSVVDVKFSENSIPKIYDALIVDNNGKKLVLEVEQNIGDEIVRTIAMGPTEGLKRGLDVINTNSPITAPTGMEVLGRMFNVLGDPIDEKPDLDVKREPIHKDAPKYEELVTTTEILETGIKVIDLMIPFTKGGKVGLFGGAGVGKTILIQELINNIAKAHNGVSVFAGVGERTREGNDLYHEFIEAGVLNKTCLVFGQMNEPPGARMRVALTGLTIAEYFRDQKNMDVLLFIDNIFRFTQAGSEVSALLGRMPSAVGYQPTLSTEMGSLQERITSTKNGSITSVQAVYVPADDLTDPAPATTFTHLDARIVLDRSIASLGIYPAVDPLASSSRVLDPEIVGQEHYDIALRVQIALQKYQDLQSIIAILGMDELSEEDKLIVQRARKIRNFLSQSFFVGEKFTGRPGVFVKVNDTVRSFKSILDGEVDYIPETYFLYSSIIDDVIEKYNKDKDK

SEQ ID NO: 17471 - protein, 187 aa, Zea mays
MENSSHKRAREAGDLVAGGCGEEGSPQADAKRLRPQDLLDMLEDDTDAAAAGDLASVMRSLEEEIASFDEAAEAPAPAPELGFLLEASDDELGLPPASSSEEEEAGRAGAPFPPALDGQIWGFEDEIVDGGGFGGYSPEAAAAAAASAAAAAWDDDGFGAGLFAFGGDDACGPSDLAALRHETMPAV

SEQ ID NO: 17472 - protein, 165 aa, Avicennia marina
MVSTFSGDETAPFFGFLGAASALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 17473 - protein, 696 aa, Pseudomonas putida GB-1
MPAARLRTTAGRHRHLALAAQGTRLPRRAWHTGPGRNSTGRCAWFHSRYGPRKLVDSATIMIRLSNLTLQRGPQRLLEGAEMTLHAGHKAGLIGANGAGKSSLFALLRGELSPDAGDCQLPGDWRIAHMRQEVDTLDRLAVDYVLDGDVRLRKVQAELAAAEQAHDGTALARLHSELESADGYTADARARKLLAGLGFTNEQMDRRVGDFSGGWRMRLNLAQALMCPSDLLLLDEPTNHLDLDAILWLEDWLKGYPGTLLLISHDRDFLDAVVDHVLHVEQRKLNLYKGGYTAFERTRAERLAQQQQAYEKQQAQRAHMEKYIARFKAQATKARQAQSRIKALERMEELSAAHVDSPFDFVFRESQKISSPLLSLSEGCLGYGDKAILEKVKLQLTPGARIGLLGPNGAGKSTLIKNLAGELEPLSGRLVRGENLAVGYFAQHQLDSLDDKASPLLHLQRIAPTEREQTLRDFLGGFDFHGARCDEPVVNFSGGEKARLALALIAWERPNLLLLDEPTNHLDLEMRLALTMALQEFAGAVVVVSHDRHLLKSTTDDFLLVADGKVDTFDGDLEDYSRWLVEYRQRSAPASTAPVNPDKTDKKAQRQAAAALRQQLAPHKKAADKLETELNQVHVQLAEIETALGDGGLYEAARKDELRDLLARQTKLKQREGELEEAWMEALETLESMQAELEALS

SEQ ID NO: 17474 - protein, 320 aa, Vitis vinifera
MKLSSKTMSSPGRTEKFPPPLMRFLRSNVGSRSRGRSRSSPMFVRKKNTAIETQEPSSPKVTCIGQVRVRRSKQGSGKATKARKKTRGWCRWIRNALCCNHFVGRLKPKPFRPVWRKWVLFFRVRFRRKSEIREDSSRIESKLEDRVEESEQSDDVGNEEEEARVFYSSSFSPPKNALLLTRCRSAPYRSSSLASRFWGSPLATEEEQKTEPENTDQQNPASENEPSSRDSAAESRTDPETDRDSEYLNQSEDSTSERSTKPTKTEAFKTGEEATAHPLILTRCKSEPARTGARLNPDTTLFWKKRRLGFAEPRSPSVCD

SEQ ID NO: 17475 - protein, 123 aa, Prochlorococcus marinus str. NATL2A
MSNIMVNSLSKSAIHLESLIMVDSANQTDGDTAVIDREVQRVRKISPKYKVLLHNDPVNTMDYVVEILRQVVPQLSEQDALNIMLETHNNGVGLVITCDLEPAEFYSESLKAKGLTSTIELES

SEQ ID NO: 17476 - protein, 331 aa, Triticum aestivum
  misc_feature (185)..(185): Xaa can be any naturally occurring amino acid
  misc_feature (215)..(215): Xaa can be any naturally occurring amino acid
AYLGDTIEQVCTKKQAGTGPEFPGYRRPTRPALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAXFKSIMSSAPIPMSPLESLASSAVRTANSAXKATLILVLTRGGTTARLVAKYRPSMPILSVVVPELKTVEFDWICSDEGPARQSLIVRGVIPMLSAGTAKAFDSEATEEALRFAMKNAKEMGLCNAGESIVALHRIGNASVIKLLTV

SEQ ID NO: 17477 - protein, 408 aa, Prochlorococcus marinus str. NATL2A
MVKVNADYLKLKAGYLFPEISRRITEFSSKNPNADLIRLGIGDVTEPLPLACREAMKAAIEEMGTKDGFRGYGPEQGYKWLREIISENDYISRGCEISAEEIFVSDGSKCDSSNILDILGKENKIAVTDPVYPVYVDTNVMTGRTGEANSVGEYKGLSYIPINSENGFEASIPKDKFDLIYLCFPNNPTGAVATKEQLVSWVKYAKENNSLILFDAAYEAFIKDESIPHSIFEIEGARDCAIEFRSFSKNAGFTGTRCAFTVIPKSLKGKAGIETVDLWSLWNRRQSTKFNGVSYVVQRGAEAVYSKEGKTQIKKLVSFYMDNAEIIKSNLTAAGFEVFGAVNAPYAWIKTPKDMSSWDFFDFLLEKANVVGTPGSGFGAAGEGYFRLSAFNSRENVEKAMQRIVKLK

SEQ ID NO: 17478 - protein, 348 aa, uncultured bacterium
MPHVMFGGLVHEPALNLARRLVGLLPEGLSHVFFCDSGSVAVEVAMKIAVQFWLNKGITQRSRFLAFKGGYHGDTFATMSVCDPEEGMHGLFAKVLPQQITAELPADADQAQAFDALLERHAQELAGIVVEPLVQGAGGMLFHDARVLRHLRAAADRRGLLLIFDEIFTGFGRTGTMFACEAADVVPDIITLSKALTGGTMGLGATIATKKVFDAFLSDAPNHALMHGPTFMANPLACAAANASLDLFAREPRLDQVAAISKVLARALEPARALPHVRDVRVKGAIAVVELDRIDGLDALRRRFIEAGVFVRPIRNIVYLTPAFTIGEEDLERLTGAVLSVLEDWTRF

SEQ ID NO: 17479 - protein, 256 aa, Sinorhizobium meliloti 1021
MTPDIRPLVAGNWKMNGTRASLDQIKAMAEGVKGDLSARVDALICPPATLLYVATALCDDSPLMIGAQDCHQKQSGAHTGEVSAEMVADCFGTHVIVGHSERRTDHGEGDALVRAKTEAAHGADLVAIVCVGETEEERKAGRTLDILKRQLSESLPDQATAENTVIAYEPVWAIGTGLTPTVSDVEEAHAFMRRELVSRFGAEGGKMRILYGGSVKPSNAKELMGVANVDGALIGGASLKADDFLAIYRAYEELTA

SEQ ID NO: 17480 - protein, 276 aa, Prochlorococcus marinus str. NATL2A
MLTRVAYLGPKGTYAEQAAKALAELEKLDSPVFSPCKGLRSVVDNLANNLCEAAVVPIENSVEGGVTTTLDSLWRHENLFIHRALVLPIKHSLMSSGSISKISEVLSHPQAIAQCSQWLNDNIPNAVHLPTNSTAEAIRMVRGSLFRAAIGSKDASEDLNILAYPINDIEGNCTRFVLLSKNNIKVDGNKASMAFSLKSNSPGALLKALNCIANLGLNMSRIESRPSKRELGEYVFFIDLDLNNNNKKDFENITKELSPLCNQIINFGCYFGSEVD

SEQ ID NO: 17481 - protein, 371 aa, Physcomitrella patens subsp. patens
MAGLGPDWKGLLKWSIANSDGTADPRELSEQDRQFFAEAMQSQTVDVIKRMKEISMVMNLTVEDLETQGITVEELEGMLEELQEHVESIDMANDLHSIGGLVPLLDYLKNPNADIRSRAAEVVSTIVQNNPKSQQQVIECNGLERLLVNFNFDDNIKVRTKALGAISSLIRHNKVATDAFRLSNGYAGLRQALASEDLRFQRKALQVIQYLLQENPKDCIVATQLGFLKSLTSLANSSDLDVRQAALQSLVEIVRNQENQNVGKTDGTTQLKDVVGKRVEEIKGLNQEDLAAVKEERQLVDTLWQLLYKEPSQLRQEGLLVLPEDNQPPPDVAGRKHASGLRSLAANVPPEPPSRQNVSQDEKKPVLLLGA

SEQ ID NO: 17482 - protein, 67 aa, Triticum aestivum
RGIAEYRAQMKAKFQRKVAKSSGDSGANVKRLKEESSLKIEQVNRQPASISPDVIQMLLRHVPSVKN

SEQ ID NO: 17483 - protein, 424 aa, Sinorhizobium meliloti 1021
MTAIIDIIGREILDSRGNPTVEVDVHLEDGSFGRAAVPSGASTGAHEAVELRDGGTRYLGKGVERAVDAVNGEIFEAIGGLDAENQIQIDRTMIELDGTPNKSRLGANAILGVSLAVAKAAAEASGLPLYRYVGGPNAHLLPVPMMNIINGGAHADNPIDFQEFMIMPVGAETLKDAVRMGSEVFHTLKKQLAADGHNTNVGDEGGFAPGLASAPAALDFIMKSIEKAGYKPGEDMYVALDCASTEFFKDGKYVLEGEGRTLEPGAMAEYLAELAGKYPIISIEDGMAEDDWDGWKSLTDLVGNKCQLVGDDLFVTNSARLRDGIKMGVANSILVKVNQIGSLSETLDAVETAHKARYTAVMSHRSGETEDSTIADLAVATNCGQIKTGSLARSDRLAKYNQLIRIEEQLGPQAQYAGRSVLRG

SEQ ID NO: 17484 - protein, 444 aa, Caulobacter crescentus CB15
MRSLIAAVERIDPLTIYGRVAAVNGLLIEVRGGLTRLAVGARVEIERFGQKPLPAEVVGFRETRALLMPFGPVEGVGPGAEIRIVPEGAVVRPTKAWLGRIINAFGEPIDGLGPLPQGEVPYPLKTPPPPAHARGRVGERLDLGVRSMNVFTTTCRGQRLGIFAGSGVGKSVLLSMLAKEATCDAVVVGLIGERGREVREFVEETLGEEGLRRAVVVVATSDEPALTRRQAAYMTLAISEFMRDQDQEVLCLMDSVTRFAMAQREIGLAAGEPPTTKGYTPTVFTELPKLLERAGPGPIRPDGTTAAPITALFTVLVDGDDHNEPIADATRGILDGHIVMERAIAERGRFPAINVLKSISRTMPGCQHPHERDIVKGARQVMSAYSNMEELIRIGAYRAGADPVVDRAIRLNPAIEAFLSQDKEEATSLDDSFGMLGQILQSEY

SEQ ID NO: 17485 - protein, 390 aa, Dehalococcoides sp. VS
MKLSKRIENLPPYLFVQISKKIAEKRAKGEEVISFAIGDPDLPTPKHILAELCKAAEDPSNHRYPETEGMPVLRKAMAEWYKKRFGVKLNPDTEILPLIGSKEGIGHAAWCFLDPGDIALVPNPAYPVYAISSQLAGADVFNMPLNKENNFLPDFNTIPEDILLKAKVLWINYPNNPTGAVADLDFFKKAADFAAKHNLAVCHDGPYSEIAFDGYKPVSFLEAEGAKDVGIEFHSLSKSYNMTGWRIGMAVGNAKMIDALRRFKSNLDSGIPQAIQLMAIAALKGSQEVINHNCAVYQRRRDRLVKALHNIGMEVTAPKASLYIWAPVPEGYTSASFATELLDKTGVVVTPGTGYGTAGEGYIRLSLTVPDEQLEKGITKLSGYKRNTFS

SEQ ID NO: 17486 - protein, 256 aa, Zea mays
MAKDCPDKHKRNDHQSTLCIRCGETGHDMFGCANDYPPDDIEQIRCYACNQKGHLCCSDFFDNSLEQGCAKQRREASAVTTPTLCFKCGEEGHFARGCTKNAKSDGPKGWSSPHSQRKGRWKNDGKSPSHIRRKEKWKKDSSARSAPHDACTTSKSNSPSFEERMGASNHKSKWRGGWTGDDDLPSKKYKPNGWGSPATPKRSYTNHQYLSGGGDYFTPQSSRRHNHGTASPGARKHRFSSSIFAASNTHVRFKRS

SEQ ID NO: 17487 - protein, 251 aa, Dehalococcoides sp. VS
MRQIIIAGNWKMNTTLSEACILVQSMKGELETIDGIEKIVCPPFISLSHIKTILENSSIKLGAQNLFYEEKGAYTGEISPLMLKELCQYVIIGHSERREYFGETGQVVNQKIKAAIQAGILPIVCVGEKLEENEKGQTRQVLETQLKEALNGLSLSSIIIAYEPIWAIGTGKAATASAANAAICYIRKVLSEILGNTAARKSSILYGGSVNEKNTAELLSQSDIDGALVGGASLKADSFISICRQAAAISK

SEQ ID NO: 17488 - protein, 578 aa, Syntrichia ruralis
MGNSCVGAAGYFQGFTSVIALGGRSSRSPSEVSPTPSKAESRGGSRAEAESPETQRKPPRPAHIPAVEPAETQQFKEVIEAMKKGREMKPVPGQSLTHSVLQRKTENLRDLYVLGKKLGQGQFGTTYLCIEKATNREYACKSIAKRKLISKEDVDDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLTPQASKRLKAHQVLAHPWICEDGVAPDRPIDSAVQSRLKHFSAMNKLKKIAIRVIAESLSEEEIAGLKEMFKMMDTDNSGSISYEELKAGLKKVGSNLKEEDVRQLMDAADVDGSGAIDYGEFLAATLHLNKVERDENMFAAFSYLDKDNSGYLTVDELQHALAEFNMGDVSVEELLREVDQNNDGQIDYTEFVTMMRKGNMGGGAGRSSLRNSQQLSLTDVLGIGG

SEQ ID NO: 17489 - protein, 235 aa, Triticum aestivum
VFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 17490 - protein, 331 aa, Glycine max
MEAEKQHQFDVDLGNLMAFDSYHTFPSQPPLSREDLTRQCLLKGTHLVQAIADALFTLPSIEDVDGPLVTLPPPTTKLPREKHLPKPKPPTKWEAFAKKKGIQKRKKDKIVYDEQSGTWKRRHGYDRANDEDAIPIIEAKPTDDPEEDPFAKRKENKKNRIEKQEKNRLQNLKEAAKFGALPSHIQLAATALPITGTQAAPKKVTKDELGNVAGIAATATASGGKFDKKLAGEKPQKHEGKYRKFLPVVEGTGIGSLEREQTEKILNKIISKNSHNILNVEKAVTMHNVKKEKKRRSEKGKALASATDKKLKTQKKSFKKGDSKKGKAKGK

SEQ ID NO: 17491 - protein, 356 aa, Escherichia coli
MTTFHSLTVAKVEPETRDAVTITFAVPQPLQEAYRFRPGQHLTLKASFDGEELRRCYSICRSYLPGEISVAVKAIEGGRFSRYAREHIRQGMTLEVMVPQGHFGYQPQAERQGRYLAIAAGSGITPMLAIIATTLQTEPESQFTLIYGNRTSQSMMFRQALADLKDKYSQRLQLLCIFSQETLDSDLLHGRIDGEKLQSLGASLINFRLYDEAFICGPAAMMDETEAALKALGMPDKTIHLERFNTPGTRVKRSVNVQSDGQKVTVRQDGRDREIVLNADDESILDAALRQGADLPYACKGGVCATCKCKVLRGKVAMETNYSLEPDELAAGYVLSCQALPLTSDVVVDFDAKGMA

SEQ ID NO: 17492 - protein, 100 aa, Zea mays
  misc_feature (47)..(47): Xaa can be any naturally occurring amino acid
VAVSNRLDSGDFFCFGSQLPVNDELVWDNGTPFPEPCIDRLRPRHIXGKYEALAWLCGGLGFFAALGVAAVVNDKASKIPYTPKVYPYDNLRAELGDRPF

SEQ ID NO: 17493 - protein, 571 aa, Silicibacter sp. TM1040
MPDQRVKNWQSLSGDGAFDVVVVGGGVNGIGTYRELALQGLRVLLVERGDFASGCSAAPSRMIHGGLRYLENGEFDLVRESLQERDALLVNAPHFVHPLPTVIPVTSLFSGLFNAAASFWGLSSKPAPRGAVPIKLGLSLYDWVSRKRRLMPRHSFQGRRATRRDWPELMEEARGTATYHDAWIGFPERLCIEMLQDVARVAPGCVALNYCEIAAETGGFSVTCQRSGQTAEIRPRLIVNATGAWLDETVAQLGGTAPRMVEGTKGSHLILDHPELFAALKGNMVFFENDDGRVCIVFPFHDRVLAGSTDIRVARTGRVRCEPEETDYILGALAKVFPGLQIDASQIVFSYSGIRPLPQSDQDFTGRISRGHDIRKLEGRVPQLCMIGGKWTTFRAFAQQTADAALGELRHGRRVDTLDLAIGGGAKFEGREAQILQELCKVQNLSHARAGHLLQRYGSHAPKVAIACGREDRPLAAGTLYSEGEILHLIRSEFVETLSDLALRRTDLAISGVLSMQIIEALAALMAQETGLSPDLITAQKQDLIAELSTYHGVTAATLERRNTERNAQCA

SEQ ID NO: 17494 - protein, 988 aa, Arabidopsis thaliana
  misc_feature (103)..(103): Xaa can be any naturally occurring amino acid
MTSMIVKTTPELFKGNGVFRTDHLGENRMVSRSNRLGDGSNRFPRTGTIHCQRLSIAKTGLHRETKARAILSPVSDPAASIAQKILERNYHRSLGGTNISAIXTSIKTNKQKTMMQRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 17495 - protein, 355 aa, Thlaspi caerulescens
MKITQNVKLLVFFFFISLLFIAVSAGESKCKCSHEGDQKNKAGARKYKIAAIPCVLASGVIGVLFPLLGKYFPSLKPETNFFFVTKAFAAGVILATGFMHVLPEGYEKLTSPCLEGGAWEFPFTGFIAMVAAILTLSVDSFATSYFYRLHLKPSKKISDGEERSGGGGDELGLHVHAHGHAHGIVGVDSGGSEVQTHRSRVVAQVLEVGIIVHSVVIGISLGASQSPDTAKALFAALMFHQCFEGLGLGGCIAQGNFNRMWITIMSILFSVTTPIGIAVGMGIANSYDSSSSTALIMQGVLNSASAGILIYMSLVDFLAADFMHPKMQSNTGLQIMAHISLLVGAGIMSLLAKWA

SEQ ID NO: 17496 - protein, 288 aa, uncultured bacterium
MTVKKIAYQGEPGANSHIACVNVYPAWEALPCATFEDALAAVADGAAALGMIPIENSIAGRVADIHHLLPRSGLYIVAEYFLAIHFQLLGIKGARLDGVRSVYSHVHALGQCRIIIRARGLAAHVTGDTAGSAREVAEWRDPGRAAIATRLAAEIHGLDVLAADIEDEPHNTTRFVVLSKIPQWGKRADGPVVTSFVFRVRNVPAALYKALGGFATNGVNMTKLESYMVDGEFTATQFLADVEAHPEEPALARALEELAFFCKELKILGVYPAHPFRTESRMRERQGQ

SEQ ID NO: 17497 - protein, 764 aa, Arabidopsis thaliana
MAFHVACPITCRRICHCSLGFSRDLRGANAKHKFLKEVIRVEEFLKDPAVSSNVFIGGTVQVRVPKVVPAPQTVSILGVGDGAIGSGVDELAEEASAQKKRVALQRQAAVTVEAAEDYARRFESGVNDLTSNDHAGEELGHSGMNIMCRMCFLGEGEGSDRARRMLSCKDCGKKYHKNCLKSWAQHRDLFHWSSWSCPSCRVCEVCRRTGDPNKFMFCKRCDAAYHCYCQHPPHKNVSSGPYLCPKHTRCHSCDSTVPGNGLSVRWFLSYTCCDACGRLFVKGNYCPVCLKVYRDSESTPMVCCDICQRWVHCHCDGISDDKYMQFQVDGKLQYKCATCRGECYQVKDLQDAVQELWKKKDVVDKELIASLRAAADDEENGPVSGRSLKFSIKGLVEKSPKKSKEYGKHSSSKKHASKKGSHTKLEPEVHQEIGSERRRLGGVRIDNVGFQINEQSDVNSSVAGICSTHEPKIVKHKRVDDVMVTDEEKPSRIVRIKCSKPHDSDSEDTLRNAGEEKSVKAKKLVINLGARKINVSGSSKSNVVSHLSRDKDQSTLGGDKVDQTGEVRTLKISGRFGKTQSEGSKATFGSVTQFPAASTSEGNHVDDKTSISPALQKEARPLLKFKLRKPNSGDQTSSVTTQSEDEKLSSAKGQRSKRKRPSSLVDMASLKEDGEATTHSHQDNSRNDEMMDANWILKKLGKDSIGKRVEVHGSQNSWRKGTVTDVSGDTSTLSVSLDDGSIKTFELGKHSVRFIPQKQKRSRS

SEQ ID NO: 17498 - protein, 365 aa, Triticum aestivum
ARGDDRVLVPDLGSLTSVHDRARALFYYLKGGRVDYGEEHSRTYGHARFGRAYDRGHYPMWDEEHPAHFVGHSAGAQVIRLLQQMLHDKAFDGYENTSENWVVSVTSLSGVLNGSTTAYLGGIRPEDGRSIRFVCLAQIYRVGTTIYHWLDIPWLRRYYDFGFDHFGMSWRTVGVSGLPSLLAGTSGPFATGDWILPDLTIQNAARMNADVRTFPDTFYFSYATRRTTKFCGITVPSGVMHIHPLVFIHVMQLCRWRHFAAEPPCKGYRDEDWEDNDGALNTISMTHPRIPVEHPSIFVEDDSDCHQLQPGIWYYKIVEADHMTFVMNRPKGSVQFDLIYDNIFRNCRKNVFRTAPLTLPNQNST

SEQ ID NO: 17499 - protein, 286 aa, Vibrio sp. Ex25
MRINRTLCFSIDHLDFNMRELDTPASDSYNQRFGGTRRLYGNSEVDILRAAHVCVIGIGGVGSWAVEALARTGIGELTLIDMDDVCVTNINRQIHAMTGTVGQSKIEVMAERVKLINPECKVNLIDDFITPDNQHEYLSKEFDYVLDAIDSVKAKASLLAYCRSNKIKVITTGGAGGQVDPTQIMVADLTKTIQDPLAKKIKDTLRRHHNFPKNPARKFGIDCVFSTEQLKYPQADGSVCGVKSTAEGPKRMDCASGFGAATVVTATFGFVAVSRIVEKLISKYKK

SEQ ID NO: 17500 - protein, 372 aa, Agrobacterium tumefaciens str. C58
MPAPDYALLLDPPAFPAERYAMLADRLAALMGTKNDVLLIQAEAVLALEAAATSLARPGLRALNIITSPYGAWFGGWLERGGATVRNLTASPAKPVTLAEVERALDDGPGFDLLAIVHAESASGILNPLPAIAALAQTRGVVTLVDAVASIGGHAFEVDQLGIDIAVIGPQKALAGPAGVSAISVSPKAWEFLSHDKAPTNSMLSLLDQKQLWLDAGRGALPGTPAPLEFYALDAALDRIEAEGLPAANARHERAAAATRHGIRALGIANWVEETHASALVSTAVLPDSVEAGAFHAAVSRQHGADISVGVGPGAERLIRLNHTGRRAHPQAVKANIAAVANALKTLGHSTNTDSALEAAEKGYSEAPAKEV

SEQ ID NO: 17501 - protein, 620 aa, Salmonella enterica subsp. enterica serovar Typhi str. CT18
MDSHTLLQALIYLGSAALIVPIAVRLGLGSVLGYLIAGCIIGPWGLRLVTDAESILHFAEIGVVLMLFVIGLELDPQRLWKLRASVFGGGALQMVVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARTLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKTHFPHLQIIARARDVDHYIRLRQAGVAMPERETFEGALKSGRQALEALGLGRYEARERADLFCHFNTRMVEEMAKGENDPLSRAAAYKRTSAMLSEIITEDREHLSLIQRHGWQGTAEGKHSGKAADEPEVKPSI

SEQ ID NO: 17502 - protein, 180 aa, Triticum aestivum
VHPLRASLLTGGLKKGRSTWGSTRAGPQHLGWLQMVQPVIQERIERYSQSEIRFNLMAIIKNRKDVYTAELKELEKKREQILQELSNEATAAAEKEPLNGALAEVALAVEAVGEKIAMEEDKFRKWKTENVRRKHNYIPFLFNLLKALAEKKQLTPLVEKARQQKAPATATATGAGASTS

SEQ ID NO: 17503 - protein, 175 aa, Nostoc punctiforme PCC 73102
MATERKSRTKRAKKEETTWQERVIQIRRVSKVVKGGKKLSFRAIVVVGNERGQVGVGVGKASDVIGAVKKGVADGKKHLIDIPITKSNSIPHPIDGVGGGAKVIMRPAAPGTGVIAGGAVRTVLELAGVRNVLAKQLGSNNPLNNARAAVNALSTLRTLSEVAEDRGIPIQNLYI

SEQ ID NO: 17504 - protein, 340 aa, Frankia sp. CcI3
MKMQLGMIGLGRMGANLVRRLIRGGHECVVYDVNPEAVKALAAEGATETRSLAEFAAALRPPRAAWIMVPAGLTGETVSALAEHFAPDDVIIDGGNSYYRDDILRAASLVERGIHYVDVGTSGGVFGLERGFCLMIGGEPGVVARLEPLFETIAPGVGTIPRTPGRTGEITQAEKGYLYCGPNGAGHFVKMVHNGIEYGMMAAFAEGFAVLDKANIGTTSAEHNAETAPLGNPEYYQYDLDTTAIAEVWRRGSVVSSWLLDLTAAALQEDPGLTEFSGRVSDSGEGRWTVLAAVEEGVPAHVLTASLYERFSSRGEGLFADKLLSAMRKQFGGHAEKPAG

SEQ ID NO: 17505 - protein, 329 aa, Oryza sativa Japonica Group
MSAGWWGPQDLGAGTLSLISPTDIRPGFLPVFRSGSCADIGTKSYMEDEHVCVDNLIEHLGVRTPVIPAPGAFYGVFDGHGGTDAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVVVVCFSSDPPPQIEVPRFRVRRSISMEGLHMLKGALDSNA

SEQ ID NO: 17506 - protein, 435 aa, Streptococcus pyogenes serotype M6
MSIITDVYAREVLDSRGNPTLEVEVYTESGAFGRGMVPSGASTGEHEAVELRDGDKSRYLGLGTQKAVDNVNNIIAKAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 17507 - protein, 352 aa, Arabidopsis thaliana
TIISNTSFLSLASKFTTRGSRLQCTVSMARSAVDETSDSGAFQRTASTFRNFVSKDSNSQFPAESGRYHLYISYACPWASRCLSYLKIKGLDDAISFSSVKPIWGRTKETDEHMGWVFPGSDTEVPGADPDHLNGAKSVRELYEIASPNYTGKYTVPVLWDKKLKTVVNNESAEIIRMFNTEFNHIAGNPDLDLYPSHLQAKIDETNEWIYNGINNGVYRCGFAKKQGPYEEAVEQVYEALDRCEEILGKHRYICGNTLTETDIRLFVTLIRFDEVYAVHFKCNKKLIREYPNLFNYTKDIFQIPGMSSTVNMNHIKQHYYGSHPSINPFGIIPHGPNIDYTSPHDRHRFSK

SEQ ID NO: 17508 - protein, 613 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 17509 - protein, 505 aa, Oryza sativa Japonica Group
MGHELWVLWATLAVSLLCYLYLTSHRLGSRRRRWPPGPRPLPLLGNLLDLRGGNLHHTLARLARAHGAPVMRLQLGLSPAVVISSPGAAREAFTAHDRRLAARAVPDANHALGFCDRSMIWLPSADPMWRTLRGVVAAHAFSPRALAAARAVHERKVRDLVAYLRGRAGREVDVKDAVYGGVLNLVSSALFSADVVDVGGESAQGFRELVEELIESIAKPNVSDLFPFLRRFDLQGWRRWTSGHLAKIYKVLDDIIDRRSAEDDAAMDKRGDFLDVLLELMSTGKIAREYLTNILFDVFTAGSDTMSLTVVWAMAELLRNPGVMAKARAEIDAALGGREAVEEADVARMPYVQAVLKEAMRLHPVAPVMLPRKAAEDGVEIGGFEVPRGCAVIFNTWAIMRDPAAWERPDEFVPERFVGRSRATEEMDFRGKDFGFLPFGSGRRLCPGVPMAERVLPLIMASLLHAFEWRLPDGMSAEQLDVSEKFTTANVLAVPLKAVPVVIAC

SEQ ID NO: 17510 - protein, 491 aa, Bacillus cereus G9241
MTFVLFGATGDLAKRKIYPALYNLYRDQKLPKQISVIGLGRRQVSHEDFQERIKESIETFSRKREEGTPELEGFLDNFRYCPLDVSKPEDYERLLQVVREREEELHIKGNRMFYLSVAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMETLRKVKKEDVQNHIIRGQYASGEIKGGQVVAYKEEPGVNPSSNIDTFVAARLWIDNPFWTGVPFYIRTGKRMKEKSTRIVIEFKNTLKQQYQDSNPNAAPNLLIIEISPGENVSLQLNSKNPLKNGEIEPMRINFTCEQADVGVPEAYERLIHDAVSGDATFFAHWREVELSWEWVQPILEAFEENLLPLHEYESGSYGPEASNELLQESGFKWWLDQETEK

SEQ ID NO: 17511 - protein, 119 aa, Oryza sativa
MRPPAPATTAGAGGKVTPNLAMDAEGTRLLNLTVLQRLDPAVEDILITAAHVTLYEFNIELNQWSRKDVEGSLFVVKRNKQPRFQFIVMNRRNTACNRYPRSGLCISPCRYRGGFLSIF

SEQ ID NO: 17512 - protein, 243 aa, Brassica napus
LYNKPEVTLNWKQRINVILGVASGLFYLHEEWEQVVIHRDVKASNVLLDGELNGRLGDFGLARLYDHGSDPQTTHVVGTLGYLAPEHTRTGRATTATDVFAFGAFLLEVGCGRRPIEIQHETDETFLLVDWVFGLWNKGNILDSVDPNMGSEYDQKEVEMVLKLGLLCSHPDPRARPSMRQVLQYLRGDAKLPDLSPLDLSGSGMMLGVQDGFSELGMSYSSSVFKGFTGGSSIADSLLSGGR

SEQ ID NO: 17513 - protein, 81 aa, Aphanothece sacrum
TPDGDNVITVPDDEYILDVAEEQGLDLPYSCRAGACSTCAGKLVSGPAPDQSDQSFLDDDQIQAGYILTCVAYPTGDCVIE

SEQ ID NO: 17514 - protein, 249 aa, Frankia sp. EAN1pec
MRLLLWRHGRTSWNDAGRFQGHADPSLDLTGQRQAELVGPFIRALNPELVVSSDLRRCRETAARIGLPVRADARLREIDLGAWSGLTGAEAAARFPAEDAAWRRGEDVRRGGGETYEEVGARAGAVFDDIVAEGLPVTAGGLVVFVLHGGTARSLLGRVLGVPVQNWWVFGPLGNCRWSMLRREPGGFRLVEHNTGPLATVAAAPDKVVSVGPGSTASHPPAEAILPTQEAPTASDTEPVHSQTQPTSG

SEQ ID NO: 17515 - protein, 352 aa, Thlaspi caerulescens
MKITQNVVFFFFISLLFIAVSAGESKCECSHEGDEENKAGARKYKIAAIPCVLASGVIGVLFPLSGKYFPSLKPETNFFFVTKAFAAGVILATGFMHVLPEGYEKLTSPCLEGGAWEFPFTGFIAMVAAILTLSVDSFATSYFYRLHFKPSKKIGDGEERSGGGGDELGLHVHAHGHAHGIVGVDSGGSEVQTHRSRVVAQVLEVGIIVHSVVIGISLGASQSPDTAKALFAALMFHQCFEGLGLGGCIAQGNFNCTSITIMSILFSVTTPIGIAVGMGIANSYDESSPTALIMQGVLNSASAGILIYMSLVDFLAADFMHPKMQSNTGLQIMAHISLLVGAGIMSLLAKWA

SEQ ID NO: 17516 - protein, 246 aa, Methanosarcina barkeri str. Fusaro
MSGSTVYECLTYRNENINQALEALRAGKMIQIYDSDTREGETDLVIPAKAVTFKDVKWMRKDAGGLICVAVDPVASKQLRLPFMAELVREASKTSDVLGEIAEKEGDLKYDAHSSFSLWVNHRETRTGIPDNERALTIRKIGEITEKKLSGDVIHFGEEFRTPGHVALLRAAEGLLDERKGQTELSVALARMAGITPAMVVCEMLDDNNGKALSKEDSKEYGKEHELVFLEGQEIVEAYMMWAGSE

SEQ ID NO: 17517 - protein, 302 aa, Escherichia coli O157:H7 EDL933; identical to SEQ ID NO: 1276

SEQ ID NO: 17518 - protein, 84 aa, Aphanothece sacrum
NEEEGINAILEVADDQTILDAGEEAGLDLPSSCRAGSCSTCAGKLVSGAAPNQDDQAFLDDDQLAAGWVMTCVAYPTGDCTIMT

SEQ ID NO: 17519 - protein, 335 aa, Dehalococcoides sp. CBDB1
MVTRIGINGFGRIGRITLRTINQYHRGELEVVAVNDLADNKSNAHLLKWDSTYGKYAGTVESDDCSIIVDGKPIRVFSERDPMQIPWETAGVDLVIESTGLFTDASKAAAHLRGSVKTVVISAPAKGEDITIVMGVNEDKYNCNTHRIISNASCTTNCVAPLIKVLHDKFGVKKGFMTTCHAYTNDQKIQDMFHKDIRRARAAAVNVIPTTTGAAKAVALVLPELKGKLDGISFRIPSASVSLVDFVGELARDVTVEEVNAAFKEASQGKLSGILEYCEEELVSSDFKGNPASSIIDASSTMVLGGNMVKVLSWYDNEWGYSTRLGDLIAYIAKK

SEQ ID NO: 17520 - protein, 428 aa, Dehalococcoides sp. CBDB1
MSAEVKSIKAREILDSRGNPTVEADVVLSDGSFGRAAVPSGASTGSHEAVELRDGDKSRYNGLGVHKAVANVNTSIASAISGFKASDQQGLDNLLIELDGTPNKAKLGANAMLATSLAVAHAAAASRHMPLYRYLNNSEEYILPVPMFNILNGGKHASNSTDFQEFMVMPVGAKSFAQALQMGTEVYHSLKKVLKGMNQNTTVGDEGGFAPSLPTNKDAVEVILKAIEKAGYRPGEDIFIALDPASSELYQDGKYTLATENKTLSSAEMVDYWCGWVEKYPIISIEDGLFEDDWDGWKLLTRKIGNKVQLVGDDFYVTNIKRLDRGIKEKASNSILIKLNQIGTLSETIAAIKMANNAGWTAVVSHRSGETEDTTIADLAVAMNAGQIKTGAPCRSERTAKYNRLLRIEEELGGKAKYPGKDAFLNLK

SEQ ID NO: 17521 - protein, 255 aa, Zea mays
  misc_feature (210)..(210): Xaa can be any naturally occurring amino acid
  misc_feature (227)..(227): Xaa can be any naturally occurring amino acid
  misc_feature (233)..(233): Xaa can be any naturally occurring amino acid
  misc_feature (235)..(235): Xaa can be any naturally occurring amino acid
MAKPAAARKPSAASTVALTLVLALASAVLLFLLLRFSPSSPSPNPHPHRRLRLRPRAHAHHHQIPFDPVVAAPVPEDLTDGEVDADEDYINDAARFNVTLRVEALFPKIDVDPADGAVTGAELAAWNLANARREVLHRTARELELHDRDHDGRVAYGEYERPSWAWRFDDHNSTDDGVGWWKEEHFSAADMDGDGFLNLTEFNDFLHPAXYYQPKANTLVVQRRSQXERDKDXDXKLNFQEFFHGLFYSIRHYDD

SEQ ID NO: 17522 - protein, 493 aa, Frankia sp. CcI3
MDADVDVIVLGAGPAGENVAGRCADAGLSVIVVERELVGGECSYWGCIPSKTLLRPGEVLAAARRVPGAASAVTGPVDAAAAFARRDWMVGDYSDSSQVPWLVDKGVELVRGTGRLAGPAGRVAVTLLDGTRRVLTASRAVVVATGTRATVPPIPGLADAEPWDNRTATGAWKVPHRLVVLGGGAVGVELAQAFRRLGSAEVTLIEGSPRLLVREEEFVGEQLRAAFEAAGITVRLGSRAVEVRRARTGPDGPAGPVTVTVEPVDPADPADPGEPVERRPRRDAVVADEILVAVGRTPATGDLGLETVGLQPGRFIEVDDRLRAVGVAGDWLYAVGDVCGRALLTHMGKYQARLAADVITGRRDLAGAPVRDLADPAAVPRVTFTDPQVSAVGLTERAAREAGIAVRAVSVPTGSVAGASVRGEEITGTSKIVVDEARRVLVGATFTGPDTQEMVHAATIAIVGEVPLERLWHAVPSFPTVSEVWLRLLEVYG

SEQ ID NO: 17523 - protein, 595 aa, Frankia sp. CcI3
MTPTRHGTPTARLDQVGRAEALRRMGADPVDVAVIGGGVTGTGVALDAVTRGLSVALVEARDLAAGTSSRSSKLIHGGLRYLEQLNAPLVREALRERSLMLDTLAPHLVRAIPFLLPLTRHGWERAYIGSGVLLYDTLGQGLARVGPGGDATMPHHRHLTRKAALREFPSLRPDALVGAIQYWDGQVDDARHTVFVARTAARYGALIATSARVTGFLREGDRVAGVRVRDLESGAEIELRARQTINAAGVWTDEIQAMVGGRGQLSVRASKGVHIVVPRDRIHGVTGLILRTEKSVLFVIPWGSHWIIGTTDTDWSLDLAHPAASSADIDYLLDTVNRVLRTPLTAADITGVYAGLRPLLAGESEDTSRLSREHAVVSPVSGLTMVAGGKYTTYRVMAADAVDAAVHGMNRAVPPSCTEKIPLLGADGFPALWNARETLARRAGLHVGWIEHLLHRYGTLTEELLDLIETRPDLAQPLRGASTYLAAEAVYAASHEGALHLEDVLTRRTRVSIETIDRGVEAAEHVADLIAPVLGWDQVTRAREVAHYLARVEAERASQRQADDATADAARLGAPDVRRLGRTDHRAPAATGGPS

SEQ ID NO: 17524 - protein, 206 aa, Mycoplasma mycoides subsp. mycoides SC str. PG1
MYIKKGDVMKQKTINLPNILTTIRILLVPIIIVLLLVDHYMNGLVFTNFSKFAWFISGAIFIIASLTDFLDGWIARKYNLVTNFGKFFDPIADKLLVNATLILFSSLGVLPIWMTVVLILRDTFIDFIRMILSSKGITLAAGMGGKLKTTFQMIGLSLLFFINLKIFGWSEWNWQNQLVLIPMYIATFFSIYSGVIYFLKAKSNLF

SEQ ID NO: 17525 - protein, 555 aa, Frankia sp. CcI3
MTVLTLPPTTATSLNAGRRERELAAVAAGGPVDLLVIGGGVTGAGVALDAASRGLSVVLAEAHDLAFGTSRWSSKLVHGGLRYLATGDVALARESAVERDILMRHTAPHLVRALPMLTPLTPGVPRSNAALVQAGVWLGDLLRRGAGTPRAVLPGPRRLTAVETLGVAPALREAGLRGGVLHWDGRLVDDARLVVALARTAAGFGARILTRLRVTGLDGGGLDGGPRGPSRHGCRGIEATAVDTLTGTRITLRARTVVNATGVWAPALAPGIRLRPSRGTHLVLRSTVLAGTRAALSLPMPGERNRFALVLPQDDGRVYVGLTDVPVEEVVDVPVPDEDEIAQLLGIVSNVLATPIDPADRLGAFAGLRPLLDTGTDHTGTDHTVVPHSAATRTSAARTADLSRRHLVRTDPGGLVTVVGGKLTTYRRMAADAVDAAVAVGDLDAGPCRTRRLGLVGAAPRSVLATVAAPRRLVERYGTEAPRVLALADGDPDLLAPVAEGTPVTGAELLFAVRDEGALDPADLLDRRTRIGLAPADRRAALGPARQLFDHTLTR

SEQ ID NO: 17526 - protein, 59 aa, Brassica napus
  misc_feature (44)..(44): Xaa can be any naturally occurring amino acid
METISMNHSPGKQVSGLRPFKNPRRRSSRGKPSRSGGSLAPPIXPTFSWGSSPAYPPSP

SEQ ID NO: 17527 - protein, 329 aa, Spirodela polyrrhiza
MGRLSLFASLALSLLLAVGSAEAQLRVGFYSKSCPHAESIITEEIDRAIRVAPSIGGPLLRLFFHDCFVRGCDASLLLNATSSSNPTEKDAPPNQFLRGFALIDRIKARLERACPSTVSCADILALIARDVVHADQGPFWQVPTGRRDGFVSIASEATQLLPAFSANISTLKSQFNDVGLSAKDLVLLSGGHTIGNAHCFTFTTRLYNFSGRGDNSDTDPSLERNYLAKLRAKCAQDGSDALKLVEMDPGSFTTFDNSYFKLVAKRRGLFQSDAALLDDADTRSHVIHLAESDNSVFFKEFAGAMVNMGNIAVLTGSQGEIRKNCARVN

SEQ ID NO: 17528 - protein, 385 aa, Silicibacter sp. TM1040
MSKRDYYEVLGVSKGASADEIKKGFRKKAKELHPDRNADNPDAEAQFKEANEAYDVLKDPERKAAYDRYGHAAFENGMGGGGGGRAGGHPGGDFSSAFSDVFDDLFGDFMGGGGGRAGARQRATRGADLRYNLRLSLEEAFAGLHKTINVPTSVSCTSCEGTGAEGGAEPTTCPTCSGMGKVRAQQGFFTVERTCPTCSGLGQMIKNPCKTCNGHGRVEKDRSLSVNIPAGVETGTRIRLAGEGEAGLRGGPPGDLYIFIEVARHELFEREGNNLHCRVPVSMAKAALGGAIEVPTIDGGRGRVQIPEGSQSGRQMRLRGKGMPALRGGGTGDMFIELAVETPVNLTPRQKEILKEFDEISEENTNPETRSFFSSVKSFWDGMKG

SEQ ID NO: 17529 - protein, 552 aa, Physcomitrella patens subsp. patens
MVAADDERCSHIGRDALRAGGNAVDAAVATSLCLGVVNPVASGLGGGAFLLLRLWNGTAMAYDMRETAPAAAREDMYTEDPSLKVKGGLSAGVPGELAGLHLVWSSHGVLQWPALVAPAIVLAEKGFVVQPYLAHYINMFIDGILADQGLRETFTLNGKPLVAGDICYRKNLANTLKEVAKHGSAAFYSGPVAENFIKDVRAAGSILTMEDLRDYKVAIRKPVVADTMGFTVISMPPPSSGGASLVLILNIIAKYGYTAALKGLVGLHRLIETFKHTYAVRMNLGDPDFVDVNSVVADMLNPSFAGKLQSRIVDNTTFPPEYYGNRWRQLEDHGTSHFSIVDPHRNAVAMTTTINYPFGALMLSPSTGVILNNEMDDFAIPTSQPPGYLPPPPQNFVRPGKRPLSSMTPTIVLKDGRLYGVLGGSGGNKIITTVAQVFINQFVKKLDPLTSVATTRVHHQLVPNVIHYENWTLVTGKHVELGEITRRGLESKGHILEAHTSGAVCQLVVQDLKTPIRMSLFKMGWLRGPRYSSRGKLIGVSDERKDGAPAGL

SEQ ID NO: 17530 - protein, 210 aa, Oryza sativa
  misc_feature (34)..(34): Xaa can be any naturally occurring amino acid
  misc_feature (76)..(76): Xaa can be any naturally occurring amino acid
  misc_feature (92)..(92): Xaa can be any naturally occurring amino acid
  misc_feature (173)..(173): Xaa can be any naturally occurring amino acid
PTRSSTRPGRRPPTPAPASRMQQTIHASPSHGSXLLKSAVLRHMMVPKPSIIPAVYSRSMSVTSANIQESGFETGXAAHIPKCNGNSADGSXLWSTTDDSVYEAAKSMTQQTAGALADAKPGQDKRIAGIVTDRDYLKNIIVQEQSYKATKEADIMTEENHLITENPDTRVLXAMQVMTDNCITHIPVIDGTAMSAMDFIEHIDRAVVRE

SEQ ID NO: 17531 - protein, 389 aa, Candidatus Protochlamydia amoebophila UWE25
MNTHEFQAKQILRKYGIPVPDFYIASSSKEVEEIIKQYQLQSAIIKVQVHAGGRGKAGGVKLATNPQEILEFSQELIGKKIINEQTGPSGMISHQVLISPAILIKKEFYLGITINRELASRVLIASPIGGVNIEKIAHEQPNQLLMLPIPLEETFRSYHLIRIASFMGWKGKQIQEGVAIIQSLVKAFKETDASLLEINPLVETKEGHLLALDAKLSIDDNALFKHEDLKTLFDPSQMSNNEARAQQFELAYVALEGEIGCMVNGAGLAMATMDLIQYHGGRPANFLDVGGGASQVKVAEGFRIILSDSNVKAILINIFGGIMNCETLASGIIEAAKGLQIHIPLIVRMEGTNVEKGKQLLQQSGLKILITENLTEAAQQAVQLAQSVR

SEQ ID NO: 17532 - protein, 478 aa, Salmonella typhimurium LT2
MRQTKLYPVVMAGGSGSRLWPLSRVLYPKQFLCLKGDLTMLQTTICRLNGVECESPLVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 17533 - protein, 322 aa, Candidatus Protochlamydia amoebophila UWE25
MSQLTILIVGGAGYIGSHVNKMLNLMGYHTIVVDNLSRGSIKTVLHGTFVQGDLCDPLFLNQLFQKYSIDAVMHFAAYIDVGESVVNPAKYYQNNVVNTLNLLTAMVKSQVKTFIFSSTAAIFGYPLSNKIGESHPCHPINPYGETKWVVEKMLRDFEQAYGLKYSCLRYFNAAGGDPEGKIKNYQTKSSNLIPLILKSLQHETESITIYGTDYATPDGTCIRDYIHIQDLGHAHIKALEQLLNGSSSTSYNLGNGSGFSVKEVIQTVEKVLNKKVSFIEGARRPGDPPILLADTQKAASLLNWHPQFSLAKMIDHAWTAYH

SEQ ID NO: 17534 - protein, 297 aa, Silicibacter sp. TM1040
MPRKVTKAIFPVAGLGTRFLPATKSVPKEIMTLVDRPLVQYAIDEARAAGIKEFIFVTSRGKGALEDYFDHAPVLEQELRKKGKDQLLEVLKATNMGSGDIAYIRQHKALGLGHAVWCARRLIGDEPFAVMLPDDVIAADKPCLQQMVEAYAETGGNMVAAMEVAPEKTSSYGILDVKDSKDAVMPINAMIEKPSPEEAPSNLAVIGRYILSPSVLQNLNKRKQGAGGEIQLTDAIAEDIARDVPVCGYRFKGRRFDCGSKSGFLQATVAFALEREELRDDLMEYLSTLSAHRQAAE

SEQ ID NO: 17535 - protein, 345 aa, Glycine max
  misc_feature (132)..(132): Xaa can be any naturally occurring amino acid
  misc_feature (152)..(152): Xaa can be any naturally occurring amino acid
  misc_feature (307)..(308): Xaa can be any naturally occurring amino acid
  misc_feature (314)..(314): Xaa can be any naturally occurring amino acid
  misc_feature (335)..(335): Xaa can be any naturally occurring amino acid
MSTSNAGGAGSNDSNATRRQSKRPKYSKFTQQELPACKPILTPRAVISAFLIVTIVFIPIGVASLIASHDVVEIIDRYDLRCIPSNVTDKVAYIQTPGEKQCNRQLTVDKRMKSPIYVYYQLDNFYQNHRRXYVKSRNDEQLRDSGKETPGXSGCEPENNANGKAILPCGLIAWSLFNDTYSFSRNSKNLTVNKKDISWKSDRDHKFGSDVFPKNFQNGSIIGGGSLNESIPLSEQEDLIVWMRTAALPTFRKLYGKIEVDLEKGDVINVNLHNNYNTYSFNGKKKLVLSTTSFLGGKNDFLGIAYXXVGGLSXFLSMAFTIVYLVKPRQLGDPXYLSWNRNPGG

SEQ ID NO: 17536 - protein, 617 aa, Magnaporthe grisea 70-15
MRTRNSLGELPTSPSEEQTSAKKRGHAEDEPQVEKDLTPRKRRKPTRFRESPQDTRKKPATAPKAVVEPKAKEEDGRPPKRNASDLIGDAQEEPAQTPTKRKPGRPKGSKNLPKPPLNGIHTTPSKSQSGRKWATPIKTNGPNGIDTPRRRNLADRSARKKSVSTMIERVVSGMMSDDEAGDDVLAREIYQSSEDEDDEDGGQQIPTVEVEAPAEDLETGEQSEVAPTPTRRRPGRPKGSGKNGPARKRSPTPPRDLPPYERYFFQNKPGSLKTSGNRLNMELLTHEEYFNLVRDYKDPHVSDVTFLQNMHADSFRQWAFELSQGFSICLYGYGSKRALLQRFATELYHRGHKRIVVVNGYVRTSGGIKEALSTMARAVDPSFRLPATLPVTMAQGLTALLADHPETVLTIIVNSIDAPGMRKGGSSNTTQAILAQLASHKQIRLVCSADTPDFSLLWDAGQRSQFNFAMHDCTTFAPFGAAELDVVDEVHELLGRKDRRVGGKDGVIFVLRSLPENAKNLFRLLVTEALVAMEEGSGMGMGDFLGADGPGVEYRMMYNKAVEEFICSSEMAFRTLLKDIENASWQDRCWRMARESESTFRGVSATIVSGTMVTHPN

SEQ ID NO: 17537 - protein, 327 aa, Silicibacter sp. TM1040
MANVLVTGGAGYIGSHACKALKQAGYTPVTYDNLVTGWQDAVKFGPFEQGDLTDRGRLDEVFAQYKPVAVMHFAALSQVGEAMSEPGRYWANNVGGSLCLIEAAVAAGCLDFVFSSTCATYGEHDNVVLDENTPQQPLNAYGASKRAVEDILKDFEAAHGLRSVIFRYFNVAGADPEAEVGEFHQPETHLVPLMIQAIKGERAALTVFGTDYDTPDGTCIRDYVHVCDLVDAHILGLKWLEDGKGSRVFNLGTGTGFSVKEVLSHSHAVTNTEVPHVIGPRRAGDCTKLVSGSVRAGEELGWEPKRSTMDQMISDAWRWHQSGHYER

SEQ ID NO: 17538 - protein, 85 aa, Zea mays
  misc_feature (25)..(25): Xaa can be any naturally occurring amino acid
YPRYVGSLAKVYPQVVLGIVGAPAXGDVMELLIRVSEGFGRIVDARFKSFGCGSAIVSSSVGEQSQILVASRSRCAGVGCYAGWI

SEQ ID NO: 17539 - protein, 72 aa, Glycine max
MDTQKSQPEKQSSSTATAPSVTSCRKKKNEEAAFLDDLKDHIDEFINASMDEHKTCFKKTIQKMFGMSKAVA

SEQ ID NO: 17540 - protein, 362 aa, Dehalococcoides sp. CBDB1
MQNLRIPGPTPCPEEVLKAMGQQMINHRGPEMAAIMKEVAEKLKYFFQTKNDVLVLTGSGTGGLEAAAVNFLSPGDTVLSVSIGVFGERFAKIASIFGAKIIALNFEQGKAADPALVKKALTEHPEIKAVLVTHNETSTGITNDLKPLASVIKGAGKLLLVDAISSLSSINLPVDEWGCDVVVSGSQKGWMVPPGLAFISVSPEAWKANAESKMPRFYWDLAKHKASIEKGQTPWTPCVSVIVALHTALIMMEKEGMQNIFKRHQKIADFTRKGVKELGLTLLAEEKYASNTVTAIVATEGLDVKKLLKIMREEYNTVLAGGQGPLEGKIFRIGHLGWVTENDIKVTLDNLKLALPKAGFRS

SEQ ID NO: 17541 - protein, 387 aa, Oryza sativa
  misc_feature (28)..(28): Xaa can be any naturally occurring amino acid
  misc_feature (180)..(180): Xaa can be any naturally occurring amino acid
MSSSSSAARTLLSPAAPPVPRRGVVRPXRCSGGGGAAAVETAASGAKVCTVSNRGDSLAICRVLNGMWQTSGGWGRIDRDAAVDAMLAYADAGLSTFDMADHYGPAEDLYGLFINRVRRERPPELLAEIKGLTKWVPPPVKMTRSYVEDNINRSRKRMDVSALDMLQFHWWDYANPGYLXDALKHITDLKEEGSKIKTVALTNFDTDRLQIILENGIPIVSNQVQHSIVDMRPQRRMAELCQLTGVKLITYGTVMGGLLSEKFLDTNVSIPFAGPPLNTPSLQKYKRMVDAWGGWSLFQALLQTLKKVSLKHGVSISTVAVRYILNQTSVAGSMVGVRLGLSEHIKDTNAIFSLELDEEDMNSITEASNKGRNLMDIIGDCGDEYRA

SEQ ID NO: 17542 - protein, 364 aa, Mycoplasma mycoides subsp. mycoides SC str. PG1
MGLQVGIVGLPNVGKSTLFNAITNSKVEAANYPFATIEPNVGIVEVPDYRLDELFKIFNSKKRVATTIEFVDIAGLIAGASQGEGLGNAFLANIRQTDAICQVVRCFDDKEIMHVENSIDPIRDIEIINLELMLADQATVKKRLDKIAPKFKSGDKVAKVEYDLLNYLLDTLNKGILLNSLTLNEEQTDLLKSYQLLTSKPIIYVCNVSDTELLEDNDYVKKVRQFAEKSNFQVVKICAKIEEDLSEVSKEEKVEFLKELGIKESGLDQLIRAAYDTLGLQTFFTAGPQEVRSWQFKKDWTAPKCAGVIHTDFFKGFIKADIYSINDLLVLGSEKAIKESGKMRLEGKTYIMQDGDVCFFKFNV

SEQ ID NO: 17543 - protein, 406 aa, Photorhabdus luminescens subsp. laumondii TTO1
MSSVDILVPDLPESVADATVAVWHKKQGDRVERDEVLVEIETDKVVLEVPASEAGVLEAILEEKDATVLSRQLLGRIRLGDSTGKPAEIKEKTEATLAKRQTAGLDEESNDALSPAVRRLIAEHDLDAKAIKGSGVGGRIVREDVEKYMADNEKVASKPAESSAASAQGSLLPHRSEKRVPMTRLRKRVAERLLEAKNNTAMLTTFNEVNMKPIQEMRKQYGEAFEKRHGVRLGFMSFYVKAVVEALKRYPEVNASIDGTDVVYHNYFDISIAVSTPRGLVTPVLRDADALSMADLEKRIKELAIKGRDGKLTVEELTGGNFTITNGGVFGSLMSTPIINPPQSAILGMHAIKDRPMAVNGQVEILPMMYLALSYDHRLIDGRESVGFLVTIKEMLEDPARLLLDV

SEQ ID NO: 17544 - protein, 388 aa, Photorhabdus luminescens subsp. laumondii TTO1
MNLHEYQAKQLFARYGLPAPAGYACTTPREAEEAASKIGSGPWVVKCQVHAGGRGKAGGVKVVNSKEEIRAFAEQWLGKRLVTYQTDAQGQPVRQILVEAATDIAKELYLGAVVDRGTRRVVFMASTEGGVEIEKVAEETPELIHKAIIDPLIGPMSYQGRELAFKLGLTGKQVSQFTKIFLGLANLFLERDLALVEINPLVITTQGDLICLDGKLGADGNALFRQAELREMHDPSQEDPREAQAAQWELNYVALDGNIGCMVNGAGLAMGTMDIVKLHGGAPANFLDVGGGATKERVTEAFKIILSDENVKAVLVNIFGGIVRCDLIADGIIGAVEEVGVHVPVVVRLEGNNAELGAKKLADSGLNIIAATSLTDAAKQAVAAVEAK

SEQ ID NO: 17545 - protein, 398 aa, Methanosarcina barkeri str. Fusaro
MFSINSECVLSKKSEDIPPFYVMEVLESAQALEAEGRHIIHLEVGEPDFPTAPHICDAACAAIGRGATKYTHSQGLPSLREAIVESYQQKFGVELSPDQVIVTSGTSPALLIVFMALLEKMDEVIMSNPHYACYPNFVKYLGGTPVFVYTSETNGFALEPKTVRQCLSPNTKAILINSPSNPGGHVMSPENLQGLAKIADEKRIPIVSDEIYQGLIYGGDEHTILEYTKNAFVLNGFSKLYAMTGWRLGYIICPPECVRAIQKIHQNFFICANSFVQEAGIAALKGPQDHVDEMVHTYNKRRQYMLKRLIGMGLEVRKEPMGAFYVLADARRYGPDSLEMSRRILNEAGVAVTPGIDFGNGAEGYLRFSYANSIENIKEGMDRLEAFLEKELEGLEIL

SEQ ID NO: 17546 - protein, 489 aa, Pseudomonas syringae pv. tomato str. DC3000
MPLITVEPCTFALFGALGDLAVRKLFPALYQLDRAGLLHEDTKILALAREPGDEQSHLAYIEKSMRRFIPEAELEADNAARFLARLSYLHVDFLKAEDYVALAERVGNAETLIAYFATPASVYGAICENLASVNLAERTRAVLEKPIGHDLASSRRVNDAVAQFFPENRVYRIDHYLGKDTVQNLIALRFANSLFETQWNQNHISHVEITVAEKVGIEGRWGYFDQAGQLRDMIQNHLLQLLCLIAMDPPSDLSADSIRDEKVKVLKALAPFTPERLATQVVRGQYTAGYSEGKAVPGYLEEENSNTQSDTETFVALRADIRNWRWSGTPFYLRTGKRMPQKMSQIVIHFKEPPHYIFAPEQRLQISNRLIIRLQPDEGISLQVMTKDQGLDKGMQLRSGPLQLNFSDTYRSARVPDAYERLLLEVMRGNQNLFVRKDEIEYAWQWCDQLIAGWKKAGDAPKPYPAGTWGPMSSIALITRDGRSWYGDM

SEQ ID NO: 17547 - protein, 209 aa, Methylobacillus flagellatus KT
MSTISKISSSTLPTKYGQFIIHVYHDVQTGQEHVALVAGHVLNNENVLVRVHSECLTGDIFSSNRCDCGEQLVLAQSMIAEAGQGVLLYLKGHEGRGIGLANKIHAYALQDRGLDTVDANLHLGLPIDQRSYAAAVDILKDLGVHSLRLLTNNPEKVSSLQQAGLTVTERIPLVIQPNQDNLQYLLTKRDRLGHFFAQTDMKNPNFGEL

SEQ ID NO: 17548 - protein, 351 aa, Aspergillus oryzae
MPDTIPLPPPFSTIPRTPLTLGPSPIHPLPRITADLNQTATIYAKRDDLNSGLAYGGNKTRKLEYLAADALAQNATTLVSIGGVQSNHTRQVAAVAARLGLKARLVQEHWVDWEDPGYDVVGNIQLSRLMGADVRMEDAGFGIEHKETLKKLREECEGNGERPYYIPAGASDHPLGGLGFARWAFEVREQEREMGVVFDDVVVCAVTGSTMAGMVAGFKLIEKLYPGEKKKRVIGIDGSAKPVETKAQVLRIARNTAVQIGLKEEDITEKDMILNEDYHAGTYGIPDKATWEAIEYAARMEAFITDPVYEGKSFAGMVDLIKKGEITGNVLYAHLGGQLALNAYSRLGETK

SEQ ID NO: 17549 - protein, 332 aa, Oryza sativa Indica Group
MESSRGSKAISPLSPIQPAPSFLLPPNPPYATLRSYIPNRPFLTFVPTLIASFPHRFYNLNHWVPFGVCYAMKRAGSKGVLESSSSSSKKTTRRQKKPPTSSLEELELPNSAMNKIQEVHDIARDVFSTATPGFVPSPLAEANLTKLLDTLKLEDFGLDASMPYFRADPQGHPKVTYVHFGDDSLNFSFGVFCLPQSAVIPLHDHLGMTVFSKILHGSMHVKSYDWVKTPNGAHFAKVRTNTIYDDSSKTTVLYPESGGNLHCFTAETACAVLDVMGPPYSSVEGRDCSYYGVCPSPRGVSRRITDELSDWLRKEHCTFNMNAVLVKPSTMT

SEQ ID NO: 17550 - protein, 253 aa, Synechococcus sp. WH 7805
MLNHIRADLAIIRERDPAARGPLEILLCYPGFQALSLHRLSHRLWRSKLPLKLAARLLSQMGRNLTGVEIHPGARIGHGVFIDHGMGVVIGETAEVGDRCLLYQGVTLGGTGKEHGKRHPTLATNVVVGAGAKVLGAISVGPNTRIGAGSVVVRDVEADCTVVGVPGRVVHQSGVRINPLAHSALPDAEANVIRNLMERIDQLEGQVRNLQDHLRAIATIKGEPIIDKRCGEAQSLKDREILEFIGDQSNSTY

SEQ ID NO: 17551 - protein, 456 aa, Lactobacillus acidophilus NCFM
MKNSNGKPKKLSFISIYFLGINAVIGSGTFLLPAQIYHDMNLMAIFVLLCTAVTVSMIALCYADLSSRFKGSGAAWLYAYHAFGRFTGYELGIFTWFLGCCTLGAEIVALLTTLKSFWPALNNSIVYYAIALGLLLLFSIINFFGRSLVKVVNNISAAAKMVTLIVFIVVGAFFIRQANFSPVIPAAATKGAVPFLQHFGAAFTPIFYLFTGFSFIPIAARQMNNPEKNIPRVLIAVMVSVTILDCLMMIVAIGLVGDKLGTYSTPLASALEHGVGKWGYSFIIVGMLISIFGVAFSASFNAPSLIASLSNEHKLLPAWVGKKNKHDAPWVGIIMTAVLTGIFVTQSYLFLVSCTVLASFIQYVPSILAVIKFKHSNEFPNHGFSLPGKYTIPTIALIVSCYMVTNFTPLTLLVGVVVAAIGAVLYFFIDRSPAMKKKEKMHQEFLNELRHNEIKF

SEQ ID NO: 17552 - protein, 228 aa, Triticum aestivum
MGKGSTFGGPAAAIAGEDTDLNLEELQDALGNPVHDLPPVVRRRVDALTNLQKQYMDLYKQYNAEVRELERKYQKLYAPVLAKRASVASGAHEPTDAEAKVEEKEVEEGVQMREASPEDAEIKGIPQFWLTVLQNNPMVGSTIAEDDEEALTYLRDIRFSEVEGAEGFTLTFEFAENPYFSNTTLTKTYFMEVDEAMGRVEYDPSTGSKIEWKAGKNLTVRPVQKKVQ

SEQ ID NO: 17553 - protein, 393 aa, Listeria monocytogenes str. 1/2a F6854
MDLPLSKRVKGVAPSPTLAITAKAKQMKQEGIDVIGLGAGEPDFNTPQNIIDAAIESMNKGFTKYTPSSGIIELKQAIVDKLKKDQFLNYETNQIFVGTGAKHVLYSAFQTILDPGDEVIIPVPYWVTYPEQVKLAGGIPVFVETGFDADFKISAADFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELNSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 17554 - protein, 767 aa, Oryza sativa Indica Group
MGIWYHKTREHTKLWVANRQAPLTDPESSQLSISSDGNMVLLDRATRSPVWSTNITGIAAAANSTVGVILNTGNLVLADASNTSAVLWQSFDHLDNTWLPGSKLRRNKLTGEATRLVAWKGSNDPTPGMFSLELDAGGGGASQHLRLAWNGSHQYWSGGGGNWTTAPEESGPEGQSPYTFLYVDAENESYVVFEVKDEALLSRIVVGVAGQIMLWGWVESAATWVLFWSEPTLCDVYSLCGSFSVCTDGAVPECGCLQGFVERQPRQWLYGDQTAGCARITGLQMPCGGGGQASGKTTKRDDTFFTMPKANSLPTGGVAAPSATASAHDDCELACLGNCSCTAYSYNGSCTLWYGDLINLRGANGSGTDGYSISIRLGVASDLSGTGNTKKMTIGLVVAGVVAAAVTLAVLVAVLVMRSRRAKALRRLEDSSSFLTVFTYRDLQLVTNNFSDKIGGGAFGSVFKGALPGDATPVAVKKLEGVGQGEKQFRAEVSTIGMIQHVNLIRLLGFCTDRTRRLLVYEHMPNGSLDRHLFGSGSGHGGGVLSWKTRYQIALGVARGLHYLHDKCRDRIIHCDVKPENILLDGAFAAKVADLGLAKLMGRDDSSRVLTTTRGTVGYLAPEWIAGTAVTAKADVYSYGMMLFEIVSGRRNVEQRRRQAEAADDDEYDSGAGGTVEADFFPLTAVRMLFDVDGDLRDAVDGNLGGEADMGEVERACKVACWCVQDAESARPTMGMVVKALEGLVDVNFPPMPRLFMVGLSTGSSHT

SEQ ID NO: 17555 - protein, 389 aa, Bacillus clausii KSM-K16
MLQARKQREAAIALHKHGKMEMKSTVPLINEYDMSLAYTPGVAEPCKRIAENKDEVYDHTIKGNLVAIVTDGSAVLGLGNIGPEAAMPVMEGKAVLFKQFAGVDAIPLCLETQDVDAIVATIKAVAPTFGGINLEDIAAPRCFEIEQRLQEELNIPVFHDDQHGTAIVVLAALINALKVVDKGLNSARIVINGAGAAGLSIATLLLEAGCSDITLVSLEGIVQENEPWLNQRQKELAAQTNRRHLTGKLDQAIEGADVFIGVSGPRALTGEQVKRMNSDAVVFALANPTPEIYPEEASAAGAAVVGTGRSDFPNQINNVLAFPGIFRGALDARASTITTTMKLAAAKAIANIVGQDLHAGHILPSPFDERIAPAVAKAVADEAKEKVCS

SEQ ID NO: 17556 - protein, 293 aa, Glycine max
MSGLKLGTTASIYVRTAKTKSKPLLSWRSPPQHPRSRRYMLSPSKNQILGFTPRNKFPCYSLGRAGLVTDFGSSVPQPQPQPQPKPEPEPEPEPSKLLTLPTILTLGRVAAVPLLVATFYMDGWRGTAATTSIFVAASITDWLDGYLARKMKLKSSFGAFLDPVADKLMVAATLVLLCTRPLDGGVFGQAPWLLTIPAIAIIGREITMSAVREWAASQDSKLLEAVAVNNLGKWKTATQMTALTILLATRDWSHGGGAAIVVGSGVALLYTSAGLALWSLVVYMKKIWRVLLR

SEQ ID NO: 17557 - protein, 4419 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKLLLNGETRPCFKRDSNAFQRYLKCYKRTLLVIATVNSLCRFIGALSNTMEEEPERRKAIALFMAFGTKGDVYPLAAIAAVFARVQQHYTVVLMSHLAHENLSSHLSKAKVSYFPINSPPALSNEPQGTQNVTDSLRKMFLEEKERIKREHRQECHSAFRTIFGKDPCMEGDFVVINFFALEGWSLAEVFQIRCVVAAPYVVPYSPPSGFERQFRKELPDLYKYLKEAPIGKVSWSDVTHWMWPLFTEEWGSWRYEELNLSCYPFADPVTDLPIWHIRPPSPLVLYGFSKEIVECPDYWPLSVRVCGFWFLPNEWQFSCNECGDNPFAGRLGTDDSHTCSNHTELYTFISSCEPALPIFVGLSSVGSMGFVRDPIAFLRVLQSVIQITGYRFIIFTASYGPLDAAIRTIANGSDSSEKQPLHAGISIFNGKLFCFSGMVPYNWMFRTCAAAIHHGGSGSVAAALQAGIPQIICPFMLDQFYWAEKMSWLGVAPQPLKRNHLLLEDSNDEKNITEAAQVVAKAIYDALSAKTRARAMEIAEILSLEDGVTEAVRVLREEVRNRKKYSSCDCEEERRQVFVSSTGKKNPTIFLDSFTLLRPPSLSFFSRRRYLGRYIKDIQKDQLKISLWNGEVLLENVELNPEAFEYLQLPIALKQGRVGKLSIKIPWKKLHRDPVTIMIEDVFICASQRNDQEWSSDVVEKREFAGKKAKLASAELAKLSRRVFDNPGGNSYMSYITAKILDSVQVSIKNFHILYSDAQPESGQVVLGLRFSSLTVTKQNSVGPSVGRVRGGQVNILVEVEGLEIYCDMYEGNMDFPSVNEKIGFDNWCQSRLQSNRFGYLLKPVHVSVTLLVNRSGELYDDLPQYSISAELTDVVVTLNEFQLQQILILLDYLQTSQLRERYGRYRPCSTSLSRKPPGWQKLWWHYAQNSVLSDVRKKLWKTSWRFLEQRIQILLECIQAVCSLLDFCFGEKIQENPQESIDKSIRLGLEELEKKSDIDDILSYRSAAEGEMQEACSELTVNMGATGATRSEKEQSAPEKEPSDDPTLNKSRGWLNWLSRGMLGAGGTEDSSQFSGVVSDEVVKDIHKATKFYPLSSSPRNTSATGKICTCSIRLNVRKFSATLQHISGSSSQVITELDILGVIVECKSWKDSTAMILSVISGRLVYPHNGKEILTMKRVCSQSDTLETKPSYGARLELSKDHDVALSLKATLQPLEAAYDGGFILAVSNFFSGSRYFKLQHERILSSLNGLESETRLAAKAEYLLSSRNKVKWDLDIKDLTLSFPGRLVESESYNLVLVLESLSITSSSTDALSQIPRLQSDVDHVVNSLQSSVEALDAFQVKDLYDHFDIKICNLEMKLMKIHPFQELPLVEKSSLLIKFASCIIPEESILKQLEVEATLPMFNVHFSPSIFKGVMSVIEYLDIQDHGTRNPPPSPAPIFHFTIKTDLAFLRLHVNLENKGENSTVLVLSIQQLDLWYSRAIFEEWSVRAKTLEITACSSKDAADSHILCSSGNLLKSSSHGHGMDAHTSDETNIIDYRTTPEAAISLNCKVSQSKSFIFHKYTVYWRSAELHCYPYIFGLLTNFLDKIASYKISSSYTNPSSLATDTIAPTEIPQFDFERFGFSNFTESRSCGCIPLDKFPFVTINNSGSLHSLESSLCYSTSDWRKLFILKNRKDGAQIGLNCECNSCTFQLKRDCPLNGLASSRDLGQTNHFTVDMHVFNTNVHFHDSSSVFGTIILPVSRYFLNISDDLLDLVASAEDLMLVSSLFTNYSGGFLWKQSSTDVSQVLNLRVRKRGLEPSGSQLEVSIGIQHTYCILPPEYLAIIIGYFSLSDWTSKSGLQSLPQATELTKAHSEFAISYKIEILDSSIVLPVEGDDRRQLKVDIQQLYISFIPECALSNVVQHIPQECVIPLNQVLGRADCLNIFGRDLSVSLLLSESDISTFKKNAVCRSITLAASIIADTWIRFPCDHNPLTELACVMSRVDVCEIVVDDSDALDGFKAFLDVVDQLSLVDEESKLFVSDVPQFLHTKMRLKQELSVAPLEPSTSFIKFRIFVNLLTSKLHRLRKAPGTLLSEPVLQADMKFVCSGELKNNFPMSLDVQFFKIGLYSLLSSVMLARCINADGDPSALRVRFTEQAENEYDLCFSLPSLDIWLHFFDWIEVIELLKSYSQKLEDSSEDRFFSKGSKLDMDESIGVVRTICDNTDRVLNVLQTEVSENSSEVMSFAARSENIGVKIHIPLCTSHTEFPGFMATDVHEISEEEHTNCFKGNYCKYVSVTACSRSGELSILGRDVKLSYKIEKLNGILAISGVDTVRSCSLFGAAQLLVETSIQMDQNKIMSIDVGILSDKVEMHASHQVLSFWHGITFDAPETPSSQNSEGNMSIKVQIRDVSLLISDGKWGCSGMLLEVLMRNFLLQANLAEKNMESLVSCDLEVNYNNMHKVLWEPFIEPWNFDIKLSRKFDANSLLNNAGLTEVIVASSNQLNLNLTESLFECIFRIIEMLNILELMETDAIPDNKGLSVYCTNSTRTERYSPYVLQNLTSLPLGYQVFQGHDSDVLNISAPVAQNFVQPGCSVPIYIDNSDTLLIPDRRRSQFGCSSSESGDAIHHYMKVQLDGTSFASPPHSMDRIGLSYFEVDFSKTSNSSDNVEKASKSGYGSSFVVPVVYEVSLQQQSKLIRVYSTVIILNSTSMPLELRFDIPFGISPKILDPIFPGQEFPLPLHLAKSGRLRWRPLGDSYLWSEAHSISKVLSQDSGIGFRRSFACYPCHPSHEPFRCCISVQSTSLPASFHINDLSAGNFGQQLHNLDQSREQFIHQVTLSTPFVVSNCLPDPISLSIESGGITQTASLPEGETPFHHIDPSHDLVLEFKLNGCRTSSLKFSRSETFSTEAKFSGGKFSQIETISFDSHVGGGSVYVSCEKTMDATCGAREVLIFVPFLLYNCTGTPLIVSDCTNETKGIYSVIPSCYNLIEQHFVQSRKVGLGILTSEKDLLDKAVMEDIPCSPSSSECSNTASSTERFIDKHATQSTRQVPFAAYPKDSAIVRKRSLSSKSLREVCFQGNDESGKVKACIYSPCPISRVSDTMIRVKRDLPGWVNSSSPYPLWSAPFPLVPPSGSTNVVVPQPSPGESSLLSVTCSILGGALAGRTQAITFQPSHNLCYKQKGTNLVSHLAVGQHSQLQWTDTTRELLVSIRLNEPGWQWSGSFLPDHLGDTQLKIWNYVNKAFNMVRVEVQNANMSSGDEKIVGSVHGHVGTNFILLSDDDMGYMPYRIDNFSNERLRVYQQKCETFDTIVHPYTSCPYAWDEPCYPHRLTIEVPGDRVLGSYAFEITKQPIAVHLRSTSEKPERTLLLSICAEGATKVFSVVDSGYHAIKDIKETFDSRFHEKGKKKLQTDNIIRYTETFLLVLPSIGISLVNSHPQELVYACASNVVLELSQSVDQQKLSFQISSLQIDNPLQNSSYPVILSFNHDHEVIPPDWGMKNNKAILLSEIVQQVRGNSCDAVVYVDLAKWRKKDVSLVSFEYINIRIGEFGLELELQTLLSLLEFVKAVLPNSQARLLPLSDPTLRPLIYDTGSKDISSEDTPHARNIPVFNKNQRSIVALPIVVPIGAPWQHIHLLARRRRKIYVETFDLAPIQFTLSFCSAPWMLRNGILTSGESLIHRGLMALADVEGARIHLKQLTIAHQITSWESFQEILVGHYTRQILHEIYKVFGSAGVIGNPMGFARNVAFGIKDFLSAPSRSISKSPAGIIQGMAHGTTSLFSSTIYALSDAATQFSKAAHKGIVAFTFNDHDVARMEKQQLGEGSRSKGVIGEVFEGLTGLLQSPIRGAEKHGLPGVISGVAMGITGLVARPTASILEVTGKTAQSIRNRSRIHNIRSQRHRLRLPRPLSREQPLRPYSWEEAVGTAVLMEVGDSLKFKGEKLVKCKALKQEGAFVVITGRLVLVLSSLSLVDFRKQGFLGVPIDLVWNIEREIGLESVIHTDCSGGVVRIIGSNSDGVWNWRQDQQKKSSPTKKRWNNPSAQPLLQTNLEFPSEEEAEDLLSVLLSTIETGKSRSWHSRFVLSRSNIT

SEQ ID NO: 17558 - protein, 295 aa, Methanosarcina mazei Go1
MEYIKTATEVYILKIIGGPASQLLASRTARALGTEPVLCEFNRFPDGELYLRIAEEIENEKVTLIQSTPTDSDFVALLQLIDACEGAAEINVVIPYMGYARQDKKFKSGEPVSARAIARCINADRVFTINIHEKSVLEHFPCPAENLDAAALIGSYVAGFGLERPMLVAPDEGARGLVKNVASGHGFDHDHLQKTRLSGDTVVIKTKNLDVTGRHVVLVDDMIATGGTMAESIRMLKSQGAIDVHLACVHPVLTRNAALRLFHAGVKDIIGTDTLEKAESKLSVAPLIAEALSGY

SEQ ID NO: 17559 - protein, 647 aa, Oryza sativa Indica Group
MGGGGTLVDGFRRLFHRRTASGSNQSSNAGEEAASSDLEVADDPDLVALRSIRIRVPKRKMPLPVESHKKFGGEMKVSGFLVILDSWPRGVLRQDQIFVAPELLAYCTISLFLFFYDLCKVQYSSSAGLTWSGLCISLVRTVSIGNKSRLAHGMEQNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRPSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDPCMD

SEQ ID NO: 17560 - protein, 137 aa, Frankia sp. EAN1pec
MSAERTLILVKPDGVSRGLVGEVVGRIERKGLKIVALELRTLERSVAETHYGEHASKPFFGELVEFITSGPLVALVAEGPRAVEALRGLIGATDPVKAAPGSLRGDFALEIGQNLIHGSDSPESAKREIDLFFPGLS

SEQ ID NO: 17561 - protein, 513 aa, Arabidopsis thaliana
MDAIVVDSQNCFIIILLCSFSLISYFVFFKKPKVNFDLLPSPPSLPIIGHLHLLLSTLIHKSLQKLSSKYGPLLHLRIFNIPFILVSSDSLAYEIFRDHDVNVSSRGVGAIDESLAYGSSGFIQAPYGDYWKFMKKLIATKLLGPQPLVRSQDFRSEELERFYKRLFDKAMKKESVMIHKEASRFVNNSLYKMCTGRSFSVENNEVERIMELTADLGALSQKFFVSKMFRKLLEKLGISLFKTEIMVVSRRFSELVERILIEYEEKMDGHQGTQFMDALLAAYRDENTEYKITRSHIKSLLTEFFIGAADASSIAIQWAMADIINNREILEKLREEIDSVVGKTRLVQETDLPNLPYLQAVVKEGLRLHPPTPLVVREFQEGCEIGGFFVPKNTTLIVNSYAMMRDPDSWQDPDEFKPERFLASLSREEDKKEKILNFLPFGSGRRMCPGSNLGYIFVGTAIGMMVQCFDWEINGDKINMEEATGGFLITMAHPLTCTPIPLPRTQNSLISHL

SEQ ID NO: 17562 - protein, 214 aa, Frankia sp. EAN1pec
MHGPQGYYGTQSRYVLPNIIEKTSRGEYGMDPYSKLLKERIVFLGAPIDDTSANDVMAQLLFLESEDPDRDISIYINSPGGSFTSLTAIYDTMQFVRPDIQTICMGQAASAAAVLLAAGTPGKRFALQNSRILIHQPSAQGEGQSSDIEIQAREILRMRSLLEHMLAEHTGRTEEAVRKDIERDKIFSADEAKDYGIIDEVIKTRKSSRLASAR

SEQ ID NO: 17563 - protein, 427 aa, Methylobacillus flagellatus KT
MQQHELSSSRFVSTLTKNTVALILAGGKGSRLRDLTNWTAKPAVPFGGKFRIIDFPLSNCINSGVRRIGVVTQYKAHTLIQHIQRGWGFLRGEFNEFVELLPAQQRIQEEWYKGTADAVFQNLDILRQTNIEFVLILAGDHVYKMDYGQMLAAHVRNKADMTVACINVPLKEASAFGVMGVDENDRVVDFEEKPAHPSSLPDDPDHALASMGIYVFNAAFLYEQLIRDADDPKSSHDFGHDIIPYLIKKYRVFAHRFTDSCVGAADGNYYWRDVGTVDAYWEANMELTKVVPELNLYDRQWPIWTYQEQLPPAKFVFDNEERRGQATDSLISGGCIVSGANVRNSVLFSDVRVNSYSSIEQSVILPKVDIGRHVTLRRVVVDSGARIPDGMEIGVNLELDRKRFHITEQGVVLVTPDMLGQNLHHIR

SEQ ID NO: 17564 - protein, 377 aa, Chlamydomonas reinhardtii
QLARHRPFRVAQGGRRSAMRVAAQSGAAAGQAPVITKRVHFKGDSAFSFAPIINGCWQLAGGHGREVYDGIQEKLEAHAAAGLTSFDTADIYGPSEEILGQWQRAHVAAGGAPVQVFTKYVPNIFQQRPTPSNVEAAIRRSLNKLQVDKLDLVQMHWWEYGIPGMTDAALALADCQAKGLIRHVGTTNMDTAALDAIVSAGVPVVVNQVQFSLLDRRPLNGMVQYCSERGIKLFTYGSVGGGLLSDKYVQEPKQGLFGFGGSKYPPVDLNTSSLKMYWNVTKQFGGQELWRELLAALKAVADKHGVSVANVALRWVMQQGDGQTVCPIVGLRGTAHIADNARVLALTLDDSDLAAIDAVLARSTGPTGDCYSFERGN

SEQ ID NO: 17565 - protein, 470 aa, Methylobacterium extorquens
MPINVLMPALSPTMEKGNLAKWLKKEGDAIKSGDVIAEIETDKATMEVEAVDEGVLAKILVAEGTADVPVNELIALIAEEGEDPGSVQAPKGGAEAKTAPVEPKGTPDQNAAPDGSHASYARVDQVPEGAKPNGAAQPAGSGDRVFASPLARRIAKQEGVDLSAVKGSGPHGRVIQRDVQAAIENGTAKAGAAAKPEAKSEGKSAPAPEKSAPKAAAAGGAPAGLSLDQVKGFYEKGSFEEVPLDGMRKTIAKRLTEAMQVAPHFYLTVDCELDALMKLRETLNGSAGKDKDGKPLFKLSVNDFVIKAMGLALTRVPAANAVWAEDRILRFKHAEVGVAVAIDGGLFTPVIRKADQKTLSTISNEMKDFAGRARAKKLKPEEYQGGVTSVSNLGMFGIKHFTAVINPPQSSILAVGAGEKRVVVKDGQPTVAQVMTATLSCDHRVLDGALGAELIAAFKGLIENPMGMLV

SEQ ID NO: 17566 - protein, 479 aa, Methylobacterium extorquens
MSETYDVLIIGAGPGGYVAAIRSAQLGFKTAVVDREHLGGICLNWGCIPTKALLRSAEIYHYMQHASDYGLSAKEVSFDAAAIVKRSRGVSGRLNGGVGMLLKKNKVDVIWGEASIESGAKGNEPGKVTVKETKRAEPPKGAKGAGTYAAKHIIVATGARPRVLPGIKPDKKQIWTYYEAMVPEKMPKSLLVMGSGAIGIEFASFYRTMGADVTVIELLPQILPVEDAEIAGLARKRFEKQGIKILTSAKVTKVEKGADSVTATVEDDKGKTQQLTAEKLISAVGVVGNIENLGLEKVGVKIERGVVVTDGLGRTNVPGVYAIGDVAGPPMLAHKAEHEGVLCVETIKGLHTHPMDKAKIPGCTYCQPQIASVGVTEGKAKELGLSIKVGRFPFAGNGKAIALGEPDGLVKTIFDAKTGQLLGAHMVGAEVTELIQGYVVAMTLESTEEELMHTVFPHPTLSEMMHESVLDAYGRVIHT

SEQ ID NO: 17567 - protein, 72 aa, Triticum aestivum
NPSFLTIHLSADILYDSWSPAMTVSSVCISILSMLSSSPAKERPSDNDRYVRNCRNGRSPKETRWWFHDDKV

SEQ ID NO: 17568 - protein, 375 aa, Aspergillus oryzae
MADTVGKAAVAWAAGEPLSIEDIEVAPPKAHEVRIQVHHTGVCHTDAYTLSGKDPEGAFPVVLGHEGAGIVESVGEGVTSVKPGDYVIALYTPECRECKFCKSGKTNLCGKIRATQGKGVMPDGTSRFKARGKDLLHFMGTSTFSQYTVVADISVVAVTPKIPTDRSCLLGCGITTGYGAAVVTAKVEEGSNVAIFGAGCVGLSVIQGAVKNKAGKIIAVDVNDGKEAWARKFGATHFVNPTKLNGKTIQEELIEMTDGGCDYTFDCTGNVGVMRAALEACHKGWGESIVIGVAAAGQEISTRPFQLVTGRVWKGCAFGGIKGRTQLPGLVDDYLNNELKVDEFITHRETLDNINAAFEQMHHGDCIRCVVDCRQ

SEQ ID NO: 17569 - protein, 514 aa, Glycine max
  misc_feature (211)..(211): Xaa can be any naturally occurring amino acid
MHTLLRSTLRTKTASSLAYAVVSRSAHENLLQAPLLSRSNSTEASLAKDNSSNDVKNGQGYKGHSMLAPFTAGWQSSDLHPLIIEKSEGSYVYDINGKKYLDALAGLWATSLGGSEPRLVDAAVAQLKKLPFYHSFWNRTTLPSLDLAKELLEMFTARKMGKAFFVNSGSEANDTQVKLVWYYNNALGRPDKKKFIARAKSYHGSTLIAAXLSGPSGFCHQKFDLPAPFVLHTDCPHYWRYHLPGETEEEFSTRLANNLEQLILKEGPETIAAFIAEPVMGAGGVIPPPSTYFEKVQAVVKKYDILFIADEVICAFGRLGTMFGCDKYNIKPDLVSLAKALSSAYLPIGAVLVSPEISEVIHDQSNKLGSFSHGFTYSGHPAACAVAIEALKIYKERNIVDQVNKIAPRFQDGIKAFSDSPIIGEIRGTGLILGTEFTDNKSPNDPFPPEWGIGAYFGAQCEKHGMLVRVAGDNIMMSPPYIISPGEVEELISIYGKALKETEKKVQELKSQRK

SEQ ID NO: 17570 - protein, 199 aa, Lactobacillus acidophilus NCFM
MNYPQLNLDKVDGPKAILKTSYGDIEIQLFPEQAPMTVENFVRLAQKGYYDGTTFHRVISDFMIQGGDPQGDGTGGTSIWNHPFEDEFSRELFNLRGALSMANSGPNTNGSQFFIVQNKNMPKRYIKQMEPAGYPKEIINAYKQGGTPWLDGRHTVFGQVISGMDIVDKIAKAKKNKLDKPLEDIKIDSIKINKSIFND

SEQ ID NO: 17571 - protein, 912 aa, Arabidopsis thaliana
MESKFSQFHGRKDILPCCQRLGLFLGFIYLYAVFLSNSGIGAFAIIGCVQAQDQQEFISLDCGLPMTEPSSYTESVTGLRFSSDAEFIQTGESGKIQASMENDYLKPYTRLRYFPEERRNCYSLSVDKNRKYLIRARFIYGNYDGRNSNPIFELHLGPNLWATIDLQKFVNGTMEEILHTPTSNSLNVCLVKTGTTTPLISALELRPLGNNSYLTDGSLNLFVRIYLNKTDGFLRYPDDIYDRRWHNYFMVDDWTQIFTTLEVTNDNNYEPPKKALAAAATPSNASAPLTISWPPDNPGDQYYLYSHFSEIQDLQTNDTREFDILWDGAVVEEGFIPPKLGVTTIHNLSPVTCKGENCIYQLIKTSRSTLPSLLNALEIYTVIQFPRSETNENDVVAVKNIEAAYKLSRIRWQGDPCVPQKYAWDGLNCSNNTDVSKPPRVLSLNLSSSGLTGIIAAAIQNLTHLEKLDLSNNTLTGVVPEFLAQMKSLVIINLSGNNLSGPLPQGLRREGLELLVQGNPRLCLSGSCTEKNSKKKFPVVIVASVASVAIIVAVLVIIFVLSKKKSSTVGALQPPLSMPMVHDNSPEPSIETKKRRFTYSEVIKMTNNFQRVVGEGGFGVVCHGTINGSEQVAVKVLSQSSSQGYKHFKAEVDLLLRVHHTNLVSLVGYCDERDHLALIYEFLPKGDLRQHLSGKSGGSFINWGNRLRIALEAALGLEYLHSGCTPPIVHRDIKTTNILLDEQLKAKLADFGLSRSFPIGGETHISTVVAGTPGYLDPEYYQTTRLGEKSDVYSFGIVLLEIITNQPVIDQSRSKSHISQWVGFELTRGDITKIMDPNLNGDYESRSVWRVLELAMSCANPSSVNRPNMSQVANELKECLVSENLRENMNMDSQNSLKVSMSFDTELFPRAR

SEQ ID NO: 17572 - protein, 887 aa, Arabidopsis thaliana
MERSLELLLLLIRTLAIIHISQAQSQQGFISLDCGLPANEPSPYTEPRTGLQFSSDAAFIQSGKIGRIQANLEADFLKPSTTMRYFPDGKRNCYNLNVEKGRNHLIRARFVYGNYDGRDTGPKFDLYLGPNPWATIDLAKQVNGTRPEIMHIPTSNKLQVCLVKTGETTPLISVLEVRPMGSGTYLTKSGSLKLYYREYFSKSDSSLRYPDDIYDRQWTSFFDTEWTQINTTSDVGNSNDYKPPKVALTTAAIPTNASAPLTNEWSSVNPDEQYYVYAHFSEIQELQANETREFNMLLNGKLFFGPVVPPKLAISTILSVSPNTCEGGECNLQLIRTNRSTLPPLLNAYEVYKVIQFPQLETNETDVSAVKNIQATYELSRINWQSDPCVPQQFMWDGLNCSITDITTPPRITTLNLSSSGLTGTITAAIQNLTTLEKLDLSNNNLTGEVPEFLSNMKSLLVINLSGNDLNGTIPQSLQRKGLELLYQGNPRLISPGSTETKSGKSFPVTIVASVGSAAILIVVLVLVLFLRKKKPSAVEVVLPRPSRPTMNVPYANSPEPSIEMKKRKFTYSEVTKMTNNFGRVVGEGGFGVVCHGTVNGSEQVAVKLLSQSSTQGYKEFKAEVDLLLRVHHTNLVSLVGYCDEGDHLALIYEFVPNGDLRQHLSGKGGKPIVNWGTRLRIAAEAALGLEYLHIGCTPPMVHRDVKTTNILLDEHYKAKLADFGLSRSFPVGGESHVSTVIAGTPGYLDPEYYHTSRLSEKSDVYSFGIVLLEMITNQAVIDRNRRKSHITQWVGSELNGGDIAKIMDLKLNGDYDSRSAWRALELAMSCADPTSARRPTMSHVVIELKECLVSENSRRNMSRGMDTLSSPEVSMIFDAEMIPRAR

SEQ ID NO: 17573 - protein, 39 aa, Glycine max
LYISDNKVILTEGFDGVVPVKYFEKIETWPGRAPIPFQR

SEQ ID NO: 17574 - protein, 369 aa, Rhodopseudomonas palustris CGA009
MKTRAAVAFEAKKPLEIVELDLEGPKAGEVLVEIKATGICHTDAYTLDGFDSEGIFPSILGHEGAGIVREIGPGVTSVKPGDHVIPLYTPECRQCKSCLSQKTNLCTAIRATQGKGLMPDGTSRFSYKGQTIYHYMGCSTFSNFTVLPEIAVAKIRDDAPFDKSCYIGCGVTTGVGAVVNTAKVTPGSNVVVFGLGGIGLNVIQGAKMVGADKIVGVDINDDKEEWGRRFGMTHFVNPKKIDGDIVQHLVGLTDGGADYTFDCTGNTNVMRQALEACHRGWGVSVVIGVAEAGKEISTRPFQLVTGRVWKGSAFGGARGRTDVPKIVDWYMNGKIEIDPMITHVLKLEEINKGFDLMHQGKSIRSVVVY

SEQ ID NO: 17575 - protein, 400 aa, Silicibacter sp. TM1040
MTFLILLVLLAFALYSLFSKRIDRSVLTLPILFTGLGFLLSKPLSEVIPAGLIHEGKAGLAEVTLILVLFSDASHVRLRSLARGWQYPTRMLVIGLPLTIASGTAVAFWLNPSSGLAVALLTAAVLTPTDAALGQAVVNSPDVPDRLAQTINVESGLNDGLVLPFVLTGAILASGFAGEAHTAGLALEALIEVILGPLAGIAVGWVAARAMDWAQNRDLMQEAAGAVVFLVTAFAAYLFAVLIHGNGFIAAFVAGMVFGNSYRHNIHFISEFMEGAGQLLTMAAFLVFGAFLLPDGLAHAGVSTLVLALLFLTVVRMGPILLSLIGSGLPTREKLFLGWFGPRGLASILFTLLMMDQFDIPNEEELLACVSLTVGLSILLHGITSTPLASWISQEGKRNT

SEQ ID NO: 17576 - protein, 507 aa, Bacillus cereus G9241
MMNKGIVMDIKKHSVVVLTPNGEFITCKRKGDSCMIGEEISFDEQEQKASRFSIPYFLKPASLLVACFLCALLFFYNQPEEKVFAYVSVDINPSLEVSVTKDLRVIDLQACNDDGRRILKEMKRWENEQLQEVIRTIIKQSQEDKYLTNDKQVMLTAVAKDKSLRPQLEQVMQELKKEYEIKHITVEYQSSTMQVRENARKAGIGTGVYIKQENEKNKSLTPPATPSNPVEKEEEVQSQPESSSGAAPDLSSVKEKKYEKPEHEEQKKTEEQPSKQIKENNGRGFQQENRGNQQGNNGRESQQGNNGNQQGNNGRGSQGNNGNQQGNNGRGSQGNNGNQQGSNGRESQQGNNGNQQGNNGRGSQQGNNGNQQGNNGRGSQQGNNGNQQGNNGRESQQGNNGNRQGDNGRGSQQGNNGNQQGNNGRGSQQGNNGNQQGNNGRGSQQGNNGNQQGNNGRGSQKENGGNEQGNNGRGFQKENGGNEQGNNGRGSQQENRGHQQGNEKKNQ

SEQ ID NO: 17577 - protein, 192 aa, Bartonella henselae str. Houston-1
MFIQTETTPNPATLKFLPGCVVLSEGVLEFRDSEEAAKNSPLAAKLFNIPNVNGVFFGYDFITVSKKEGEWQHLKPAILGTIMEHFLSGDPVINTNATRQAQTHALNEEFYNEKDADIVLTIKELLETRIRPAVANDGGDITFRGFENGIVYLNMRGACAGCPSSTATLKHGIENLLRHFIPEVVGVEAMPQ

SEQ ID NO: 17578 - protein, 547 aa, Listeria monocytogenes str. 1/2a F6854
MTVKSGFDYMNNPLLNKGTAFSEEERANYQLDGLLPPIIETIEQQAVRIETQIENLETPLHKHQLLTNLYNENRTLYYYLVTKNVTDYLPIIYTPTIGDAVIQYHKEYTAPDEALFIDAFAPEKLSASIKNYAKNNPNIDMIVITDGEGVLGIGDWGVNGVKIAVGKLAVYTVAAGLAPDRVLPVVIDAGTNNETLLNDSLYLGNKGPRLSESEYDAFIASFVNVMKEVFPKAILHWEDFGRANASRILHNYRDKICTFNDDIQGTGAMVVAAVLATIQVSRIPLSEQKIIIFGAGTAGIGIADQLSAQLMRETGLPFEKAKKHFYLVDRKGLVLDNMTDLTTGQKKYAHPSAEWSNVPTDTLENLVEAVHPTMLIGCSGVTGAFKESIVKKMTQYTERPAILPLSNPTKLAEATASDLIQWTDGKALIVTGSPSKPVEYQNTTYEIGQANNALLYPGLGLGALVTRAKYITDDMLAAASMAVAEQISPNKAGAALLPHVRTLRETSRAVAIAVANQAIKENIHQVELTNVIEAIELEMWQPIYKGV

SEQ ID NO: 17579 - protein, 551 aa, Bradyrhizobium japonicum USDA 110
MGVQTCAVAGRGVVAYLLAMTAAQNDRSASTPSVASAHDKILIVDFGSQVTQLIARRVREDGVYCEIVPFNKAEEAFKEMKPKAVILSGGPESVHEAGSPRAPQLIFASGVPVMGICYGQMTMAAQLGGEVEGGHHREFGRADVEVKAQSKLFEDVWSSGSKNQVWMSHGDRITKMPPGFSVAGTSPNAPFAIIQDEKRKYYGLMFHPEVVHTPDGAKLIRNFVRKIAGLTGDWTMRAFREEEIAKIRAQVGKGKVICGLSGGVDSAVAAVLIHEAIGDQLTCVFVDHGLMRLNEAEQVVDLFRHHYNIPLVHVDASKQFLGELEGVTDPETKRKTIGRLFIEVFEAEAKKIGGADFLAQGTLYPDVIESVSFTGGPSVTIKSHHNVGGLPERMNMKLVEPLRELFKDEVRKLGRELGLPEIFVGRHPFPGPGLAIRCPGDITSDKLDILRKADAVYIDQIRKHGLYDDIWQAFAVLLPVKTVGVMGDGRTYDYVVGLRAVTSTDGMTADFYQFDMKFLGETATRIINEVKGVNRVVYDVTSKPPGTIEWE

SEQ ID NO: 17580 - protein, 213 aa, Frankia sp. EAN1pec
MSDIAAPGLAVPGPSLRSPGQNGPGFDEQVFNRLLRERIIFLGSVVEDSIANAICAQLLLLNAEDPERDIFLYINSPGGSVSAGMAIYDTMQYVENDVATVSLGLAASMGQFLLCAGAPGKRYSLPHARIMMHQPSGGIGGTASDIAIQAEQMLYTKRMMQERIAFHTGQPVEQIERDSDRDRWFTADEAKDYGFVDHVVQRARQVPSEGPVS

SEQ ID NO: 17581 - protein, 174 aa, Bartonella henselae str. Houston-1
MIRKTVPNTTFHTRVRDESIGGDNPYRWQEVNSDAYFKGKRVILFSLPGAFTPTCSTFQLPDFEKLYDEFKKVGIDEIYCLSVNDAFVMNAWGKAQGIKNVKLIPDGSGEFTRKMGMLVAKDNVGFGMRSWRYAAVINDGVIEHWFEEQGFSDNCATDPYEVSSPQNVLKTLKG

SEQ ID NO: 17582 - protein, 252 aa, Rubrobacter xylanophilus DSM 9941
MSGLEGKVALITGGATGIGRATALLFAREGACVLIGDINEEGASETVEAVRAAGGDAAFRRCDVSGEEEIAALVAAAGEEYGRLDVVFGNAGLLRTRPLEDLSTKEFELHLRINLTANFLLTKYAAPVMRRHEGGSIIFMASAGGLRGTRGSVAYNASKGGLVNMTRSLADELAPHNIRVNCVCPGWVDTPFNRPFWEHAGAGAEEEVLRGVPLRRQCTPEEVAPAVVFLAGEGASYITGEALVIDGGMLAT

SEQ ID NO: 17583 - protein, 408 aa, Nostoc punctiforme PCC 73102
MDLLEYQVKEWFGKIGIPVLPSQRIDHPTDLKRLKIRFPIVLKSQVHGAERAKAGGVRFAETTIDAIAAAQNIFSLPIWGELPEVVLAESQYDANQEFYLAVVLDTAVCRPVLLGCKEADIDWESAGEKMHHVVVEQEFSPFYARRLALKMGLQGTLMQSVSSVLEKMYHLFVQKDLDLVEINPLAVSANGQVMALNGKVRINERAIKRHPDLAEMAAKIISRHTSTEINGILGDWDGVKMHGKIGILGNGTGSVMATLDLVANAGGNPGVCLNLRHAFLTDTTPTTFRDRLETGLKILEADKGIQVILINFLGSIPQTEEVVKVIARVVQQDNSELESQVVRSNGSKSRQVQNFTPLVIRLAGSEFNAARKYLATLKTHSDALLVVENLDEAVAAAVRLAKPTANKK

SEQ ID NO: 17584 - protein, 92 aa, Coprinopsis cinerea okayama7#130
MYGFGDDRNPSNDTVNVMEEILIEYITDVCQVAGANSKRARLSVEDLRKALSRPADAKKLARLEELIFMQEDIKRARGMFDESDSIQNSTKF

SEQ ID NO: 17585 - protein, 515 aa, Methylobacterium extorquens
MIHPNTAPKAGAAKPAPDCTLVIFGVTGDLTHRLLMPALYNLARWKLLPERFAIVGVGRSEMGTDGLRHDLTRTMQGFVAERGGEFSADSLDREAWNRVVGRLDYLAGDVEDPATYEELSRRIGVSRDAQAAGGNVLFYLAVAARLFGPVVTRLGEAGLTREGEGAWRRVIIEKPFGHDLASAKALNREVLAALSEDQIFRIDHFLGKETVQNIMVFRFGNGLFEPLWNRDRIDHVQITVAETVGVEKRGSFYDATGALRDMVPNHLFQLFTMTAMEPPISFDAHAVRDKKEEVLMAVHQLSEDAAVREAVRGRYTAGAVRGQPVRSYRDEPDVDPASQTETYVALRLMVDNWRWAGVPFYLRTGKAMTRRDTEIAIQFKQAPLALFRGTAVEACIPNWLVLQIQPDEGISLQFGAKVPGTEVRLGAVNMDFLYKDYFQTQPSTGYETLIYDAMIGDATLFQRADNIEAGWRAVQPVLDAWSSGRAPMAAYPAGSAGPKEADDLLARDGRAWRPL

SEQ ID NO: 17586 - protein, 208 aa, Prochlorococcus marinus str. NATL2A
MTDSNNQSPNKKTSGSSSAPPAADGRQENRRSRGEKRGGRRDRRGQERDSEWQERVVQIRRVSKTVKGGKKMSFRAIVVVGNEKGQVGVGVGKAGDVIGAVRKGVADGKKHLVRVPLTRNSSIPTLSNGRDGAASVLIRPAAPGTGVIAGGSIRTVLELAGIKNVLAKRLGSKTPLNNARAAMVALSELRTHKATAKERGISLEQIYS

SEQ ID NO: 17587 - protein, 250 aa, Glycine max
SIIWDCFRPEDGRTLKPICLLQLCRIGVIIYDWFDISWLKNYYNFGFDHYNMSWRKMGIWGLVDCLLGNAGPFASGDWILPDLTIQGSIRLNYHIRTFPNTYYFSYATKRTTKIMGVKVPSSILGIHPLLFIRVLQMCQWRFPPDVPPPYKGYRDEDWQDNDGALNTISMTHPRLPIEHPNCLVEKESDCQPLQPGIWYYKYVEGDHILFIINRERAGVQFDVIYDSIFQRCRKHVFRKKLPTMPNEINH

SEQ ID NO: 17588 - protein, 164 aa, Synechococcus sp. WH 7805
MATFEGRFTDVQGLRIAVVIARFNDLVTGKLLSGCLDCLGRHGVNTAADSEQLDVAWVPGSFELPLVAQQLARSGRYQVVVTLGAVIRGDTPHFDVVVSEASKGIAAVARDTGVPVIFGVLTTDTMQQALERAGIKSNLGWSYGLQALEMGSLMKTLPTSLSVD

SEQ ID NO: 17589 - protein, 465 aa, Oryza sativa
  misc_feature (313)..(313): Xaa can be any naturally occurring amino acid
  misc_feature (329)..(329): Xaa can be any naturally occurring amino acid
  misc_feature (403)..(403): Xaa can be any naturally occurring amino acid
  misc_feature (447)..(447): Xaa can be any naturally occurring amino acid
MSLGVSVASARARAISRARARTGASTMSTALPISTPGAIARAATIPGTLALVPVKERVVAPCSPLPSEKPEAMASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETXFFYMAENNVMFEGILXLKPSMVTPGAECKDRATPEQVSDYTLKLLHRRIPPAVPGIMFLSGGQSEVEATQNLNAMNQGPNPWHVSFSYAXRALQNTCLKTWGGQPENREGRRRTRLLLRAKANSLAQLGKYTSXDGEAAEAKEGMFVKNYVY

SEQ ID NO: 17590 - protein, 247 aa, Aspergillus oryzae
MPKLETHWATIVTSYSPSTIEFTGTLLIQLLTFWLPSLIYLTLPTLFPTWSNNHKIQPAPKQPTKKEIHHCFKIVLRNQLLTTTLHLLQLNLLNKGTSSYTLTPTFPSLPILARDFLLSLLAREALFYYAHRFLHRPYFYVRIHKQHHKFTAPIALAAQFAHPIEQIFANALPISLPPQLLGSHVLTFWAFLGYELFVTATVHSGFDFFGGKARMHDLHHEKFNLNYGSLGLLDWVHGTDRLEKRRD

SEQ ID NO: 17591 - protein, 339 aa, Glycine max
MSSQGTGSVVDFDLPDEILSVIPTDPYQQLDLARKITSMAIASRVSSLESDASRLRQKLLEKDRIILDLEDRLSSLTRASHQTDSTLNTALNENIKLSKERDQLAATVKKLSRDFAKLETFKKQLMQSLTDDNASHAETIDIGTCDQSVPKAYPDKDDDGSGYMVHHSYNGPADVGKTNDEASRYSGQRFSLTPYITPRLTPTGTPKVISTAGSPREYSAAGSPKKTSGATSPTKLPYDGRTSLSSWYSSSQQSSAANSPPWGRSLPVRTPKIDGKEFFRQARSRLSYEQFSAFLANIKELNAQKQTREETLRKADEIFGSDNKDLYLSFQGLLNRNAR

SEQ ID NO: 17592 - protein, 487 aa, Salmonella typhimurium LT2
MCDCGGKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 17593 - protein, 346 aa, Silicibacter sp. TM1040
MKAVLYETFKELPKLVTVEDPTPDPDGVVIKVEATGLCRSDWHGWMGHDSDIVLPHVPGHEFAGVIVALGKNVRNWTVGDRVTVPFISGCGACSECHAGHQQVCHNQQQPGFTHWGSFAEYVGVRQADLNLVALPQEMDFATAASLGCRFATSFRAVVDQAQTRAGQWVAVHGCGGVGLSAVMIAQAVGANVIAIDIDDEKLNLAQELGAVATINGARVADVPEAVIDLSRGGAHVSLDALGHPLTCFNSIQNLRPRGKHVQVGLMLAEHSTPSVPMAKVIAKELEILGSHGMQAHRYDAMLDMIASGKLDPRRLVGREISLDAAPSALVKMDQFQSIGATVITTF

SEQ ID NO: 17594 - protein, 600 aa, Synechococcus sp. WH 7805
MALLVQKFGGTSVGSVERIQAVAQRIAACKEDGNDLVIVVSAMGHTTDELTAKARAINSNPPQREMDMLLATGEQVSIALLSMALHALGVPAVSMTGSQVGIVTESAHGRARILDVRTDRLRSRLAEGQVVVVAGFQGTSLSSGGTAEITTLGRGGSDTSAVALAAALGADACEIYTDVPGVLTTDPRKVVDAQLMPEVSCDEMLELASLGAAVLHPRAVEIARNYGVTMVVRSSWSDDAGTTLTSRSAQPIGREGLELGRPVDGAELVEEQAVLALSHVPDQPGVAAQLFESLSKGGVNVDLIIQSTHENNSNDITFTVAESELDKARCICNAQLQTLGGDLVAEAGMSKLSISGAGIMGRPGIAAGLFQTLSRVGINLRLIATSEVKVSCVIEASAGAKALQATQEAFELDSALISLNPLPSGEGEPEVRGVALDRDQAQVSVRHVPNKPGTAGALCHALADAGISLDGIVQSERQHADGSRDISFTLKRDDRAAADRALRGLLAQWPGALLEDGPAIARVSAVGAGMPATAGTAGRMFRYLADAGLNIEMIATSEIRTSCVVAESDGIAALRAVHTGFQLGGSTHHEAQGTESPLEK

SEQ ID NO: 17595 - protein, 629 aa, Salmonella typhimurium LT2
MAEFETTFADLGLKAPILEALTDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIQPSAEGEELDLETLAAALLKMAQGERPLILPPDAPMRPKREFRDRDDRGPRDRNDRGPRGDREERPRRERRDVGDMQLYRIEVGRDDGVEVRHIVGAIANEGDISSRYIGNIKLFASHSTIELPKGMPGEVLQHFTRTRILNKPMNMQLLGDAVPHAGGERRGGGRSFSGERREGGRNFSGERREGGRGDGRRFSGERRESRGPRRDDSTGRRRFGGDA

SEQ ID NO: 17596 - protein, 331 aa, Rhodopseudomonas palustris CGA009
MQPNQPHRFSVAPMMDWTDSHCRVFHRLLTRRGLLYTEMVTTGAVIHGDRQRLLGFDASEHPVALQLGGSNPNDLATSAKIGEDFGYDEININVGCPSDRVKEGRFGACLMAEPELVAEGVAAMKRAVSVPVTVKCRIGIDDQDPEVALDALARAVVAAGADALIVHARKAWLNGLSPKENRHIPPLDYDRVYRLKQAMPQVPIIINGGIGSIAEAKRHLEHVDGVMLGRAAYQEPWRLLEVDPELYGETAPYPSMKEALEALIPYIERQLAQGLRLHAITRHVIGAYQGVPGARAFRRYLSEFGVKPDADASVLLKAMVAVTERAEIAAA

SEQ ID NO: 17597 - protein, 315 aa, Salmonella typhimurium LT2
MKNNVCVIGSFNVDIISYLPRLPSTGESLLADKFIFSPGGKGCNQALAASYADSDVHFITKVGSDHFSDYAINFINSSKIHKSVIYQTKETQTGTATIMVNGDTGDNVIAIYPGANMTISPDEITIQKEAIVHSDIVLVQLETNYEALQQTIRLAQKNDIPVIINPAPYNDMVNTIIDNIDYITPNETEAGLLANMAVNDIESAKCAAKIIHQKGVKNTIITLGSKGSLAYDGTQFIYSPAFPAVVKNTAGAGDAFNGALASGLAKGKSLASALCYASAFASLAVETPNASDMPENDSVLHRIQGSHYKQTISTH

SEQ ID NO: 17598 - protein, 218 aa, Silicibacter sp. TM1040
MSLSEIKSRIAAAESAAGRVPGSVELIAVSKVQPNERVEAVLEEGHRCFGENRVQEAAGKWPQFREKFTGVDLHLIGPLQTNKARQAMELVNVIHSVDRPKLANALARLAQELGHCPDLFIQVNTGEEEQKAGILPQDADGFVAECRKLDLPIKGLMCIPPVDEEPSLHFALLAKMAERNGLNGLSMGMSGDFESAIALGATHVRVGSAIFGARAYSA

SEQ ID NO: 17599 - protein, 360 aa, Azotobacter vinelandii
MSKQILVLPGDGIGPEIMAEAVKVLQLANEKYQLGFVLGYDELGGAAVDKYGVPLADETLERARRRCHPARRRRRSEMGRHRPGHPPGARPAENPFATGPVRQPAPGVLYPQLAEASTLRPEVVAGLDILIVRELTGGIYFGAPRESRLLANGERMAYDTLPYSESEIRRIAKVGFDMARVRGKKLCSVDKANVLASSQLWRAVVEEVAKDYPDVVLSHMYVDNAAMQLVRAPKQFDVIVTDNMFGDILSDEASMLTGSIGMLPSASLDADNKGMYEPCHGSRRPDIAGKGIANPLATILSVSMMLRYSFGQVEAANAIEQAVSKVLDQGLRTGDIWSEGCRKVGTAEMGDAVVAALATL

SEQ ID NO: 17600 - protein, 274 aa, Oryza sativa Indica Group
MGLERAEQEPPSADAGKSDAAQAEGGGGDDDAEQEDAGSDDGYPQMTEKQKKLFELRLKMSWVFISLLFLVLQNEARKANQQAMVAEKKRMEPRAESRGVSKQKWLEDRKKKIGKLLDSNGLDMTKSYMLDTQESAEAKYKKWEKEPAPYGWDVFNQKTLYDAYKKRTKNIEVDMEAYNKAKEADPEFYRDASSLQYGKVSKVPEENIDRMVNELKERDEKRKAFSRRRKFHEDKDIDSINDRNEHFNKKVERAFGKYTLEIKNNLERGTALPD

SEQ ID NO: 17601 - protein, 437 aa, Oryza sativa Indica Group
MAAAKRPYCKPPPPTTTTTAITSSSGQNHKRLRPSLPAAAAMDGGMEEEAVCADDDEDNDKHQCRRSRCSPGCPDHLAQLCLSPLPPRLLHAVCRPWRRLMYTPSFPPFLSLYALLDDADADAGVSFAAYDPLAGRWDALPSPPMPSPPPMLWHPSFLARRLPLQSVAAAGRLVLVSGSTQSLHPALSRPLVFDPAAPTPRWQLGPRIPLSPRRWCAAGAARGRVFVAGGVGAGYDPAVARSGATWDPAASPPPAAAWEPIPPLRDGRFSRDAAEAVCSGGKVCMVNLRTPGAKEGAVFDLRAGRWEDMPPGMLAGWKGPAAASPPDDGETIYVVDEERGALTAYDWGADRWRTVAESDRLKGAAEMTVAGGKACVVAPGGGKVLIVDVTPPPPPPPAARRESWAAPPPPPRMWEVAAPGGKRVVSLHVLPRMTRPE

SEQ ID NO: 17602 - protein, 424 aa, Dehalococcoides sp. BAV1
METEIYFKFILSFGLILLVARLGGAIAERFLKQPAVIGELLAGIIISPFLLGQFLFANDPVIMNFALIDGVFSQNGEHLSGFAPMEIISQIAVVVLLFVAGLETNVTSFIKNSFTGAMVAIGGVVVPFALGVFSAMYFFPDLHMAGWLFIGAILTATSIGITVRILMDMGKLSSREGTIILVAAVVDDIIGLVILSVVISMAQSGSVNALSAVTTGVIGFAVWLGILLLGVYGHKYISKYILTPFKSSGTMPVMALIVGLIVSYLVTLVDLHPVVGAYVAGLMFASTMEKEEILHQTRPIMLFIAPFFFAYLGMQVDLREVWAVIVPALVIVVLAIIGKIVGCYFPARFVGKTSHNGAMIVGVGMVPRGEVGLIVAGAGLIAGAITRDLFGIAVAVSILTTLVMPVMIKPFFKPKAEANAKRLP

SEQ ID NO: 17603 - protein, 512 aa, Arabidopsis thaliana
MSPLISFTPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDEILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATIHVHLMLARMVQEFEWCAHPPGSEIDFAGKLEFTVVMKNPLRAMVKPRI

SEQ ID NO: 17604 - protein, 250 aa, Pseudomonas aeruginosa
  misc_feature (112)..(112): Xaa can be any naturally occurring amino acid
MSDLSGKTIIVTGGGSGIGRATVELLVASGANVAVADINDEAGEAVVAASGGKAAYFRCDIAQEEDVKALVAQTLAAFGGLDGAFNNAAIPQAGLPLAEVSLERFRQSMDIXVTGTFLCMKYQILAMIERGTKGSIVNTASVAGVVGVPMHGEYVGAKHAVVGLTRVAAADYGKHGIRVNALVPGAVRTPMLQRAMDNDAGLEPYLNSIHPIGRFSEPHEQAQAAVWLLSDAASFVTGSCLAADGGFTAI

SEQ ID NO: 17605 - protein, 282 aa, Triticum aestivum
  misc_feature (193)..(193): Xaa can be any naturally occurring amino acid
MADRGGERGGDRGGERGGFGRGFGRGGRGDRGGRRGGRRGPRQEEEKWVPVTKLGRLVKEGRFTKMEELYLHSLPIKEHQIIVETLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGFXGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 17606 - protein, 209 aa, Dehalococcoides sp. CBDB1
MKKIYDLSPEIRPDMISWPGDSCPEITLLHSIKYGSHSNLSRLTMTLHNGSHIDAPHHFFEEGIGAGEIPLEILVGDVRVLRFGGVKTITRKMLEHADLKGVTRLILATDNESLWKKPDFDENYTYIDIGAAQYLTEIGIRLLGIDYLSVEDFQGLDGVHKHLLSQGVVILETLQLAGVPEGDYELYCLPLKLGKVDGAPARVILIERD

SEQ ID NO: 17607 - protein, 220 aa, Dehalococcoides sp. CBDB1
MKDVKVVPAILTDDPAAFESMIKQSEGFAPVAQIDIMDGQFVPSLSIPPEVLGRYKPSFASEIHLMTLNPEEYLTYCKQHGARRVIFHFEATPRPEYVISRIKEMGFKVGLAVNPETSVAEFAHLVPQVDMVLFMSVIPGFYGAPFIPEVLLKVKEFKRRFPETEIGLDGGAKQSNIPEIVAAGVNDICVGSAIFRQSDPQSSYLYLDKLAKNSAKEAGL

SEQ ID NO: 17608 - protein, 357 aa, Mycoplasma mycoides subsp. mycoides SC str. PG1
MLFCYYYYWNEVIMDNKDIYVFGLSASQQLAKEVCHFLGVEQKVVKTTRFADGEILVESIDSVRGKEIYVIQSTSMPVNENLMELLIAIDAFKRGSAEKINVVIPYYGYARQDRKAKGRQPITAKLVADLLTKAGADRVIVFDIHSTQTMGFFDIPMDNFHTSQSLANEIVDTIIKEKFDPEKCILVSPDYGGLNRVHKVDSYTANMTNGIAVIGKRRPEPNKAEVEFVLGDIEGRTCFIIDDMIDTGGTIISGAKALKANGAKDVYIFACHGLFNGPAKERMTQAIKEGIVKNVVVTNTVEIPQERQFEGLKIVSVVPLLANMIKESQEHHSLTEVYNKNEDEIQLKIQDFMNHKN

SEQ ID NO: 17609 - protein, 489 aa, Dehalococcoides sp. BAV1
MKFQYDLVVIGSGLAGFTSTVFANGLGKKVAMVEKGKLGGACTWNACVPSKTLLQIGRRVGQIKKYNQNGLKLVSVNLQTENIMPYLHSVLEDISGVDDFDNLEKTGINILKGEAVFTDRHHISLNGQVVSAKHFIIATGSSPAIPPVEGLADIPYYTNETVFDIKSIPSSMIVLGGGPAGIELGLAFAWLGCKVDIIEMAERILPKDDTELSGLLLDYLNAEENLQIHVSTKAIRFQEQDNGQLKLEMQTREGKINEITAETVLVAVGRRANVAGLALEKAGVKYTARGISVNSKLQTSSLNIFAAGDVAGPIQLGMMAEKQAILAASNACLPFKQSIRYDDVAWVTYSEPQMAHIGLTEDEARRKYGNNIRIIRYPLTKVRRAVMDHDIRGMCKFVLDKHDRLIGAHLLCSQAENLIHELQIVKCLHKPLSRLHTIPHIYPTYEEGIIKRAADISYTMKMRRNPFVRLVLRYWHGYKDKLDTVINRL

SEQ ID NO: 17610 - protein, 446 aa, Aspergillus oryzae
MTTDSPETTRADGTTVQAAPSPESHYSTHIVLTTYPGQSGIDPVPLNWGAKDAKSRGPVVVSRSGPLLKRRNAMGAHGGSYSIYNALAIAAGDLPPDFRPDFKNSEPTFNFPWQPAWADKDKIVSMDPYGHDIVNQFRDELNAGWDIRPTMAVTRANMKLAEIGEAVRDGQLDVDGSIVVDSSGEVRVTKVAVEPVWYLPGVADRFGVSEPILRRTLFEHTGGSYPELITRPDLKVFLPPIGGLTVYIFGPPERVSDENVKLALRIHDECNGSDVFQSDICTCRPYLAFGIREAIREAQNGGSGVVIYFRKEGRALGEVIKYLVYNARKRGGDTADKYFTRTENIAGVRDMRFQALMPDILHWLGIKKIDRMLSMSNMKHDAIVQSGIKILERVPIPEDMIPDDSRVEIDAKINAGYFTTGRQYTMEELAEVKGRGWEKWEDITVS

SEQ ID NO: 17611 - protein, 406 aa, Arabidopsis thaliana
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNVCKLVGCKEMGEEVLKSVDSKVPV

SEQ ID NO: 17612 - protein, 351 aa, Lactobacillus acidophilus NCFM
MKRYLILEDGSSFSGEGIGASIISTGELAIQTTNFGYQEALTDPTNAGKILVFTSPMIGNNGINAIDYESIDPTVKGIIANDIALNISDSENFEDLSSFLKEKNIPAIFNVDTRALVHRLMEEGTIKASIMDTNDEHAFDQIKALVLPKNKSAMVSTKNAYASPNVGKTVAVLDLGLKHSMLRALSLRKVNATVLPYNASPVDIENLRPEGIIISNGPGRPEELIDKLAPVLDHFYGKYPILGIGLGFLILSSYLDFELVDLPQEFNGINYPVIEQNTNTIWQTSMNIDQLVLPDSIQMNMNREYFDLHSELMAGFWNTQDKLIATAFNPEGAPGTRDADEIFDYFVQMME

SEQ ID NO: 17613 - protein, 462 aa, Thermoactinomyces vulgaris
MANDASTVFDLVILGGGSGGYAAALRGAQLGLDVALIEKGKVGGTCLHNGCIPTKALLHAGEIADQAREAGQFGVKATFEGVDMAAVHKYKDDVISGLYKGLQGLVASRKVHYIEGEGRLSSPASVDVNGQRIQGRHVLLATGSVPKSLPGLEIDGNRIISSDHALKLDRVPKSAIVLGGGVIGVEFASAWTSFGTDVTIIEGLKHLVPVEDENSSKLLERAFRKRGIKFNLGTFFQSAEYTQDGVRVTLADGKTFEAEVLLVAIGRGPVSQGLGYEEAGVAMDRGYVLVDEYMRTNVETISAVGDLVPTLQLAHVGFAEGILVAERLAGLQTVPVDYDGVPRVTYCHPEVASVGITEAKAKELYGADKVVALKYNLAGNGKSKILKTAGEIKLVQVKDGAVVGVHMVGDRMGEQVGEAQLIYNWEALPAEVAQLIHAHPTQSEALGEAHLALAGKPLHSHD

SEQ ID NO: 17614 - protein, 517 aa, Oryza sativa Indica Group
MGSTGDCGNGKAAGGGRGGGLVVPEIKFTKLFINGEFVDAASGKTFETRDPRTGDVLAHIAEADKADVDLAVKAAREAFEHGRWPRMSGYERSRVMNKLADLVEQHADELAALDGADAGKLLTLGKIIDMPAAAQMLRYYAGAADKIHGESLRVAGKYQGYTLREPIGVVGVIIPWNFPTMMFFLKVSPALAAGCTIVVKPAEQTPLSALYYAHLAKLCTFDIIIQAGVPDGVINVIPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWRVGDPFDAATNMGPQVDKVQFERILKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 17615 - protein, 122 aa, Triticum aestivum
MAPVKMALGPQVPLKDLLHLHKEEEEGEDESLRRWKEQLLGPDAVHTTNLLHALGAVENQKVMLGTFSPQQEPYTYKAEEDSTPSGIFARGSYSARLKFVDDDGKVYLDMRYSFEIRKDWPN

SEQ ID NO: 17616 - protein, 362 aa, Silicibacter sp. TM1040
MSLMPTMLERIARARVDLRMGLPVILTTGESAILAISVESLSPERLTDLRSLGPVTLALTARRAATLKARVYDNDIARVTVPSDAGLAWVQALADPADDLETPMKGPLLSEREGDASLPRLAIAMVKSARLLPATAYVALENAGDFALKHDLTLLPQSAAEPLLNTSSPLHPVAAARLPMEASEAGRLHIFRPEDGGEEHYAIEIGRPDRSQPVLARLHSACFTGDVLGSLKCDCGPQLRGALSHMGQEGAGILLYLNQEGRGIGLANKMRAYSLQDQGFDTVEANHRLGFEDDERDFRLGASILRELGFSSVRLMTNNPGKIAMMEKTGISVVERVPLKVGENAFNRHYLATKAAKSGHML

SEQ ID NO: 17617 - protein, 489 aa, Candidatus Protochlamydia amoebophila UWE25
MKNQQNSVSSTLLILKKRSLILFQFFLIIIVYHTLKDLKDTIVITASDAGAEIIPFIKIWGMLPLAICASYFFAKFYNKFGREKTFYIFSSFLLVNYLFFAFVLYPFRKFFYLENVADYLHMILPVGAKGFVAMVSYWHYTLFYLTAELWSMLILSILFWGYVSDTTSLVEAKKFYPLCMFVGNMAGIISGQLSHFLCQHLSDFMSWERTLQWMIGIVCVCGLLIMIINRRLALTTDFSAIKQKVKKQIAPSSFKDNVMDVLRTGPLLCIAVLVVGFGLTTNLIEVIWKENIRQLHPTPQAYNAYINQLTSLIGTGAVCIALLSSWIFRKFTWTQIALTTPLCLLITSSAFFSSLLMPKELLAEIASFFQFSPTQLIVTLGSICYVFSMSAKYTIFDTSKEIAFLSIETEKRTYAKSVIDSIGSRLGKSGASCFYQFLLIAFGIASEHILLIGVVSIIMIGISIFATKKLGGQLSGKNENHRFIEASHG
